United States Patent 6,812,339 (POLYMORPHISMS IN KNOWN GENES ASSOCIATED WITH HUMAN DISEASE, METHODS OF DETECTION AND USES THEREOF) - sequence listing, part 83

SEQ ID NO: 18849 - DNA, 601 bp, Human
agcgagaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgttttgtagtaatttttatttggtttcaacagtcaatgaaaataggttaataaaatgtctagtatttcataataacctactgtgtgttacatattayaccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgt

SEQ ID NO: 18850 - DNA, 601 bp, Human
ctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccayagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaata

SEQ ID NO: 18851 - DNA, 601 bp, Human
tgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccwtgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgc

SEQ ID NO: 18852 - DNA, 601 bp, Human
tgtcatatataatagaaaacaaatctacttagggaaaacataataagagaaagattaattgagggcatttccctttaaaacggtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgyttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttc

SEQ ID NO: 18853 - DNA, 601 bp, Human
gcatatctgtgagtagatgagcataaaagtggtgtactactgaggaaattatattctcccacattgtttttgatccccttcaattttgacacttgctgcaaaagactttatcttgataagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcaytttaaaacataacatttaggtcagagaaaatttgctgctatcgtttttaaaaatcttctttgccatgccctataaacaaacttttgtttttccaataatataatatattatataaatagttttatattatattatatattatataatatatataataatatataatatattatatttatataatatatataataatatataatatattatatttatataatatatataataatatataatatattatatttatataatatatataataatatataatatattatatttatataataatat

SEQ ID NO: 18854 - DNA, 601 bp, Human
agcagtaagttgcattttaaaacataacatttaggtcagagaaaatttgctgctatcgtttttaaaaatcttctttgccatgccctataaacaaacttttgtttttccaataatataatatattatataaatagttttatattatattatatattatataatatatataataatatataatatattatatttatataatatatataataatatataatatattatatttatataatatatataataatatataatatattatatttatataatatatataataatatataatatattataattatataataatatataatatattatataatatataatataaatagtttttggtaagaaagaaagagcaggagacaaagaaagaaagagagaaacagagagaggaaggaaggaaggaagggaggaaagagggaaggagggagagagggagggagggagggaggaaggaaggaagaaggaaggaaggaagggaggaaagagggaggagggaggagggagggagggaggaaggaaggaagagagagagagaaagaaaggaagaaagggagaaagacctggagtttgctaatagagttggcag

SEQ ID NO: 18855 - DNA, 601 bp, Human
gcagtaagttgcattttaaaacataacatttaggtcagagaaaatttgctgctatcgtttttaaaaatcttctttgccatgccctataaacaaacttttgtttttccaataatataatatattatataaatagttttatattatattatatattatataatatatataataatatataatatattatatttatataatatatataataatatataatatattatatttatataatatatataataatatataatatattatatttatataatatatataataatatataatatattatatwtatataataatatataatatattatataatatataatataaatagtttttggtaagaaagaaagagcaggagacaaagaaagaaagagagaaacagagagaggaaggaaggaaggaagggaggaaagagggaaggagggagagagggagggagggagggaggaaggaaggaagaaggaaggaaggaagggaggaaagagggaggagggaggagggagggagggaggaaggaaggaagagagagagagaaagaaaggaagaaagggagaaagacctggagtttgctaatagagttggcagg

SEQ ID NO: 18856 - DNA, 601 bp, Human
ctttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccargtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattatgggattattttattatggtaattaattattattttattatggtaattaattattgtagaaaattattatgggattattttattatggtaatttattatgggatccat

SEQ ID NO: 18857 - DNA, 601 bp, Human
cagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacarcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctcttgaataatatcattgctctgttttgtttttattttattttatggttggtttttaaagcccaatatgtggcgggatccagagaagc

SEQ ID NO: 18858 - DNA, 601 bp, Human
acagagcacctctgatgggtccaaaagacaagaaactggaggctttcagtcagtaaaattccacactgtaggttgtcttgcaggtagatcggatgaggcgcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctccwaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactgtctgccagggttgtcctgaggagtaaatgagtacat

SEQ ID NO: 18859 - DNA, 601 bp, Human
catgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagtggctataaaatatttagagtaatgcctagcatgtaagtgctatggaagcatttatcattattattattatctttattagttttattaattgtgttatacattgtgctttggcacaggaaaactagctarttactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagtaataaccaaaacagcaatgactaacatttatttagtgtttactcggtgtaaagtatttttctaaacaccttccacagctggtgtgtaatgctgtgagcaatg

SEQ ID NO: 18860 - DNA, 601 bp, Human
atttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccgctatgtggcatgcattccttgtcttggatggctttgaagatattctcaaacattatttttgcaatctttgaaaaagtacaaaaggtagataactttgtacyctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattggtttttactgcagatcgggctcatcaaggaaaaactaatccgtacagcataaacaaattagaaatgaacttaaaataaatatacaaacaaaatag

SEQ ID NO: 18861 - DNA, 601 bp, Human
tggcatgcattccttgtcttggatggctttgaagatattctcaaacattatttttgcaatctttgaaaaagtacaaaaggtagataactttgtactctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattrgtttttactgcagatcgggctcatcaaggaaaaactaatccgtacagcataaacaaattagaaatgaacttaaaataaatatacaaacaaaatagtaaactttgtagtacccgaatataaggtgttacagttaacatggaatctgataacaccaattctttcctttcttaaacttcataggaaagctaaaaatactttaacttttgaaattaataaatgaaatacatcttatatttattgaacagctcctttctgaaatacattgtactataatataaaagatgaatgaagtaagttttt

SEQ ID NO: 18862 - DNA, 601 bp, Human
aaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtatgtgctgctgacatgcagctagggaaaacctccctcaattctgtttccattgctcagttttaacttcattcagtgtttgttatacctgcttcattaagctaaacaaacagatggacaaaatctcattgccagacatggagttttcattgrtatgcatttgttggcataccgataaacactgcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttag

SEQ ID NO: 18863 - DNA, 601 bp, Human
acagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctrtgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtc

SEQ ID NO: 18864 - DNA, 601 bp, Human
agctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctrtgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaattgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaa

SEQ ID NO: 18865 - DNA, 601 bp, Human
taactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctgtgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaaytgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaata

SEQ ID NO: 18866 - DNA, 601 bp, Human
tgcctaggaaagcaaaacagaaaaattatgaagtctctcaatggccaactaatgaatataaaaatactatttttcaaatgtttatactggaataagcacacaagacagcagaaaatcttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaatatacttaaaaaacrctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgt

SEQ ID NO: 18867 - DNA, 601 bp, Human
ctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttawacatagcaaaggtacattaaaaatatagttttataatcttatgggaccactgtcgtacacatggtcctatcattgaccaaaatgtcattatgcagcagcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaaga

SEQ ID NO: 18868 - DNA, 601 bp, Human
aatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggacyggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagt

SEQ ID NO: 18869 - DNA, 601 bp, Human
gacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgcagctatgcatgaggagaggactgagcctgaaacacaagacggttctcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaa

SEQ ID NO: 18870 - DNA, 601 bp, Human
tgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactyctaccttttattcataaatcaagcaatgtctgcagctatgcatgaggagaggactgagcctgaaacacaagacggttctcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtaca

SEQ ID NO: 18871 - DNA, 601 bp, Human
aggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgcagctatgcatgaggagaggactgagcctgaaacacaagacggttytcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacacttttt

SEQ ID NO: 18872 - DNA, 601 bp, Human
caggagcagatgaaggaagagatatgttaataagtgaattaaagttggataagatttcccaggctaatgttatccaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccrcctgaagcacatagaagccaataacgttggcactggcttcggagaaaagaaaggctttactgcaaaattgttcagcaaggagacaagagtcaggttcaaatctgtctccctaatttgggatatggggaaggttgcaagggatcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtcca

SEQ ID NO: 18873 - DNA, 601 bp, Human
ctgaagcacatagaagccaataacgttggcactggcttcggagaaaagaaaggctttactgcaaaattgttcagcaaggagacaagagtcaggttcaaatctgtctccctaatttgggatatggggaaggttgcaagggatcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccagrttttgattttgtccctgtcttgttggttcaaggggaggaatagttggttcctggtgttgttagagttcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgatt

SEQ ID NO: 18874 - DNA, 601 bp, Human
ttgttcagcaaggagacaagagtcaggttcaaatctgtctccctaatttgggatatggggaaggttgcaagggatcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccaggttttgattttgtccctgtcttgttggttcaaggggaggaatagttggttcctggtgttgttagagktcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgattggttagcaggatcaataacagggtgtgttttcatttttgtttcattgttgttttatatgatttgta

SEQ ID NO: 18875 - DNA, 601 bp, Human
atagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgacggagtggcagtgctcacacacccttagaagtttccagtgccttcccaaggaaagatcagactctttgagcattagaaaccctctgtaatctgactacctttccaggctccaagccctcaactccattctatataawgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgta

SEQ ID NO: 18876 - DNA, 601 bp, Human
catctataatctcaggaatcattgataggccacctactttacactaatattgtgacaataagtgtgtaaaggacactgttggtgccctgcctaggcacctacactgaagccttctctccaacagaagaggcagaaaggcctgaatgtttacccgcccttcctgcagtggcccatgactaaccagcgtgagagtacaaaagtccagctctttggcccctaagtggaacaagttttgagatcttattttatgctccagagcactccatggaatcaggctaagactgggacatcacctgaaatyatacccttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcat

SEQ ID NO: 18877 - DNA, 601 bp, Human
gcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattartccttacaaaaccaataaaattcaaattaaaaacattaatataaagtaacatgattttggctgaatggaaattgctgcttgcaacaagaataggatattgactattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggcca

SEQ ID NO: 18878 - DNA, 601 bp, Human
gaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattaatccttacaaaaccaataaaattcaaattaaaaacattaatataaagtaacatgattttggctgaatggaaattgctgcttgcaacaagaataggatattgastattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggccatattcatctctcaggtgcctagcctgggatccagaaatgcttacattaatatttaaggttatcatcaaaatgaaaacacatgattagaatcttgtactaaag

SEQ ID NO: 18879 - DNA, 601 bp, Human
aggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcgatgtctagtgaaggcctgttcctcacagagggtgacttcttgctatgaccccacrtttaattcatttaatatctggatactgaggaaaaggatagctagctctctggggtctctttaataagggcactaatcccaatcatgaaggctacattctcatgactcaatcacttcccaaaggctccacctacctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaa

SEQ ID NO: 18880 - DNA, 601 bp, Human
gaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcactkaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtcaacctttcactctacataatactatgataatattgactgggagattcagcaaaagtttcacaaaaataacagcatcatagcagaagtggagaggaattggaaga

SEQ ID NO: 18881 - DNA, 601 bp, Human
gactaagctaaggaattggtttttatcctgagagccataggaagcaattgaaatattgcagtcatgggttaaaataaaatgttgcagaatttgagtggctcactgaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtyaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccag

SEQ ID NO: 18882 - DNA, 601 bp, Human
tcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgattgagacaaggataggtgctattttagataggtaatcagaggagtggctattaccagaatggagggaggamacaagccaaagagtaggaagagcacatagtgggaatatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctg

SEQ ID NO: 18883 - DNA, 601 bp, Human
aatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctrttctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatagattctagaattcaatatgtagtaccaatataactattcagcacttatattttagttagaaatggatgctccatctttctttaaaagtagttttaattccttaactagtatcgcataacttttcttcgcttg

SEQ ID NO: 18884 - DNA, 601 bp, Human
ataagtaaaaaatagaccccaaatggagaaatagcaatatttgtctctcactgattttactcttctaggccaggattgagtttcatgtacttttgagacaagctatatgttccaaagaaaaattataatctattctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatarattctagaattcaatatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaata

SEQ ID NO: 18885 - DNA, 601 bp, Human
accccaaatggagaaatagcaatatttgtctctcactgattttactcttctaggccaggattgagtttcatgtacttttgagacaagctatatgttccaaagaaaaattataatctattctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatagattctagaattcaayatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattt

SEQ ID NO: 18886 - DNA, 601 bp, Human
aacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcaygcctgtaatcccagcactttgggaggccgaggtgggcagattgcctgagctcgggagttcaaaaccagcctgggcaacatggtgaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagt

SEQ ID NO: 18887 - DNA, 601 bp, Human
ttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcatgcctgtaatcccagcactttgggaggccgaggtgggcagaytgcctgagctcgggagttcaaaaccagcctgggcaacatggtgaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaa

SEQ ID NO: 18888 - DNA, 601 bp, Human
tcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcatgcctgtaatcccagcactttgggaggccgaggtgggcagattgcctgagctcgggagttcaaaaccagcctgggcaacatggygaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgt

SEQ ID NO: 18889 - DNA, 601 bp, Human
tttgatgcttgtccaaaggttttgactagcataaatagtagagaatcattttcaaatcctgatttctgttaattatgaacacactagctatatggcctttctgtggataggcttaattaggagggtctgggcaaagctttgctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaayacattctgtttcaaatttcagtttcatgtttctaatggaatcaaaacaatttattgttaaaaggatggcttttgaaaatttggtcccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaa

SEQ ID NO: 18890 - DNA, 601 bp, Human
tagctatatggcctttctgtggataggcttaattaggagggtctgggcaaagctttgctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaacacattctgtttcaaatttcagtttcatgtttctaatggaatcaaaacaatttattgttaaaaggatggcttttgaaaatttggycccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttac

SEQ ID NO: 18891 - DNA, 601 bp, Human
tgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttggtctcttctgggaagtgcacctaccccagaaagattttgtgaaattaattccagtaatgtagtacaagtgctctgaatctcacagcatgcttcacaaataargtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattccttttttgaatcatcccaccagaa

SEQ ID NO: 18892 - DNA, 601 bp, Human
gaaagattttgtgaaattaattccagtaatgtagtacaagtgctctgaatctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcrtataattaggacgttcttcatttgagtaccattgagtgccctgacattccttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaatt

SEQ ID NO: 18893 - DNA, 601 bp, Human
aatctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattccttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgc

SEQ ID NO: 18894 - DNA, 601 bp, Human
tctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattmcttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcct

SEQ ID NO: 18895 - DNA, 601 bp, Human
cacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattcctgttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaa

SEQ ID NO: 18896 - DNA, 601 bp, Human
cgacacagctaaagatgtactggcacagattacagagctccaccagaacctcgatggcctgaagaagaattacaataaactagcagacagcgtcgccaaaacgaatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctrgaatccaagtcttctagctctgccccggtgcttttttcctctgaaatttttccagttgagaagagattaggaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttatta

SEQ ID NO: 18897 - DNA, 601 bp, Human
cagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcrtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaactgaatttctctatagaattaactagattatgctgtttctgataacac

SEQ ID NO: 18898 - DNA, 601 bp, Human
tggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagaygtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaacta

SEQ ID NO: 18899 - DNA, 601 bp, Human
ctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgaca

SEQ ID NO: 18900 - DNA, 601 bp, Human
agggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacattaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaagga

SEQ ID NO: 18901 - DNA, 601 bp, Human
agatttctgagtgcttttcccctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctcyggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggat

SEQ ID NO: 18902 - DNA, 601 bp, Human
tcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcamccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttct

SEQ ID NO: 18903 - DNA, 601 bp, Human
ccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattartagtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaaggtcattctcattagctccatg

SEQ ID NO: 18904 - DNA, 601 bp, Human
ctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattaatwgtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaaggtcattctcattagctccatgta

SEQ ID NO: 18905 - DNA, 601 bp, Human
gggagctgttaaatacattaatagtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaagrtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaact

SEQ ID NO: 18906 - DNA, 601 bp, Human
tctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaattwgaattggtaaaattaacaaacatgcctgagcattatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgg

SEQ ID NO: 18907 - DNA, 601 bp, Human
tccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaatttgaattggtaaaattaacaaacatgcctgagcatwatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacc

SEQ ID NO: 18908 - DNA, 601 bp, Human
tgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaacygggtttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaatt

SEQ ID NO: 18909 - DNA, 601 bp, Human
gcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaaccggktttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctg

SEQ ID NO: 18910 - DNA, 601 bp, Human
gaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctcygcattttatatcttttaaatctggaattaccagaaatgtgatgcatatttcattttctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgac

SEQ ID NO: 18911 - DNA, 601 bp, Human
tatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttastgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgac

SEQ ID NO: 18912 - DNA, 601 bp, Human
aggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcrtgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacattacagacaaaagaatagaattgtggagaaggtcagcagctcacctaaagttagaagctaggaagtgtttatttactgatgatgaaaactggtatagcaaaaagtaatcagcattcgtggattaaata

SEQ ID NO: 18913 - DNA, 601 bp, Human
tgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacctatgggatytaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaat

SEQ ID NO: 18914 - DNA, 601 bp, Human
gcagtgtcagccctttcttataccccttgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacagttgtgtaagtttttagcaggtcagccccaaccctattttcccataagccctgttatttgtaagaataatttttatagaactcctggtgtttgtttgtttgtttgtttgtttatttgttgytttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgct

SEQ ID NO: 18915 - DNA, 601 bp, Human
tgtattctcagcccatccagaaaccccgcccctttgcccaaataccactaagacacccttaagcatcaatataactatctactaccaagtgcttttacaaaacataaagcacttaaaaaaactaatgacttagttattgcacacctcatgaaaggtgagaggtggtttttacttattctagcacggtggcagtagagatggagataagtggaaggaatgaagatgtatttagggtatttcctgccctacaacagcctatagtctcattgctattcagtgatgcattgaataatgacagacygaatagatatgatctgattcatgtgaaatgtctctcttctcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctggtaaagatcatatgcatagcagagtttccgtgactaaaatgcgtttgcttcttttatcagttattggtaaaatcatcagttattggtaaaatta

SEQ ID NO: 18916 - DNA, 601 bp, Human
gctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcrtacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtga

SEQ ID NO: 18917 - DNA, 601 bp, Human
ttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacrtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtgaaataataaaaataaaaataaagacattcggaacactaagctgaattggctaatgctataaactctaaagatagtaatatgcttggtagatgtacggtataacaaac

SEQ ID NO: 18918 - DNA, 601 bp, Human
tggacctggaggtcattatcctaagtgacataacccagaaacagaaaatccaataccatatgttctcacttacaaggcgagaagctaaacaatggatacacgaagacgtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtraaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagtta

SEQ ID NO: 18919 - DNA, 601 bp, Human
ggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagygaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaatt

SEQ ID NO: 18920 - DNA, 601 bp, Human
taaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaattattcacccaggacacaagaaagcatattttttatasaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgc

SEQ ID NO: 18921 - DNA, 601 bp, Human
tcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgrattcagataaagtttaaaagaactccactgagtttgggtataggcaggtccctgaggactttagcaagaccagagatgacagagtagtgggagaggaattgaaataaggctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgc

SEQ ID NO: 18922 - DNA, 601 bp, Human
aaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtccttttttaataaggcaattgtgtttgattttattgaagacacatctttttgaaatgatagggctatagacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagaataaacatttagaaatt

SEQ ID NO: 18923 - DNA, 601 bp, Human
gaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagrataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggcggtagtgagagggatcaatgagataaggagttcctgtctgctttctaaacaatgcagtttgaacag

SEQ ID NO: 18924 - DNA, 601 bp, Human
acccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggcggtagtgagagggatcaatgagataaggagttcctgtctgctttctaaacaatgcagtttgaacagagaagtgcctcatctttccttttttccatctatttctgaattcttatcttcatmacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatatttctaattaattatctgattcctaattagatatctttgttattta

SEQ ID NO: 18925 - DNA, 601 bp, Human
cctcatctttccttttttccatctatttctgaattcttatcttcatcacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatrtttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaa

SEQ ID NO: 18926 - DNA, 601 bp, Human
tagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacacygccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattaacaccacataaagaattatctttttcacttctatataccttcactattcaaaatagtagccacaagtcacagtagctatttaattgtaaattaaatcaaattaaataacaataaatattcagtttctcattga

SEQ ID NO: 18927 - DNA, 601 bp, Human
ctgactgactgaacgaaaagaaaaccttgggaacaaggaaaaattatcaatgaaaataaagaagttccagaaaggagtgcgggggtggaaacagacagacacctgacatgaaataaatcacctgatatacaccgccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattamcaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaacgactgatttggacagtgcagaacagacaatatccatcatcacaggaagttctgtggaatagcactgttataattaaagaagtatcatcatcactgacattctgatagcctttgtttgttgagc

SEQ ID NO: 18928 - DNA, 601 bp, Human
tgtttttcattaagataaaaaaaggaacttggcatcatgggacaatgaggagagaattaatcatcaccctatcaactacaatatattgatgccgactggacagtttttaccgatgctgattaacaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaackactgatttggacagtgcagaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtagatactatgattattattatcatgcccatttcacatataagaacactgagtcttggagaacttagatcacttgcaacatctggactcaagggcaaggacttcatttcctaatctgctggc

SEQ ID NO: 18929 - DNA, 601 bp, Human
gtgcagtgctattccttaatttattaaacctttgcaatttgattatgtagatactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgtgattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactctgttgcctcaggctggtcttgtcttgaactc

SEQ ID NO: 18930 - DNA, 601 bp, Human
tgggtttttgcatttggttgctttattttgttattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactmtgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaa

SEQ ID NO: 18931 - DNA, 601 bp, Human
attcactgcagccttggcctcctgggctcaaaagatcctctctcctcagcatctccaagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttrgactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatgtaaagcatcaataagaagtcagttaattcctgtacctcatgtttaaatgctgtgggtga

SEQ ID NO: 18932 - DNA, 601 bp, Human
cactctgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatgtaaagcatcaataagaagtcagttaattcctgtacctcatgtttaaatgctgtgggtgagattattgttaaaggggagaaggactacaaaaagactccttctgcaggataacatgaacatccatttagaccaaccagtagataatggaaaccagagtttgctgggtacacgtgtgcacagtttgataga

SEQ ID NO: 18933 - DNA, 601 bp, Human
aatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttstctttggtgaaaaaaataaaacttatttcattacacatgtaaagcatcaataagaagtcagttaattcctgtacctcatgtttaaatgctgtgggtgagattattgttaaaggggagaaggactacaaaaagactccttctgcaggataacatgaacatccatttagaccaaccagtagataatggaaaccagagtttgctgggtacacgtgtgcacagtttgatagacatgtgcctgcatgtgtctgctccacaaggcttccttcccatagtcagagactacactaccatcaccctaat

SEQ ID NO: 18934 - DNA, 601 bp, Human
gtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatrtaaagcatcaataagaagtcagttaattcctgtacctcatgtttaaatgctgtgggtgagattattgttaaaggggagaaggactacaaaaagactccttctgcaggataacatgaacatccatttagaccaaccagtagataatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggcc

SEQ ID NO: 18935 - DNA, 601 bp, Human
tttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatgtaaagcatcaataagaagtcagttaattcctgtacctcatgtttaaatgctgtgggtgagattattgytaaaggggagaaggactacaaaaagactccttctgcaggataacatgaacatccatttagaccaaccagtagataatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaata

SEQ ID NO: 18936 - DNA, 601 bp, Human
aaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatgtaaagcatcaataagaagtcagttaattcctgtacctcatgtttaaatgctgtgggtgagattattgttaaaggggagaaggactacaaaaagactccttctgcaggataacatgaacatccatttagaccaaccagtagayaatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctc

SEQ ID NO: 18937 - DNA, 601 bp, Human
ggctgcctcaaagatattgaaatttcaagaactccgtacaatatactcagtagtcccgattatgttggtgttaccaaaggatgttccctggaggttggtctgtttttgatagttctctaaacacatttatatcagatttcacttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaatttyccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattgaagtttacacaagtagcaagtagtaatttacaccgtagccattagtgcatagtctgttgtctacaaacttgaagtctagcccccttgtctttgaaataacatagactgggacctgtggcaa

SEQ ID NO: 18938 - DNA, 601 bp, Human
tgttaatatattttacttttctactgatcctactcttaaacgataaagcaagattaaagcattctctaaattaccatgataaaaaatggtattatgaagtcctagaattgtgatccaattttccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattsaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttcgtttaactattttgcactgtttcttcagttgacactgacccatatgtgagaaagaccccggccatagctct

SEQ ID NO: 18939 - DNA, 601 bp, Human
tttaaatttattttacttttatgtgttgtatatagctttattagcaaccttacattttttctggaaccattgaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttygtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaacgttaaatatgtcattctcatacatttttaattatcctatcataatacaattattcattttgtctgctgcttctaatcaaaattatcttaaaccactccaatagaattagggaaatgaagggaaaa

SEQ ID NO: 18940 - DNA, 601 bp, Human
gactgggacctgtggcaatcaactctgcaaagacttgtgtttgacatgcctgcaaagtcctttgttagctgatatcctcagtaactcttctttgatgctaaagcatcctagcattcccctattttcgtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaaygttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactctgagaagtttgggaataagaaaagagaaaacacattaagaactaaaac

SEQ ID NO: 18941 - DNA, 601 bp, Human
catacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactctgagaagtttgggaataagaaaagagaaaacacattaagaactaaaactgtaaggacccatactgkcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctct

SEQ ID NO: 18942 - DNA, 601 bp, Human
actaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtrgaaagtcctcctgccattaaaagtgactatctacatttactgagagagtgatatcttccacatatgtaagaaaaaaaagtcattaggaatgaacatgtctatcaagattcattttaaatacagggaggaggagagaggaagatggcaaggttgtgaaagagtgaatgaatgaatgaatgaatgaattatagaaagctatatgcttctgcacagctttgagattgagatggggagctgattttctcccttttgcaccttatttacatttctacttgaaatgtaactgttttaattttatac

SEQ ID NO: 18943 - DNA, 601 bp, Human
taccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtagaaagtcctcctgccattaaaagtgactatctacatttactgagagagtgatatcttccacatatgtaagaaaaaaaagtcattaggaatgaacatgtctatcaagattcattttaaatayagggaggaggagagaggaagatggcaaggttgtgaaagagtgaatgaatgaatgaatgaatgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgttttatttatttttaaggtttggtcttatcactggggaaaaatgcagacacagataatggtc

SEQ ID NO: 18944 - DNA, 601 bp, Human
aaaggattctttgcttttactcctacaaaatctaggactttaaaaatgaatattttaagcactttaaattcctaactacatgggcttgcttaaataaatactagcaaattcataaagtagaaagtcctcctgccattaaaagtgactatctacatttactgagagagtgatatcttccacatatgtaagaaaaaaaagtcattaggaatgaacatgtctatcaagattcattttaaatacagggaggaggagagaggaagatggcaaggttgtgaaagagtgaatgaatgaatgaatgaawgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgttttatttatttttaaggtttggtcttatcactggggaaaaatgcagacacagataatggtcatacccatctgtaaaacataaacaattaagtgatagagtttattcaagagatattcgttac

SEQ ID NO: 18945 - DNA, 601 bp, Human
gaagtaatagtcttttgggcctgactcatcccatcctctctggacacaaagaagggcagaaaatggatctgggagaaagcaagtagaacacaaccaacacagacagggacaattttatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaamtgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgattctgttaaaagcaatccctcaactgcccagatttaagcatcatacctcttattgccttggtattctttaatatcttcaatcacattttttaaaacgtaattttccatttaatctagtttttc

SEQ ID NO: 18946 - DNA, 601 bp, Human
ccatgtctgtaatcccagcactttggcaggtcaaagcaggaggatcgtttgagcccaggagtttgaaactaggctaggcagcatgataagaccctttctctacaaaaaatgtttaaaaattaaatgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgrttctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaa

SEQ ID NO: 18947 - DNA, 601 bp, Human
atcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctrtaatcccagttacttgggaggctgaggcaggagaattgcttgaacctgggaggccgaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaag

SEQ ID NO: 18948 - DNA, 601 bp, Human
tttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagytacttgggaggctgaggcaggagaattgcttgaacctgggaggccgaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgat

SEQ ID NO: 18949 - DNA, 601 bp, Human
acccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggcygaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaa

SEQ ID NO: 18950 - DNA, 601 bp, Human
aaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggccgaggttgcagtgagccgagattgtgccattgcactccagcctgcgcgacaatgtgagactccgacycgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatat

SEQ ID NO: 18951 - DNA, 601 bp, Human
aatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggccgaggttgcagtgagccgagattgtgccattgcactccagcctgcgcgacaatgtgagactccgactcsaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatag

SEQ ID NO: 18952 - DNA, 601 bp, Human
aaataaattcacaataaattaaagtcttaaatatggaaggacaaaaatctttaaaattcttagaagaaaatataccaggattaaattttgaccttcgggaaaagaacacttgattgaacaaaacaagattataagtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgytatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagtgttcatcagctggagaacagagaggcaaactg

SEQ ID NO: 18953 - DNA, 601 bp, Human
tttataatgggatatcgaaaccatactggttgttatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagwgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggta

SEQ ID NO: 18954 - DNA, 601 bp, Human
ctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaacsgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgcaatactcctcaacaggggccgtctggaagtgcatctctccacaggggcacgaacaatgaggaaaattgtgatcagaccagagccaaatctgtttcatgatggaagagaacattccgttcatgtagagcgaactagagggtaacaatagcactaa

SEQ ID NO: 18955 - DNA, 601 bp, Human
ataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaaccgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgyaatactcctcaacaggggccgtctggaagtgcatctctccacaggggcacgaacaatgaggaaaattgtgatcagaccagagccaaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttc

SEQ ID NO: 18956 - DNA, 601 bp, Human
tatattaatatatccactttccagatcatctcacaagcaaaaatggtaaatgattagaaagatatttccagctgttttcaaaaccgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgcaatactcctcaacaggggccgtctggaagtgcatctctccacaggggcacgaacaatgaggaaaattgtsatcagaccagagccaaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacc

SEQ ID NO: 18957 - DNA, 601 bp, Human
gccataaatgagacttctgtttaatcttcaataaccacttgctgttgcaggcctattatgcaatactcctcaacaggggccgtctggaagtgcatctctccacaggggcacgaacaatgaggaaaattgtgatcagaccagagccaaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacmtactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagc

SEQ ID NO: 18958 - DNA, 601 bp, Human
gggccgtctggaagtgcatctctccacaggggcacgaacaatgaggaaaattgtgatcagaccagagccaaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcytcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagcagttatggcagctgcttagctgtcacagatacagagtgtggcagcagctgcaggacctattgagcctattaagtgc

SEQ ID NO: 18959 - DNA, 601 bp, Human
ttgtgatcagaccagagccaaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctmcacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagt

SEQ ID NO: 18960 - DNA, 601 bp, Human
aactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagyaaaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctggg

SEQ ID NO: 18961 - DNA, 601 bp, Human
actcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcraaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggc

SEQ ID NO: 18962 - DNA, 601 bp, Human
attacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatccttcatcacagatgagaaaatattaactaacctgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgc

SEQ ID NO: 18963 - DNA, 601 bp, Human
tcaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgccttggtggccagcagttcttactggacaaaaacatcaaaccctaagagcctgaagtagttacttaagcaaataggacaagcaactgaactgaktttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggtttaaaaaaaaatcttaaacccacattccaaacaaata

SEQ ID NO: 18964 - DNA, 601 bp, Human
ttacttaagcaaataggacaagcaactgaactgattttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggtttwaaaaaaaatcttaaacccacattccaaacaaataagaaatagggtataagtaatcaggtaattatgaaactctaagaatcagccattgaaactgtaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaag

SEQ ID NO: 18965 - DNA, 601 bp, Human
catctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaayttagactgagaaaagcacactaatggacttaaaaaggcatgcggggattgggcttaattgtaaggaagcaaaaaaacgaaaataaaaaaatcttatttattacattctattagccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatgtaagtgtttatattatc

SEQ ID NO: 18966 - DNA, 601 bp, Human
gtactttagcatttcacaggctttcatgctcctttacctaaattcagactcaaggtttttatactccagccagtctttacaccccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttsctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttc

SEQ ID NO: 18967 - DNA, 601 bp, Human
tccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaatttttaatttttgtgggtacacagtgggtgtatatatttatgggtgacctgagatattttgatgtargcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctctggtaactatccttctactttctatctatctccatgagttgaattgctttaatttttagctcccaca

SEQ ID NO: 18968 - DNA, 601 bp, Human
atgaacatttccagtatggttttatatcactggtcatgaaggtacagttaggaaaaagaaataggaaataacctctacataataattttttaatcctttaatttttaatttttgtgggtacacagtgggtgtatatatttatgggtgacctgagatattttgatgtaggcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagta

SEQ ID NO: 18969 - DNA, 601 bp, Human
atatcactggtcatgaaggtacagttaggaaaaagaaataggaaataacctctacataataattttttaatcctttaatttttaatttttgtgggtacacagtgggtgtatatatttatgggtgacctgagatattttgatgtaggcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcraatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttcttt

SEQ ID NO: 18970 - DNA, 601 bp, Human
ttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaaygtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttg

SEQ ID NO: 18971 - DNA, 601 bp, Human
gctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaatagkattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagatt

SEQ ID NO: 18972 - DNA, 601 bp, Human
aatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagtttwaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaa

SEQ ID NO: 18973 - DNA, 601 bp, Human
aaaacatttatatttacatgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatcctaaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgcctcttaataagtactgtaataacatagcctcctggaatggtctttcatcattttgtcaagaggaact

SEQ ID NO: 18974 - DNA, 601 bp, Human
acagcaattggagccaaacttggtgttctttctgatttttttaaaattaatataccagaggaatcataaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgccycttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaat

SEQ ID NO: 18975 - DNA, 601 bp, Human
actagaacttaagaacattttgttttcatttcaattttcctacagttatcttctctttataacaagtggtactgctttcaacttatgataatgatacaaagtttcctttcagttatgaatttatttatggagaaaaatgagtcaagcactgtctgtaatagcaaaaaaattcagtagaatttttagaaaattacttttagaaaaagtaattcatctaaatgtccaaaaacaggaggatggataaactgtggtaatattcagacaaaggaataatatacaacagttaaaatgaataaacttrggctaattatattaacatggttaaatctcaaaaatctaatgaggaggggaaaaacaaattgcagaagaataatgaaatagggtctcacttatctaagtttaaaatatgcaaaacaacattgtatattttgtggatacatgtatctatagtaatattgtaaaaacatctattggaattaattaaattcagggtagtggttaactctggggagggaaggaggcaaatttatagaggaaatttcaactaaaaaactggaatcaaaatatgtcaaaatattaaggtttgataaaactagactat

SEQ ID NO: 18976 - DNA, 601 bp, Human
ctggccaacacagtgaaaccccgtctctactaaaaattagctgggcatggtggtaagcacctgtagtcccagctactcactcgggaggttgaggcagaagaattgcttgaacccaggaggcggaggctgcagtgagcagagattgtgccactgcactacagtttggcgacagagcaagactccatctcaaaaaacaaaacaaacaaaaaaaaaaaacccacctcctctgacatctacccagccttccctcattctccatctgcatctgctgtgatcacttagtactgcctgtctcaggtcrttggttgtatctcagtcttgggtatctagaggtttctttcttatttctccttgtgcctctacagtctaacacagtgcccaacatgtggtatacaattgatacttgtttcatttaatctggagtttcacaaaaagtgggatgagccactgagggtaggaaaggcattttaagtttacagatcacaacattcaacaatctgagttacatggtgagaaagtgattctctttttggtgatccttctaacctaatgatgtcagtgaaaaaggccacgtcctcccctcaacacacgctagtccccc

SEQ ID NO: 18977 - DNA, 601 bp, Human
atgagcctgaacagctgggatatataattcaatcactctgactccctagaaggtacctctcagagatcatctgagtccagtcttccagttgacaccactcagcacacattagcccagtatccagcatcactgtagggaacacatctggctagcagtctgggagagctgctattccacctgggccaaatctgatcacactagccctttgttaaaaacctcccacagctctccactggcctctacaaggccccctggcacccatgtgcctactttcctgtgcagtctaattgtccccatcacycccaccttgtctccacaaccatccacagccaaggctttgctcctccaaggatacaaggtttgttgctccccagttaccctatggatttcacttcgatgcctttgcctgggctgctctctctgcctagaatgcctttcctctctggtctactgattaaaatcctttgcatactccaagacttccagatcagatattaccttctttgtataaaacctcccctgggccaggcaaggtggctcacacctgtaatcccagcactttaggagtctgaggtgggcagatcacaaggtcaggaaattg

SEQ ID NO: 18978 - DNA, 601 bp, Human
gggtcccgccggcccagctgtgccggcactcacccagctggttggagagcggcagtgtgaaagtggactgcttcagtggggcttccagcaaggccctggggcgggaccccctccctggaggctccctgtccggctgcgggataggcaggtggcagaacttcccggtggagttggcggggcaccagcattcgtccctgccgatgcagcggcctccgttcaggcaggggatctggcagaaatctgcaacatcaaccctcaaggtaaccagcggtggaagaacagcagcacccgctctgtggcyggtgaccaccacagagaaacaggcggcagaaccctgaccctagatggctcctgtagcccggagccccctgaaatgtagggactttccacttcattcatgtagagtgaagaagagtggataataaccagcccctgccttcctgaaaagtctatttaggcgtttccctgcaccccacaataacctgggagatggggaggtggcattatcatgaactctgtctcttctctgttgaggaaacttggactcagagaggttatgtgactcctagagtcacacagctaggctgccaagtgaggactc

SEQ ID NO: 18979 - DNA, 601 bp, Human
acccctgggccaggcaggccactggctatgtgtcaccccaaaactctccttccatttctttgctcccaagttagaaccccagaatgatcccttgtggggacgggatgaagtgcaaactctgtcactgaaggagcctcattatcacattccaagctaccttcctgattctacctcccccatgaccctggccaaccctggaactccagccccctgtctcctgcatggccccacctccgtgcctttgctcgtgccagtccctctgcttaaccagatgctacccattgtttcaggcctaactgcrgtccatcccctccacgcagctgtcccagagcactctgggcttaggagcctctccatcccctgatcccctaaagcattctgtatttttttggcacctaataatggaaggcagggaaaatgaaatgttttatgctgatattctatttcccatccattctccctctattacccaggcccatggattccttgagggcggcaccctgcccttacactgttttgtcttccccagggttcccagcacagggaaagggcaaaaacaagtcgataaattccgatgggagggggctgagaagttgaggga

SEQ ID NO: 18980 - DNA, 601 bp, Human
ggatgtcaaacacacctctctggtaaagggatcttaagtgatgtggagtagaaggaagggtgtaagcctctcaaggccttgatcacctgccactgccaccatgaaggtttcttgagagcggtctgacatgttctccccactctgggcccctcactctctgggcacccccctcctatagctcttgctgtcttctctccctagagccactgggttcagcctctgggtggcactggagtcttgtccaatcccatggccctcccaaacccagtaccagaaagtttgcagactgagggcttggcckgttgcagggagctctgctgagctgggcgtggcccatccaacctcggctgctgcctcccagaggccagttgggactggttttattcagctctggtcaggcctcccggcccagggaaagccctatctgggctgtggtgtcagttctgccattgggggctgctgccagcctgggcctctcaccctggaaaccacagaggtctctggaaacagggctgcctggcatacatgcatgtacatacctggacacaatgctaatgcccactatgtgttcacagataaggagaaacttcagaaccacaag

SEQ ID NO: 18981 - DNA, 601 bp, Human
tgcctctggggctcaagccatccttccacttcagcctctcaagtagctgggactacaggtgtgcaccaccacgcctggctaatttttaattttttgtaaagacagggtctcaccatgttgcctaggctggttttaaactcctgaactcaagtggtccacctgcctcagcctcccaaagtgcttggattacaggtgagaggcacggggcccagccccagcgaattcttttttgcttaaggcagtttgagtttggtttctgtcacttgcaatccaaagactcccgattaataaactttcttcrtggtattgtcgtggagattaaatagagtgaggtgtgtgagagtggcttgttaaaggtcatgtgcccgccacaggtaaatcatcagccgtctgtgagccctggatctccaggtgcaaactctgcttctagcagccacttccattgggacactgtaaggaagggctctgtccctttgaaccccagggtggagatgacccaggtgggaatatcaggaggctggggcagccctgtagactgccccactggacctggtcaggcggcagggagggaaggaggcagaactcagaaacaaagggaaga

SEQ ID NO: 18982 - DNA, 601 bp, Human
acctttgcctctggggctcaagccatccttccacttcagcctctcaagtagctgggactacaggtgtgcaccaccacgcctggctaatttttaattttttgtaaagacagggtctcaccatgttgcctaggctggttttaaactcctgaactcaagtggtccacctgcctcagcctcccaaagtgcttggattacaggtgagaggcacggggcccagccccagcgaattcttttttgcttaaggcagtttgagtttggtttctgtcacttgcaatccaaagactcccgattaataaacttkcttcgtggtattgtcgtggagattaaatagagtgaggtgtgtgagagtggcttgttaaaggtcatgtgcccgccacaggtaaatcatcagccgtctgtgagccctggatctccaggtgcaaactctgcttctagcagccacttccattgggacactgtaaggaagggctctgtccctttgaaccccagggtggagatgacccaggtgggaatatcaggaggctggggcagccctgtagactgccccactggacctggtcaggcggcagggagggaaggaggcagaactcagaaacaaagg

SEQ ID NO: 18983 - DNA, 601 bp, Human
agttgtgtgaaccaatgcttttggtttttcttgagaagagtcttgtctattgcccaggctgcagtatagtggcacgatctcggctcactgcaacctttgcctctggggctcaagccatccttccacttcagcctctcaagtagctgggactacaggtgtgcaccaccacgcctggctaatttttaattttttgtaaagacagggtctcaccatgttgcctaggctggttttaaactcctgaactcaagtggtccacctgcctcagcctcccaaagtgcttggattacaggtgagaggcackgggcccagccccagcgaattcttttttgcttaaggcagtttgagtttggtttctgtcacttgcaatccaaagactcccgattaataaactttcttcgtggtattgtcgtggagattaaatagagtgaggtgtgtgagagtggcttgttaaaggtcatgtgcccgccacaggtaaatcatcagccgtctgtgagccctggatctccaggtgcaaactctgcttctagcagccacttccattgggacactgtaaggaagggctctgtccctttgaaccccagggtggagatgacccaggtgg

SEQ ID NO: 18984 - DNA, 601 bp, Human
caatgataatcagctttgagactattattcctgggttattggggaaaaggggctcattttttattgagtttgcaaggctgagagggtgtaggcctagagcatctggtgaccacctttgaaggaaccatgaaactcacacagaggaaagagcaggacatgccctgcagacactgtggctgcctaggtcagccagcctgaggccataccacgtctgcacttcctagttgtgtgaaccaatgcttttggtttttcttgagaagagtcttgtctattgcccaggctgcagtatagtggcacgatytcggctcactgcaacctttgcctctggggctcaagccatccttccacttcagcctctcaagtagctgggactacaggtgtgcaccaccacgcctggctaatttttaattttttgtaaagacagggtctcaccatgttgcctaggctggttttaaactcctgaactcaagtggtccacctgcctcagcctcccaaagtgcttggattacaggtgagaggcacggggcccagccccagcgaattcttttttgcttaaggcagtttgagtttggtttctgtcacttgcaatccaaagactccc

SEQ ID NO: 18985 - DNA, 601 bp, Human
gtggaggctgacgcctttctggctgaaggcttgtggtccatacccctggttacagtgattgggtcagggatgggcacttaaccaaggaggcccaatgataatcagctttgagactattattcctgggttattggggaaaaggggctcattttttattgagtttgcaaggctgagagggtgtaggcctagagcatctggtgaccacctttgaaggaaccatgaaactcacacagaggaaagagcaggacatgccctgcagacactgtggctgcctaggtcagccagcctgaggccataccaygtctgcacttcctagttgtgtgaaccaatgcttttggtttttcttgagaagagtcttgtctattgcccaggctgcagtatagtggcacgatctcggctcactgcaacctttgcctctggggctcaagccatccttccacttcagcctctcaagtagctgggactacaggtgtgcaccaccacgcctggctaatttttaattttttgtaaagacagggtctcaccatgttgcctaggctggttttaaactcctgaactcaagtggtccacctgcctcagcctcccaaagtgcttggattac

SEQ ID NO: 18986 - DNA, 601 bp, Human
gaagcctctcacttggtaagcggaaggccctgctttcctgtaaggcctcgggtgacaggagtcccacctgctcccggacctgtccaccccatccattctggagtcacctccttgcactgctacctcctccctcccatgcctcccagccaggctgggtcatgcagccccctgccctgggctttgggccaggggaacagtttgaggaaggagtggaattgctcctggcttggccggtgtcctgtgtccacaacaactggggctctgtcctcactcccctgtctattccagattcctggagcartttgaccaatcacatagtttgctggcgctatgacgttccaggcctcctgcattcagtgttaccagtgacctgggcatgacttctccatggttttcagggcacttgcaaggagagcctcatacccagcctccctccagccccgtgcctctggggtccaaggccgttgagctggagttagcactctgactccaaggccgggccaggggtctgacatgcaggtccccaggacccacctgccagctattcaggcctgcagcaagcaccggccccagaagctgcatggccagagggcaggagatg

SEQ ID NO: 18987 - DNA, 601 bp, Human
gggactggccaccacaaaattccagaaccccaggtctggagggcctgaagatagcttagtgaagcctctcacttggtaagcggaaggccctgctttcctgtaaggcctcgggtgacaggagtcccacctgctcccggacctgtccaccccatccattctggagtcacctccttgcactgctacctcctccctcccatgcctcccagccaggctgggtcatgcagccccctgccctgggctttgggccaggggaacagtttgaggaaggagtggaattgctcctggcttggccggtgtcctktgtccacaacaactggggctctgtcctcactcccctgtctattccagattcctggagcagtttgaccaatcacatagtttgctggcgctatgacgttccaggcctcctgcattcagtgttaccagtgacctgggcatgacttctccatggttttcagggcacttgcaaggagagcctcatacccagcctccctccagccccgtgcctctggggtccaaggccgttgagctggagttagcactctgactccaaggccgggccaggggtctgacatgcaggtccccaggacccacctgccag

SEQ ID NO: 18988 - DNA, 601 bp, Human
agtctgcgccccagaccacatccccagcagggccagcagcacagaaagcgtggactcttcttacctgcctctgccccatcacccctgtagggactggccaccacaaaattccagaaccccaggtctggagggcctgaagatagcttagtgaagcctctcacttggtaagcggaaggccctgctttcctgtaaggcctcgggtgacaggagtcccacctgctcccggacctgtccaccccatccattctggagtcacctccttgcactgctacctcctccctcccatgcctcccagccaggmtgggtcatgcagccccctgccctgggctttgggccaggggaacagtttgaggaaggagtggaattgctcctggcttggccggtgtcctgtgtccacaacaactggggctctgtcctcactcccctgtctattccagattcctggagcagtttgaccaatcacatagtttgctggcgctatgacgttccaggcctcctgcattcagtgttaccagtgacctgggcatgacttctccatggttttcagggcacttgcaaggagagcctcatacccagcctccctccagccccgtgcctctgg

SEQ ID NO: 18989 - DNA, 601 bp, Human
acttggtcatctcttcaagtaaaatctaacagatactccatctttctccctctccctccctcatgagacactgccctggggcctgagctgctaccaggtcctgctctctgccatgcttgcccggccccctagtgggaggacgcactcacctggccagcctgagagtcacctggaagggaaaggtaacagcgtgagctcagggaggagggtctggctgccttctcccctcaccgccacctgggcggcttcacagtctgcgccccagaccacatccccagcagggccagcagcacagaaagcrtggactcttcttacctgcctctgccccatcacccctgtagggactggccaccacaaaattccagaaccccaggtctggagggcctgaagatagcttagtgaagcctctcacttggtaagcggaaggccctgctttcctgtaaggcctcgggtgacaggagtcccacctgctcccggacctgtccaccccatccattctggagtcacctccttgcactgctacctcctccctcccatgcctcccagccaggctgggtcatgcagccccctgccctgggctttgggccaggggaacagtttg

SEQ ID NO: 18990 - DNA, 601 bp, Human
taaacaagagctgttgttatcacttcctttagggtaaaactgggtctttggatcaatcctcccacttggtcatctcttcaagtaaaatctaacagatactccatctttctccctctccctccctcatgagacactgccctggggcctgagctgctaccaggtcctgctctctgccatgcttgcccggccccctagtgggaggacgcactcacctggccagcctgagagtcacctggaagggaaaggtaacagcgtgagctcagggaggagggtctggctgccttctcccctcaccgccacmtgggcggcttcacagtctgcgccccagaccacatccccagcagggccagcagcacagaaagcgtggactcttcttacctgcctctgccccatcacccctgtagggactggccaccacaaaattccagaaccccaggtctggagggcctgaagatagcttagtgaagcctctcacttggtaagcggaaggccctgctttcctgtaaggcctcgggtgacaggagtcccacctgctcccggacctgtccaccccatccattctggagtcacctccttgcactgctacctcctccctcccatg

SEQ ID NO: 18991 - DNA, 601 bp, Human
gtgaaaaaggccctggaggctggctgcgtctgtggggaccagagttagagctttggcctggggggacatcatatggtggcccagggacagaacaaggcacccggaagaaactgtatttgggaacagtcaggtatgcaggctggaggggcaggggacagagtagggactgaggctgatgagggaagaagcagatcccctcttctggaatgttttcctgggacgacacccaggttttcccaggggaatcttgggcacagggaagggagttggatgcacctttctccgtgaggtggtttgaggytgttcacagctgtgcccacacttccctgtacaccactcccagagggacctggaggttcaactaaaccagcgcagaaagtgccagacccagaatgaactggaagcagctccacacctcgtctgcagtgcttaaagcttgagtgacagccaggcctaacaggacatgttcctacttcctttctgaaggggccccagcccatcccaaatgggaaaatgcttgcacaatggctgctccataaacaagagctgttgttatcacttcctttagggtaaaactgggtctttggatcaatcctcccac

SEQ ID NO: 18992 - DNA, 601 bp, Human
ggaagagggactcacctgtgacccaggcaggtgcatgggtgacactggtcgtgacctgcacagaaacaggagaaggtcacttttggctcctctgccgtccctgtgatgtgccaccttccaccacactgacccccacctccgggcttcctaccaggagctcattcatgttttcattcattccaggtattgatgagttcttactctatgctgggcattctgccaggcactttacacccactcacttcattaaccttctcaactatcttatgatgggaggttgaaatgattaaatgagctgatrtacatactatgccagctcagtgttgggtccatggtagaaaatcagcaatttggtgtcagctataaccctagcatctcaacacagtaacagaagctctggaggttcactagagtgcctggagccacagggccagagtggggaagctgggaccacaggttatacctggtgtccctcaacatagccagtggacagaatttgctgagaggtggggatgtaacagcagaagagtgggcagagggtgaaaaaggccctggaggctggctgcgtctgtggggaccagagttagagctttggcctggg

SEQ ID NO: 18993 - DNA, 601 bp, Human
cacatagtaactccactcctgattaagggctctttccctcccttctcttttgcctaggagccgccaggaagagggactcacctgtgacccaggcaggtgcatgggtgacactggtcgtgacctgcacagaaacaggagaaggtcacttttggctcctctgccgtccctgtgatgtgccaccttccaccacactgacccccacctccgggcttcctaccaggagctcattcatgttttcattcattccaggtattgatgagttcttactctatgctgggcattctgccaggcactttacacmcactcacttcattaaccttctcaactatcttatgatgggaggttgaaatgattaaatgagctgatgtacatactatgccagctcagtgttgggtccatggtagaaaatcagcaatttggtgtcagctataaccctagcatctcaacacagtaacagaagctctggaggttcactagagtgcctggagccacagggccagagtggggaagctgggaccacaggttatacctggtgtccctcaacatagccagtggacagaatttgctgagaggtggggatgtaacagcagaagagtgggca

SEQ ID NO: 18994 - DNA, 601 bp, Human
actatctgtgaagcgtcatggggtctctcgctgacttcacagcaccttaggtgtatagagagctcccagaaacagcactcacaggccacgtccttctcaccctcctctgatgtgtgtgtgagcgtgaaccagctcacacatagtaactccactcctgattaagggctctttccctcccttctcttttgcctaggagccgccaggaagagggactcacctgtgacccaggcaggtgcatgggtgacactggtcgtgacctgcacagaaacaggagaaggtcacttttggctcctctgccgtmcctgtgatgtgccaccttccaccacactgacccccacctccgggcttcctaccaggagctcattcatgttttcattcattccaggtattgatgagttcttactctatgctgggcattctgccaggcactttacacccactcacttcattaaccttctcaactatcttatgatgggaggttgaaatgattaaatgagctgatgtacatactatgccagctcagtgttgggtccatggtagaaaatcagcaatttggtgtcagctataaccctagcatctcaacacagtaacagaagctctg

SEQ ID NO: 18995 - DNA, 601 bp, Human
ttgttctgatttatgtgctaagtggtgccatgaaatttgcaaagagttctgtggctagaaaactatctgtgaagcgtcatggggtctctcgctgacttcacagcaccttaggtgtatagagagctcccagaaacagcactcacaggccacgtccttctcaccctcctctgatgtgtgtgtgagcgtgaaccagctcacacatagtaactccactcctgattaagggctctttccctcccttctcttttgcctaggagccgccaggaagagggactcacctgtgacccaggcaggtgcatgrgtgacactggtcgtgacctgcacagaaacaggagaaggtcacttttggctcctctgccgtccctgtgatgtgccaccttccaccacactgacccccacctccgggcttcctaccaggagctcattcatgttttcattcattccaggtattgatgagttcttactctatgctgggcattctgccaggcactttacacccactcacttcattaaccttctcaactatcttatgatgggaggttgaaatgattaaatgagctgatgtacatactatgccagctcagtgttgggtccatggtag

SEQ ID NO: 18996 - DNA, 601 bp, Human
cctggcttccttctcccatggtgtcccttctcttcccccttctgggcttgggcagtgctccaggcagggctcttgttttcacaagagggaccctgtgttctttgtaagatgaggccaggggtgcacagcccagctgggagcctgctggggactttacctagttggaaaggtgagggggcattccattcatgcccctgccctggagttggctctggacagacacagctcacagggcagggtgcagggagccccaaaggtctggctgcagctacctggggtgctcagggtcaccagcacatcrgtggagggggtcacttgttcttcctgtatctctgcaatcccctgttcaggcattggtggggttgtggcattccctgtggaggagagaggggaagaggtggggttgtggccccttggctggccatggcccttccctcttccctggtgctcagactcccaagaacgaagggtgaagcctggggtgggtcactcccatgccttccagtctcctgaaagttgatctggccccacttagagaatctgagagctctaacaggcgttggagcacatccagtctaatcctccatgtcagggccaggag

SEQ ID NO: 18997 - DNA, 601 bp, Human
tgccaggcactctgctgactcaggggagtggcctggaagagccaggatcccagtggccctcactccccatgctccccttccttgagagggacccccagattctcctggaagacccctggcttccttctcccatggtgtcccttctcttcccccttctgggcttgggcagtgctccaggcagggctcttgttttcacaagagggaccctgtgttctttgtaagatgaggccaggggtgcacagcccagctgggagcctgctggggactttacctagttggaaaggtgagggggcattccatwcatgcccctgccctggagttggctctggacagacacagctcacagggcagggtgcagggagccccaaaggtctggctgcagctacctggggtgctcagggtcaccagcacatcagtggagggggtcacttgttcttcctgtatctctgcaatcccctgttcaggcattggtggggttgtggcattccctgtggaggagagaggggaagaggtggggttgtggccccttggctggccatggcccttccctcttccctggtgctcagactcccaagaacgaagggtgaagcctggggtgggt

SEQ ID NO: 18998 - DNA, 601 bp, Human
gttacagaatggcagaggagaagggggatagggcaaaaggctgaggctggggttgcggtggggacactcatccacatgccaagagctgctgctgagcttggcctgccccctgccccctgccccctgcttcccatcccttcctccaggtccattttccttgtcagaaattcagcactcctctgcacactctgcctgctgagcagaggccagaaggggatgctccctggagcagcgctttgagcccagaggagagaggtcccaggagaggtcagtggggtgtgcctgggaaggctggaccccyactccccactctctggactgttccaccaggcgcaggggctttccctttgctgaaggaaatccagaaccccctgaccaccctcacccccaacacaaggtgactgggtctctggacccagtcgtaaggttaagagagcaggagccccaggagcgggcacacacgtgtacagggagcagcggcaacaacacccgccttgcttctcctgcaccaagtccccagacaatgagcctttaaggagggcacattccagagcaaggtggatttgccaggatcgcccccacacccgcccctcgcccccat

SEQ ID NO: 18999 - DNA, 601 bp, Human
cttctgcatttgtgtccaccctgaagtctttgcctgaagcccacatgctcaggggtccctgccccgcccccatagcttgggagaagccgaagacccaagggaatgggttggggaatggtctgtacgtgggtatacagtggggcttaacagtctgccagattgtactgaattgaatgtgcacccaaggctaccctctccccgggcctggctctaagtttgtgtcagccttgggggttgtgggggccctcagctgggtcctaaatgtctgcccagaggggtgaggttacagaatggcagaggrgaagggggatagggcaaaaggctgaggctggggttgcggtggggacactcatccacatgccaagagctgctgctgagcttggcctgccccctgccccctgccccctgcttcccatcccttcctccaggtccattttccttgtcagaaattcagcactcctctgcacactctgcctgctgagcagaggccagaaggggatgctccctggagcagcgctttgagcccagaggagagaggtcccaggagaggtcagtggggtgtgcctgggaaggctggacccctactccccactctctggac

SEQ ID NO: 19000 - DNA, 601 bp, Human
gggtccttaaaacctgttgaaataatttaaatgagggtctgccttgggtggtggtgatggggtgagaagtggggagacaggtacagaattgagaaatagtttggaggcagactcactgggactcggggttgaggctgtgtagacagcagagactttagctttctgaacggtatccctaatactagaaaggtacctggcacttagaacatgccaaatggataaatgaatgaatgatgcttctgcatttgtgtccaccctgaagtctttgcctgaagcccacatgctcaggggtccctgcccygcccccatagcttgggagaagccgaagacccaagggaatgggttggggaatggtctgtacgtgggtatacagtggggcttaacagtctgccagattgtactgaattgaatgtgcacccaaggctaccctctccccgggcctggctctaagtttgtgtcagccttgggggttgtgggggccctcagctgggtcctaaatgtctgcccagaggggtgaggttacagaatggcagaggagaagggggatagggcaaaaggctgaggctggggttgcggtggggacactcatccacatgccaag

SEQ ID NO: 19001 - DNA, 601 bp, Human
ttgagactggcctgtaacaaggattttgtgaaaggtgggggtgggtcagagcagtcctagaaaggccactcaggcaacgagatgatggatgaactggtaagggaggtatagtgggtccttaaaacctgttgaaataatttaaatgagggtctgccttgggtggtggtgatggggtgagaagtggggagacaggtacagaattgagaaatagtttggaggcagactcactgggactcggggttgaggctgtgtagacagcagagactttagctttctgaacggtatccctaatactagaaargtacctggcacttagaacatgccaaatggataaatgaatgaatgatgcttctgcatttgtgtccaccctgaagtctttgcctgaagcccacatgctcaggggtccctgccccgcccccatagcttgggagaagccgaagacccaagggaatgggttggggaatggtctgtacgtgggtatacagtggggcttaacagtctgccagattgtactgaattgaatgtgcacccaaggctaccctctccccgggcctggctctaagtttgtgtcagccttgggggttgtgggggccctcagctg

SEQ ID NO: 19002 - DNA, 601 bp, Human
gtggagacatttgcaactggggcagtcctgggtgtgctctccaggcagcaaaatggccagtttgaggggtgggctgatctcagagaagagggctgccaggcacaggccaggatgcatgcaatgggctggcttctgtgctcctggagtcctggagactcatcggatggggctcaccgagactggtcttcccctgaaggttaaagttagcttagtccacagggactgtgctcctcctaaactcatcaaccacccagcactgcttggaccttctgcttcttcctggactctcaactcggcctcytagcccctgctcccatctaccccagccgccaagtaagcccagggcacccaagtgaatacctgtgcagtaggcctggctggggtgcagctggtagccagggctgcagacacatctgtatccatcggggaggttcacgcaggttccagggccacagacgttggtggctccagcagcgcatctgtcaatgcctgtgggagacagagcaaaacagaggttatggcagggtgggtgctggacaaaggcagtggagcggggtggggacagtcagtggccagggtctaggggcctcagaaggccaac

SEQ ID NO: 19003 - DNA, 601 bp, Human
agacgattggagcccagagaagcctccttccctcagcctctctcctggctcctccagcctgttctgagccctgccccttaagtcagctccccggaagtcagctgacccagtcaccactgttctgctcacagacttctactggctacccatgcctgtgagacagtgtccaagcgcttcagcctggcactcaagacatttcccacactggcctcttcctccaggtagccctgctccagtcatactgcattcatgattattcccagagcatgccagggaacgttcactattcaggtctctgcaragatgcttctctctacctggaataccctctgctccctcaattcctattcacgctccattcctattcatgctccaacaccctgtgtgtaagggagtgtgtctttggaagcaaaccatgctttggagctagagtgatttgattctgtttctagctctgtcaccactaggtttgaggcccctgggtatttcaattcacctctgagcctcagtttgctaaactattaaatggggctaaggatttccataacatggagttgggatgatgagcttcatataacaaaatgcttgggacattgccagc

SEQ ID NO: 19004 - DNA, 601 bp, Human
tgaggaaacccacaggctaatgtatgaagagatgcttacatttattggtaaacatttacttagatatttaatatgtaaataatttatcttattgataatataaattatgatttatattaattatatatacattatttaaataatctataaatagatataaatatcaaatcattgaggtaatgagatattactttatgagactgggaagcttcagaaagtgggtgttattctggacaaggcctcttccagtggtacccaagccccactgggagaagtacttagagccagccttgaaccccayccccgttccccagctgctggggctggcagagacatcttggacacccaggctggcacggtggcagaaacttgtgtctgcaccagtcctggtgacaccattctctgcagcagctgctgcttatcccaggccagctccccaggctgggtctgcaaagagcagtgcctctggcccacaacacccacctagacgattggagcccagagaagcctccttccctcagcctctctcctggctcctccagcctgttctgagccctgccccttaagtcagctccccggaagtcagctgacccagtcacca

SEQ ID NO: 19005 - DNA, 601 bp, Human
tacagatgaggaaacccacaggctaatgtatgaagagatgcttacatttattggtaaacatttacttagatatttaatatgtaaataatttatcttattgataatataaattatgatttatattaattatatatacattatttaaataatctataaatagatataaatatcaaatcattgaggtaatgagatattactttatgagactgggaagcttcagaaagtgggtgttattctggacaaggcctcttccagtggtacccaagccccactgggagaagtacttagagccagccttgarccccacccccgttccccagctgctggggctggcagagacatcttggacacccaggctggcacggtggcagaaacttgtgtctgcaccagtcctggtgacaccattctctgcagcagctgctgcttatcccaggccagctccccaggctgggtctgcaaagagcagtgcctctggcccacaacacccacctagacgattggagcccagagaagcctccttccctcagcctctctcctggctcctccagcctgttctgagccctgccccttaagtcagctccccggaagtcagctgacccag

SEQ ID NO: 19006 - DNA, 601 bp, Human
ggcccaggaacccacgctgttatagctcttcaggcaattctggaataactggtgttcactgtgagaagctctaaccccaatggaagagagaagggaactcatagacagagccgtatgtgggaactggatgaagaactcattatcccctgaggtcaggacgactgtctgatagatggtgctggaaaactccctcactccatggagaaaaatggagacgtgaatagagaaagaccaggttcttaacagccatatgaagatggactccagatgaatcaaagcataccataaaagggaaaactagaactcaattaaggtataggagaatatctttatgacttcaggatatggaaggatttcttaaacaaagcccccaaaacacacaaaaataaggcaaaatggtgaatttcagtaaatcaaaattaaggatttctgttccaagaaatgtagataagcttaaaggatagaggacaaaatgggagcattgcaatttctaaacccggccaagaatctagaatatataacggactcctaaagagccccaggaaaaagcagcaaccaccattggaaaactgagcaaaaatgggagccagcagtttacaga

SEQ ID NO: 19007 - DNA, 601 bp, Human
gattgcgttttaggtaaccatggatctgtagggtgtggtttctgtcacttttccaaagtatattggtgtcccatcatctaaagcccaaccccactcacgcccctccactgcttaaactcctaccagagacccctgctacctccagttctgttcgcagcttggctcacaaggcctttgccagctggcccagctctgctgtatttgctaattcacacaagtcccttggtatagcctcagctattgcagatttcagcagtccaatctccaagcctttgttcacacaaatgcttccacctggagyctctttcctcacgatggccagcaaatccctgcccccatttcaaggactggtttaatgcatcacctttgggtcctgtgggtccccatcccctgtccccacagtcaaattaatcaaggcctcaccttcccactctcccccttaaactgggactgatacaaacacttcacagagtccttgtgcagattaaatacaataatccaggtgaggggttgagcactgtgcccacctggcataaggtaagcactgcagaaatgttagctattattatcctagtgttaaaccccataaaatcccagctcc

SEQ ID NO: 19008 - DNA, 601 bp, Human
tttattgagacggagtttcgctcttgttgcccaggctggagtgcgatggcgccatcttgactcactgcaacctccggctcactgcaacctctgcctccctggctcaagcgattctcctgcctcagcctcccaagtagctgggattacaggtgcccgctaccacacccagctaatttttttgtatttttagtagagatgaggtttcactatgttgaccaggctggtcttgaactcctgacctcaagtgatccacactcctcagcctcccaaagtgctgggattataagcatgaaccactgcrcctggcctcctggagtccttcctaaggaccttcataaaggttaggaaccaagcagccagtgagggattgcgttttaggtaaccatggatctgtagggtgtggtttctgtcacttttccaaagtatattggtgtcccatcatctaaagcccaaccccactcacgcccctccactgcttaaactcctaccagagacccctgctacctccagttctgttcgcagcttggctcacaaggcctttgccagctggcccagctctgctgtatttgctaattcacacaagtcccttggtatagcctca

SEQ ID NO: 19009 - DNA, 601 bp, Human
cagacacaccgactcttcctctgccccatgagaagagcacatttttcaaggcaacagggcggaggttacagaggagatgttcctaaggtgtcatgtggataaagttgttcatgctcccctgctgcaggtggcagacaggatgccagaatgtcactgaggggatggaagggctcaggaattctcataggtgtctctgtccatagacgtgggctcagcatcaaggggccagggcagagacaagccagaaggcgtgttggtggtgggcagtgcgtagggagggacaggtgggtggtggggtggsagggcgcttccctccttcccgttccttaccttggcagtgtcctttcctgaccatgatgtagccctgatcacactcgcagtggtacgagccctcggtgttggtgcactgccccccgctgcacacccctggctgctcacactcattgatatctgtgaacacacagaaaagccctgagtcacagccagccctggaggatggtggagggggcggggtcctggagcattccttctagaggccaaggacaaaggatgccatgctgaggcctgggcagggaaggcatgctggctgcagccacaattg

SEQ ID NO: 19010 - DNA, 601 bp, Human
tgtgcgggctacatcattctttctttcaacagactcggagtgtctgccctgggccaggaactctgcctgacctcccagatgaggtgtgtgtctagaacctttccttgggaagggaaggagagggctggggtatgggggagcctggacatgaaaaagaactaccctctgacagtaacatttccctctacttattcaaggtctgtatgtgccagacggtgcctagcactttgtatacattagcttatccggtgctcacaaacatctctgagatgggcattacagttcaatttccagacatcgygtcaaaagccaaacccaagcctgtctgcaccagagcctgtgcccttcacacagactggttaatataaatctgatttttttttttttttttttgagacagagtctcactctattgcccaggctggagtgcagtggcgtgatctcggctcactgcaacttccacgtcctgggttcaagtgattctcctgcctcagcctcgcaagtaggtaggataacaggcatgtgctatcacgcccagctaatttttgtatttttagtagagacggggtttcaccacgttggccaggctagtcttgaactg

SEQ ID NO: 19011 - DNA, 601 bp, Human
tgtgagagcatgcggtgggggtagggaaggcactcaggcaggggccagaagctcaagtgaccttggttatggctgggcgacaccaaaggccctggcagtctgcagggaagtctatcccctgtccgtgggaacctggagtcccggtacgacggaaatgccgttgagactgctggacgggcctctgtccagaccactcagcctttcaccagagactttcagtttcagtggcgagagtggtttctgagttggagaaagaagaaagagggagaggaaattgactgggctcccagggtgatgggcsgggcttgtggttaccgatggaaacctggagaagtgtgcgggctacatcattctttctttcaacagactcggagtgtctgccctgggccaggaactctgcctgacctcccagatgaggtgtgtgtctagaacctttccttgggaagggaaggagagggctggggtatgggggagcctggacatgaaaaagaactaccctctgacagtaacatttccctctacttattcaaggtctgtatgtgccagacggtgcctagcactttgtatacattagcttatccggtgctcacaaacatctctg

SEQ ID NO: 19012 - DNA, 601 bp, Human
aagcagcccctcattctccacccgagccagggaagggctctccttggtggaagtgaatataactgaaccattagccaagccaatccaaaggagccagaggaagattccgaatgaagcagattctattaccagctaccctgaggctgtcccaccagcatcttggtgcctggactggaaccagtcactggatgcagaaatattccagtttttctgcctggcctagggtatgaatgttaatctgagattacggtgtgttttggagggttttaatattctgtctttgaagccaggagccatctgycttcttcctgtgttcccagcccatggccgacacagctggtgctcaacaaatgtttgctaaccaaagagtgggagagtatgcctcaaacttcacccttcatctttttggtataaggctgctgaagagaccccaaagggcccatggcaacaatcaatccagagaccagcttgccaagcttctgttggttcgctgggagaatcctggagcttctctaaccacagatcagcctttggatgaggaaatataaaggcattcacttctggtggttgtgagagcatgcggtgggggtagggaaggcac

SEQ ID NO: 19013 - DNA, 601 bp, Human
aaacaaacaaacaaacttggctgctatgtcaataagataggggttgtttgttaacgcagcataaccttgtctatcttggcatgccactgctggcttccttcctcagaccagagccccagccagtgattatcacacgtgaatgggagggggagggcagatgatgaaagcagcccctcattctccacccgagccagggaagggctctccttggtggaagtgaatataactgaaccattagccaagccaatccaaaggagccagaggaagattccgaatgaagcagattctattaccagctacyctgaggctgtcccaccagcatcttggtgcctggactggaaccagtcactggatgcagaaatattccagtttttctgcctggcctagggtatgaatgttaatctgagattacggtgtgttttggagggttttaatattctgtctttgaagccaggagccatctgtcttcttcctgtgttcccagcccatggccgacacagctggtgctcaacaaatgtttgctaaccaaagagtgggagagtatgcctcaaacttcacccttcatctttttggtataaggctgctgaagagaccccaaagg

SEQ ID NO: 19014 - DNA, 601 bp, Human
catggtgactcgcgcctgtaatcccagcactttgggaggccaagataggcggatcatctgaggtcaggagttcaagactagcctagccaaaatggtgaaaccccatctctactaaaaatacaaaaattagccgggtgtggtggtgggcacctgtagtcccagccactcgggaggctgaggcaggagaatcgcttgaacccggtgggggaggaggttgcagtgagccaagatcacaccactgcactccagcctgggtgacagagcgagactctgtctcaaacaaacaaacaaacaaacttgkctgctatgtcaataagataggggttgtttgttaacgcagcataaccttgtctatcttggcatgccactgctggcttccttcctcagaccagagccccagccagtgattatcacacgtgaatgggagggggagggcagatgatgaaagcagcccctcattctccacccgagccagggaagggctctccttggtggaagtgaatataactgaaccattagccaagccaatccaaaggagccagaggaagattccgaatgaagcagattctattaccagctaccctgaggctgtcccaccagc

SEQ ID NO: 19015 - DNA, 601 bp, Human
gcttcctagtctcttgtggttgggtggagccatgagactagtgagggccaacgaactgtgagtgcgtatgatacggataatttatggaccaaaccatttaatttgtgcaaccctccagagtgctcttttattcttccacagagactggctattcctttagcctacatctccaatgaggaaacatggggcagagcccccagctgacccttgatggacatgtggcactgatgagatagaaacttggctgctgctgggcatggtgactcgcgcctgtaatcccagcactttgggaggccaagayaggcggatcatctgaggtcaggagttcaagactagcctagccaaaatggtgaaaccccatctctactaaaaatacaaaaattagccgggtgtggtggtgggcacctgtagtcccagccactcgggaggctgaggcaggagaatcgcttgaacccggtgggggaggaggttgcagtgagccaagatcacaccactgcactccagcctgggtgacagagcgagactctgtctcaaacaaacaaacaaacaaacttggctgctatgtcaataagataggggttgtttgttaacgcagcataac

SEQ ID NO: 19016 - DNA, 601 bp, Human
ggagctagttctccccggagccgaggagagggctcttccccgacgtaacctggcatatcatgggcttcatcatcaaggcacccaggggacctggactgagtgagggaggtcctgtcacagggactgaactctgagtcagcactgcaggaggacattatgcccctctggcccggtatcaaggctctggcccactcttcacaacaggtccattggccaaggaaagaggaggggttcttcttcctaaatgggtaattgtcattcttctagaggaagtccaccagcttatgcatatttagaggcyctactgcccgagaggaggacctactcagcacctatggaggaagtgtgggaggcaggcctagggtctgaacataggctttctgcagagggactaaagccagcagctgtcactgctgctggacatggagaggagaggacatggaccttaaagtggagggtgaaagtgagtcctctctgaggttgtttggcttccagaagtcaggacacatcgaagccctctgtcccagaggactgggaccctctcaagcctaaagcttctgcctgagggtccagaagacggggacatcgccacagggcaggt

SEQ ID NO: 19017 - DNA, 601 bp, Human
gaggacccaggaagggagagtggcaacaggaagaggagggagctagttctccccggagccgaggagagggctcttccccgacgtaacctggcatatcatgggcttcatcatcaaggcacccaggggacctggactgagtgagggaggtcctgtcacagggactgaactctgagtcagcactgcaggaggacattatgcccctctggcccggtatcaaggctctggcccactcttcacaacaggtccattggccaaggaaagaggaggggttcttcttcctaaatgggtaattgtcattctyctagaggaagtccaccagcttatgcatatttagaggctctactgcccgagaggaggacctactcagcacctatggaggaagtgtgggaggcaggcctagggtctgaacataggctttctgcagagggactaaagccagcagctgtcactgctgctggacatggagaggagaggacatggaccttaaagtggagggtgaaagtgagtcctctctgaggttgtttggcttccagaagtcaggacacatcgaagccctctgtcccagaggactgggaccctctcaagcctaaagcttctgcct

SEQ ID NO: 19018 - DNA, 601 bp, Human
ggccaagaccagctctgaggcagagtgcagactgtagggtagagctggcaaagcttctctgctggagagctgtcagacatttcttccagccaagaatcatgtagggatcctggcacccactctggtgagatccaggaaagtcagccagaagggttaagcctggacaccaaatggacacccaggggacgagaggacccaggaagggagagtggcaacaggaagaggagggagctagttctccccggagccgaggagagggctcttccccgacgtaacctggcatatcatgggcttcatcatyaaggcacccaggggacctggactgagtgagggaggtcctgtcacagggactgaactctgagtcagcactgcaggaggacattatgcccctctggcccggtatcaaggctctggcccactcttcacaacaggtccattggccaaggaaagaggaggggttcttcttcctaaatgggtaattgtcattcttctagaggaagtccaccagcttatgcatatttagaggctctactgcccgagaggaggacctactcagcacctatggaggaagtgtgggaggcaggcctagggtctgaacata

SEQ ID NO: 19019 - DNA, 601 bp, Human
accatggaggaacccccaatcttggatatggccaagaccagctctgaggcagagtgcagactgtagggtagagctggcaaagcttctctgctggagagctgtcagacatttcttccagccaagaatcatgtagggatcctggcacccactctggtgagatccaggaaagtcagccagaagggttaagcctggacaccaaatggacacccaggggacgagaggacccaggaagggagagtggcaacaggaagaggagggagctagttctccccggagccgaggagagggctcttccccgacrtaacctggcatatcatgggcttcatcatcaaggcacccaggggacctggactgagtgagggaggtcctgtcacagggactgaactctgagtcagcactgcaggaggacattatgcccctctggcccggtatcaaggctctggcccactcttcacaacaggtccattggccaaggaaagaggaggggttcttcttcctaaatgggtaattgtcattcttctagaggaagtccaccagcttatgcatatttagaggctctactgcccgagaggaggacctactcagcacctatggaggaagt

SEQ ID NO: 19020 - DNA, 601 bp, Human
aggaccatggaggaacccccaatcttggatatggccaagaccagctctgaggcagagtgcagactgtagggtagagctggcaaagcttctctgctggagagctgtcagacatttcttccagccaagaatcatgtagggatcctggcacccactctggtgagatccaggaaagtcagccagaagggttaagcctggacaccaaatggacacccaggggacgagaggacccaggaagggagagtggcaacaggaagaggagggagctagttctccccggagccgaggagagggctcttccccsacgtaacctggcatatcatgggcttcatcatcaaggcacccaggggacctggactgagtgagggaggtcctgtcacagggactgaactctgagtcagcactgcaggaggacattatgcccctctggcccggtatcaaggctctggcccactcttcacaacaggtccattggccaaggaaagaggaggggttcttcttcctaaatgggtaattgtcattcttctagaggaagtccaccagcttatgcatatttagaggctctactgcccgagaggaggacctactcagcacctatggagga

SEQ ID NO: 19021 - DNA, 601 bp, Human
gactccctgggtgggtgcagtaggctatggttaccaccagctgtgggagggtcagaggctccactttgtgagctgggctgttggggatgggctttcatctctcccctggcgaattcctaatcctttataagcagtgaccattactgggatgtgcttggcacagcagctaactggattgccagaggctccacaatagatcatcggaggggcagtgaaggcaacttgggcttccttgcaccaggaaatgaggaccatggaggaacccccaatcttggatatggccaagaccagctctgaggcwgagtgcagactgtagggtagagctggcaaagcttctctgctggagagctgtcagacatttcttccagccaagaatcatgtagggatcctggcacccactctggtgagatccaggaaagtcagccagaagggttaagcctggacaccaaatggacacccaggggacgagaggacccaggaagggagagtggcaacaggaagaggagggagctagttctccccggagccgaggagagggctcttccccgacgtaacctggcatatcatgggcttcatcatcaaggcacccaggggacctgga

SEQ ID NO: 19022 - DNA, 601 bp, Human
agggcagggcgtcccatcccccgggctcacttcagccctatctagtaactcagagcactctgcatgtatccacgcagggggccaggtctccccgccctggggctggtttggctcatctgaggatacttgaaatgaggtgtccaagacccttgacttccctcattgtgtgtgccaggaaccctacatgacctcctaccggccaaccaaacaacccacgatcccaacccaacaagcagcttctgcgggtgggcgggcagcgtggagagaggccagtcatgccgaggtggctgagtggcagccytgagggcctgggaaacgtctgccctctccagagcctcaaagcgtctattcaacactcagtccctcccagcattctgaaccctgagcctttcttcctgagggggctgcaggaaaagagcacacgcctcctactgcagacctgctgcccttctgagggaggagcgccccgctgtgcggtgggcgtgcagtttagacgctgcttttgagatgcagaagagcaggagacccttcctccctgggaactgcagaagggcctggccccatcctaagacccttaggctcctcgctccaccacaggatc

SEQ ID NO: 19023 - DNA, 601 bp, Human
cctggcccagtgtccccctcagcggctagaggctagtagagggatgcagagggacacgctctctgtaaacctctgagtcaccatggataatgtgtctcccaggcctcacctccagccccccgtgggcggcagtgcccctcctgggcatcgtactcctccaggtcactggcacagaggcacaggaaggagccctccacgttctcacagagcgcggccccacataccgccagcataagctcacactcgttcacatctgccaggtgtgagaacaggctcgtgggcagaaaagaggcagcccgtrccccctgcccctgactacagcccactgcccccaaaagaagcaggctaggccttggggaagaaacaagagtaagtatagatttgtagggaggaggaaccaatggacagagggcatgggaaagaagaaaaaaggagaggagtggcagcaaacggtcacagaagtgcacaaagaggaagggttacccctcagtgcacattctccaaacctcctgcctcctgaggctctgaggcttgaggacacctgctgccctgctggcagagcgcggctgtgcttccccttacccgcccggcccatgtgccc

SEQ ID NO: 19024 - DNA, 601 bp, Human
cctctggtccattctgcttcacatgtaccccagcccctcccacccttcctcgtctccctcactttcccccaaggcagtgaagaccagctgagtcctagtccagcctggcgtgagaggctgaacccaggagctctcgggtggagtgggaagtgggaaagggagagcccggtttagttcagctccaagtcctctctcatccagaaggttcccagggattagatggattcagggtccctccaaggctcaatctgcggtccctggggccaccctaagtcagcatcagggtttcctgagcctcctstaggatcgtcgccaccctgtagctcctggttttgctgcgcgcggccctcagcctcctcacccctccatgcaccaggccccgcctgcacctccctatgctgccccaggccctggcccagtgtccccctcagcggctagaggctagtagagggatgcagagggacacgctctctgtaaacctctgagtcaccatggataatgtgtctcccaggcctcacctccagccccccgtgggcggcagtgcccctcctgggcatcgtactcctccaggtcactggcacagaggcacaggaaggagccc

SEQ ID NO: 19025 - DNA, 601 bp, Human
cttctgcccggagtagcagtccatgcgggtgggggccggggcatggtcccccgttggggcctcagacatactctgacctgtgcgtgacagatgctcattactgtctgttcatgaccctctaaggggggtcaatagtccttgactttatttcttaaatttaacatttgtgtagcactttacagtggaaaaaattctgttacctgtattacctcactgaggctctccacaaccctaagaagtggcctaatcatcatctcaagaaattgaggcttagagaggcttggggcctcgccactgctgygcgattaagctattaagcagtgcagcagggatctgaccccagttcctcctcccctgcgctttgcggtataccatgctgcctgcctccctgggacgggctgcccccagtgcctggcatgccatatgggcagccctctggtccattctgcttcacatgtaccccagcccctcccacccttcctcgtctccctcactttcccccaaggcagtgaagaccagctgagtcctagtccagcctggcgtgagaggctgaacccaggagctctcgggtggagtgggaagtgggaaagggagagcccgg

SEQ ID NO: 19026 - DNA, 601 bp, Human
tacctggaccatcctactgtgagtgtgtgttccccagagtttctggcctcatcagtgcggccagggagatgagcgcagcctctggcctctagagcagtgctctccactctgtccctgtgcccacatgtggctgtgggtgagagttagtcaaggcatcatagtttgtttctggaggtgcagcttgggagagcagggaaactgaggtgaggctcatgtggacactccaagagcagcttgagtcagaacttccagctaacactctgcagggagtcagccctgggacagaaaaggtggaggcaayctgcgaggccagggctggatgcagaacttccccagggaccctgtggaggagcaggctagggcccactcaggtgaaggagtttggggcagaggatggagcagattacctgtgtacatggtctgtccaaacgtccaggctccttccacaggaatgtagccttttccactagggcagatctcgctgaattcagctatgtagagaggcgtttcagctcagagtggggagggccctgcccccttcctctctccccttctttcagtgtcaccttgcagagctgacccttcgaggatctggaaccct

SEQ ID NO: 19027 - DNA, 601 bp, Human
gctaggcttgacttcctcattagactccaaggcctgagtgtttggatcgcaccattcacaaaccgagtcatcacggtgggcctttaaagtccttagaaaaccttaatccacacttcaggtcacaagtgtgaatgctgggtgtccttagagcaggttattctgcagcctgtaggtggcgtggagggagaaaaagactgcagtgaacagctttctctctctctctcagtccccacaggaagcttgtaggttgggacaggggcagtgtcctgtacctttttgtgtccctgtgatagtttatgayggagttgttagggtcggacctgggcgtatgtacttgtctcaagcgagccgtgaacggggacctctggcttggtgtgtctttccccttcccagtcctcaccctgctggcaatatgactagcaggtggaggagatggaagtgaaacagctttggtgcccacctcttccccagttttgcagcaacacagacctggatggctggccacgtagtggggctggagttctgagggctgcaaaggagactcaaggatgggtgtgcggtccgctgagtgaccggctgtgttggggaaggcaggctcagg

SEQ ID NO: 19028 - DNA, 601 bp, Human
gatgcacatttctttattccaccatggttctgaactcccagctagtttgggttggagtgagtctctgcttgtaaactcagaggaatgcctgccatcgttttctgaagggaaagggcaggggtttctgagtggaggggaaaaacaacattggaaatctggctgcttctgaacaagaccacactggaaaatagactttttacttttagcacatcaaactggttttcacaaaaggagatcccagaagaggtttgtttcctgtaagaagcagtgtttatgtaatagaggtctttgtagatgggtrctgtatcccatggcagcccttgctgctggtgcccacaggctatcactgggcggattcagctactgaatattttctttagacgtataaagccttggctcccctttctcatcaactccacgtatttttcatcatgtcctcttgctgctttctcaggctctttgttcttcttcatttgtgtctcttacattcaacaagctaatatcagccttgcttctctgagtgaagggatcttctgccactccttggggtcagagaatgggctacaggatggaggtgtggcaaaatcagggcccagaacag

SEQ ID NO: 19029 - DNA, 601 bp, Human
cagatgttaaattctgtaattaaagatattcattaattccttaatctttcctttagaaactactgctaaacatatgtttgaggttgtgttttgtttgtttgtttgtttgtttaatctagcctcctgccagtggcagaccctggtagtacctttaggtttgtctgagcccttagcctctacacacttctaccactgaaggcctctcgctgataaaatatcctaaaataaatacatgctggccaccttaggcttacccatcagagttcctagaagcttgctgactgatcattgattgtgaatktctctgcctgtgcagacacagctcacaggctcccactctgcctagggaaatccaacaggagaaggaacaaagctggagtccagcaggggcttccagatagcaccacacacaagacaatgcccaaggaggttgtttctgaattgtttttgtttttgttttggctttcaaaatttttatcaatatcacttagtaggcttaagatagccaatagttgtttttttggaaaaccagagaagaaaacctttatctttctagcagagaggaattcagcaatggaatgacaagcagaaagtcacctag

SEQ ID NO: 19030 - DNA, 601 bp, Human
agggttcaacatgagctggaatttgattttattcttccactatttgccttaaagactctgcagggtctaaaatgtaaagcactaaatggtgcttgtaggaaaatctactcttgctttggggttatgcaaactgtcaatatctacaaattaagaaataaaagtgatctctatctacatatattatagctcattcagtgttaaaaatacccacagtctgctcttaatagagtaatatgtttttgttaagaatccagatccagaatcaagcagtttggctctcaaaagcagatgttaaattctktaattaaagatattcattaattccttaatctttcctttagaaactactgctaaacatatgtttgaggttgtgttttgtttgtttgtttgtttgtttaatctagcctcctgccagtggcagaccctggtagtacctttaggtttgtctgagcccttagcctctacacacttctaccactgaaggcctctcgctgataaaatatcctaaaataaatacatgctggccaccttaggcttacccatcagagttcctagaagcttgctgactgatcattgattgtgaatgtctctgcctgtgcag

SEQ ID NO: 19031 - DNA, 601 bp, Human
aagtcctgaaaatgaacttaaaaatagttaagaagtcaattttacctctttgccaagaggtaaaatcagacggctcaaacagctgcattgcatggcaggttccacaagatgcaatgcaccgtatataaaacaccacacccaagtacatgactccacccataagaattctacaagataacccctatacatcattgttgttttgcagaatacttccataagcagctctcagatctcccacatggtcactcagcctcccgaaagccaggtgtccttagagctgggcttgacctcttcaattackgtaggactgacaagggttcaacatgagctggaatttgattttattcttccactatttgccttaaagactctgcagggtctaaaatgtaaagcactaaatggtgcttgtaggaaaatctactcttgctttggggttatgcaaactgtcaatatctacaaattaagaaataaaagtgatctctatctacatatattatagctcattcagtgttaaaaatacccacagtctgctcttaatagagtaatatgtttttgttaagaatccagatccagaatcaagcagtttggctctcaaaagcag

SEQ ID NO: 19032 - DNA, 601 bp, Human
aacgcaactcacacataaacaaacacacacgcattcttctaaataaaaaatctctcattcctcatcatgttccctttaattctaacatctacaaaagtcctgaaaatgaacttaaaaatagttaagaagtcaattttacctctttgccaagaggtaaaatcagacggctcaaacagctgcattgcatggcaggttccacaagatgcaatgcaccgtatataaaacaccacacccaagtacatgactccacccataagaattctacaagataacccctatacatcattgttgttttgcagartacttccataagcagctctcagatctcccacatggtcactcagcctcccgaaagccaggtgtccttagagctgggcttgacctcttcaattactgtaggactgacaagggttcaacatgagctggaatttgattttattcttccactatttgccttaaagactctgcagggtctaaaatgtaaagcactaaatggtgcttgtaggaaaatctactcttgctttggggttatgcaaactgtcaatatctacaaattaagaaataaaagtgatctctatctacatatattatagctcattca

SEQ ID NO: 19033 - DNA, 601 bp, Human
tgttagccactgcgcccggtcaaaatcagctcttctaggagtctaacgcaactcacacataaacaaacacacacgcattcttctaaataaaaaatctctcattcctcatcatgttccctttaattctaacatctacaaaagtcctgaaaatgaacttaaaaatagttaagaagtcaattttacctctttgccaagaggtaaaatcagacggctcaaacagctgcattgcatggcaggttccacaagatgcaatgcaccgtatataaaacaccacacccaagtacatgactccacccataaraattctacaagataacccctatacatcattgttgttttgcagaatacttccataagcagctctcagatctcccacatggtcactcagcctcccgaaagccaggtgtccttagagctgggcttgacctcttcaattactgtaggactgacaagggttcaacatgagctggaatttgattttattcttccactatttgccttaaagactctgcagggtctaaaatgtaaagcactaaatggtgcttgtaggaaaatctactcttgctttggggttatgcaaactgtcaatatctacaaatta

SEQ ID NO: 19034 - DNA, 601 bp, Human
atatcgacttttcagtttacatatcaacttatctaccagagggaaaacactttttttaagtataagaaattagaaatactttgaaatttttatttatttccattcctgcctaattttggatgacacgtattatataaagtcatagaatgccctaaaaaagaaataccttttttttttttttgagatggagtgtcagtctatcacccaggctggagtgcagtggtgtgatctcggttcactgcaatctccacctcccgggttcaagcaatcctcccacctcagcctcccaggtagctaggaytacaggcttgtgctaccacgcctggctaatttgttttgtattttcagtagagatggcgtttcaccatgttggccaggctggtcttgaactcctggtctcaagtgatccgcccacctcagcctctgaaagtgctgggattacaggtgttagccactgcgcccggtcaaaatcagctcttctaggagtctaacgcaactcacacataaacaaacacacacgcattcttctaaataaaaaatctctcattcctcatcatgttccctttaattctaacatctacaaaagtcctgaaaatgaact

SEQ ID NO: 19035 - DNA, 601 bp, Human
ttgctaaaaataattatctatttgtttcatggttagaaatgtttttcctccctgttactacacaggggaggtctcataattgagaaatctactgcagagcagaggacatggattttggaactgaggagtatggctcgtttgtcttatacccatgattaatttctcagtctagcccacttaggtctccagcagggagggatcgggtgtttcttaccacaggccaccttggcattggggtcttgcttgagatgggcatccagcactgcatcactgatctggtcacagatcttatctggacaasagcaaatatgggtcagaatcacaaaaatattcgggataacaaattgaaatcttaaaataattagatatcgacttttcagtttacatatcaacttatctaccagagggaaaacactttttttaagtataagaaattagaaatactttgaaatttttatttatttccattcctgcctaattttggatgacacgtattatataaagtcatagaatgccctaaaaaagaaataccttttttttttttttgagatggagtgtcagtctatcacccaggctggagtgcagtggtgtgatctcggtt

SEQ ID NO: 19036 - DNA, 601 bp, Human
cagcctacatgagtcttcagacacaataaattatgcagatgggagccagggcttcagtactttagtttaacattaatgtctcttaggaaagccattgatttattgaaaaacaattggtgaagatgttgccttcctgttgctattaaatgggggacactaattattttaaaacctaaatcataccacaaactaggaaagaaaacaagagaagaagccaggtatctgtgcagccaacaaaggctcctacaatgaggatgcagcttataaccatctaggcagctacctgtgtttcaagctcttkcatcccgtctggaagattcacctaagaactttgaaagacctccttgttcccaatgagatcaagcatcagaaaggccatgtgctggtccaaccctctgctatttatggttgctatgacatttaacgttagattcttgctaaaaataattatctatttgtttcatggttagaaatgtttttcctccctgttactacacaggggaggtctcataattgagaaatctactgcagagcagaggacatggattttggaactgaggagtatggctcgtttgtcttatacccatgattaatttctcag

SEQ ID NO: 19037 - DNA, 601 bp, Human
ccatttcctcgtctgcataagtacataaatgattaagacaacacaagagactatcaccagtgcctggcagcgagcatgtccccaaaggagggcagccccctttattcagtgcatctttctcttccaaagcctttggcagcgccaagaaggcaaggcctaaaacaagcccaatcaacaacagatgggcatgtgctgggcccactgggcatagtcgcctgttggccatccttatgccagagtctttgacccctggaacctgacagacaagtgtaggagtgttttcctcctggtagtattgatrctcccatcgggctgaaaggcacgggtttgactcagcactggggtctctatcagcagagagcaacagggatttcagacccggaggcctgccctcacccttggctgagtcatcgtagccgatgtgcttgatggtgtccctcaccacccgctggtagtccaccatggccattgaggtgatctcaccacacagcagcaccatgccggtcttgcacactgtctctgaaagggagcggggagcgaggagagttagcagccaagtgccagcaaagggaagctcacattcccagacctctcacagtgc

SEQ ID NO: 19038 - DNA, 601 bp, Human
cagcctcgcctgctgtcagcaccagttctggactgagtcatcttgctccatgtctatgattgcaagtaggtttagtggaagcacaggagtcctcagcctagtggctgcttaccctgtgatctcacacagactgtttacccctctaggcctccatttcctcgtctgcataagtacataaatgattaagacaacacaagagactatcaccagtgcctggcagcgagcatgtccccaaaggagggcagccccctttattcagtgcatctttctcttccaaagcctttggcagcgccaagaaggyaaggcctaaaacaagcccaatcaacaacagatgggcatgtgctgggcccactgggcatagtcgcctgttggccatccttatgccagagtctttgacccctggaacctgacagacaagtgtaggagtgttttcctcctggtagtattgatactcccatcgggctgaaaggcacgggtttgactcagcactggggtctctatcagcagagagcaacagggatttcagacccggaggcctgccctcacccttggctgagtcatcgtagccgatgtgcttgatggtgtccctcaccacccgctg

SEQ ID NO: 19039 - DNA, 601 bp, Human
catgagtgctttgggctgcaccaggccatggctggactgaacctctgcgagtctgcaccatcataccatgagtgggctctctcacttacaaacgggggtccagcaccctgacccacaggatgctacacatcaccctagacaacgattatgtgacacaggcagaaatgaacacctttaaagtcatgcttctctctgtgcatcttgattacaggtgtatagctaggcaggatgacctggaagtgggtctttttgccatggcgtgaggtcatcacatctctcacagtgatttcagagaattagrgaaagagctaacagagacccaaaatgaatttttctttaaaaattagaattgcctgaacatctaatgccagagaccaacgtggagactctaagaattggggccagagccctgcccaggaagccagcatggacaaagggcccctgaagctcctgcagaatgtgatcgcatacaggccctccgcacctggtgtctgctctctgggtcctttgctgccctccaggctgtgccgctgcctggcctgctcagtctcagatgttggaatctgcttcaaagttctgctagggcctgtgccccttccct

SEQ ID NO: 19040 - DNA, 601 bp, Human
tccgtgtggtaacgcctcaggaagctgcagctctgggacaatgtgtttcctctgtgaataccctcatgtcccgaccaggagaattaactggttcttactgcttctcttcccactgagtctcaaaatcactgtcatgcactcaaccaatattaattgctcatgagtgctttgggctgcaccaggccatggctggactgaacctctgcgagtctgcaccatcataccatgagtgggctctctcacttacaaacgggggtccagcaccctgacccacaggatgctacacatcaccctagacaaygattatgtgacacaggcagaaatgaacacctttaaagtcatgcttctctctgtgcatcttgattacaggtgtatagctaggcaggatgacctggaagtgggtctttttgccatggcgtgaggtcatcacatctctcacagtgatttcagagaattagggaaagagctaacagagacccaaaatgaatttttctttaaaaattagaattgcctgaacatctaatgccagagaccaacgtggagactctaagaattggggccagagccctgcccaggaagccagcatggacaaagggcccct

SEQ ID NO: 19041 - DNA, 601 bp, Human
cagagaaaacacacagatccaagctgctgtttctgtacaagcttcaggtggggatctactgccaaggaataaaactgaagcttttcagtctgacacagcccttgctcctgggactccttgagccaacatgaactcaagtttagccatcagcatgatatacttttccatctccactaggtccctgcctagaacgttctacctccagctcccaccccacatgcccaaaccccacgtccactctcagtgcatgtccctggacctgcctgcagttcattagacacaatgccaggaacttaccccrgggcacctcatgttgcatcatataccctgggagtatcaggtcacctttgccctttacaccctcctgtttcctaatgaatgtttttgaatgcacaaatcaatgaacagtctttaaagaactgccaaaagctgtcctgttctgcactgaacatttcagtttacctaatcactgtctgtctaaataatgaatctccccagggctcaaaaatcaagcaagggctccaaggaatttggaaaaacagaacttaggggaccaagaggggaggtacaggacttggaaaggacaatgagcccagcaaca

SEQ ID NO: 19042 - DNA, 601 bp, Human
agtctggggcaaatggaaaagccacctgccctttcccatctacaaagctgaggcacagggtgcaggcctgctacacctagcacgcgaggcactggtttggggaagtctggactagcagtagctcagccctgggagtcccatgaggaaactgctatgcaccgagaccgtgcgcacctcctcacagctgtgctgggctcagtcacagggactgtgagaataagggactgaatacatggacgcccccaccacaaggtcaagcatagtgacacactcactctccaaacccccacagccatcttcyttcccatctattctcctacccacacagcctgaaagggcttacagagaaaacacacagatccaagctgctgtttctgtacaagcttcaggtggggatctactgccaaggaataaaactgaagcttttcagtctgacacagcccttgctcctgggactccttgagccaacatgaactcaagtttagccatcagcatgatatacttttccatctccactaggtccctgcctagaacgttctacctccagctcccaccccacatgcccaaaccccacgtccactctcagtgcatgtccctggac

SEQ ID NO: 19043 - DNA, 601 bp, Human
gtcggtagcatagccgaacatcaaaccctgtggcgagagagcaggctgagcggcgcccaccctagaccaagaggaccgcagctctctccaagcctgaaatctccctggtgtgtccacgttgattgggtgcctcctccatggagctttccactggcatgtgcaggggaaggacgtcatccctgacccccaacactctaggagggggagacaagcccaaacccagtgtcagcaaccacagccatccacagcacggccgtgaagctggggttcccaactcgctcctggctatcgtgctaggacragaatccacccctcagtgtgattaacccactgctcatgaactttcccagccagctcaacacacagctcccacatgcagtgccgagctacctgatctcctgcccccacatcctcctcatttctgtccagatggacgcactgggcaatatctggggattgctgctccaaagccaccagcacgttgcaagtcttgaagtcaaagcctaggcggaagcaaagtgagcctaagtggggaacaggtcagaaggagggggccacaaacttcccaatggatggctcggttcctgacatgccatttggt

SEQ ID NO: 19044 - DNA, 601 bp, Human
aatcaagaggatttgggggtattaaagcttctgtctagggctctcctggggtaattcagctgctcacctgagtcttagagtcaggccgcagccaggggaggaggccggagcgcctgaggtctgccatccgggcgttgagcttgtgagcaaggatgatggtgaggggcatgcactcctctgtctcgtcggtagcatagccgaacatcaaaccctgtggcgagagagcaggctgagcggcgcccaccctagaccaagaggaccgcagctctctccaagcctgaaatctccctggtgtgtccaygttgattgggtgcctcctccatggagctttccactggcatgtgcaggggaaggacgtcatccctgacccccaacactctaggagggggagacaagcccaaacccagtgtcagcaaccacagccatccacagcacggccgtgaagctggggttcccaactcgctcctggctatcgtgctaggacaagaatccacccctcagtgtgattaacccactgctcatgaactttcccagccagctcaacacacagctcccacatgcagtgccgagctacctgatctcctgcccccacatcctcctc

SEQ ID NO: 19045 - DNA, 601 bp, Human
tgggaagcatctctagctgaagatttttcacataaatagttcttttcaaaactgaccattctttgaatgcccagattgaatatttcgatcttaaaaatgacacaatcaagaatcaagaggatttgggggtattaaagcttctgtctagggctctcctggggtaattcagctgctcacctgagtcttagagtcaggccgcagccaggggaggaggccggagcgcctgaggtctgccatccgggcgttgagcttgtgagcaaggatgatggtgaggggcatgcactcctctgtctcgtcggtrgcatagccgaacatcaaaccctgtggcgagagagcaggctgagcggcgcccaccctagaccaagaggaccgcagctctctccaagcctgaaatctccctggtgtgtccacgttgattgggtgcctcctccatggagctttccactggcatgtgcaggggaaggacgtcatccctgacccccaacactctaggagggggagacaagcccaaacccagtgtcagcaaccacagccatccacagcacggccgtgaagctggggttcccaactcgctcctggctatcgtgctaggacaagaatc

SEQ ID NO: 19046 - DNA, 601 bp, Human
gtctgacacttgcacaagaaggaactccatctctgtacaactggagttgtacatggagccacacacagcacgctgagctataacaccatgggtgccagattccaagtgcaggacaagagaaggcgctggcgctgtctgctagtggccagggatggcatcccaaaagaggtagaactttgctggccactgaaggagaggtgaagaccagagagggagctcaggtaaagcaaagccctaagaaacaaggggacaatgagtgaaatgatgtcgattaagcaaagatggtgtggggcaggcagargcaggtaaagttggaagaccataaaaggttgtgaatgccagaataataagtggatttcccccttccccttgtaggaagcccaaagttgtagaaaacactgaatagatgttagggaattaaaaatgaggcctaaaggggattagctggaatttccaagcagggagtacctttggaaggataggccactgatcctggcctggctgggatgatggcagccctggggaaggctgagctggagcgagaggggtgcttgatggggtaaactggggacatgggtaggtggagagagatggcgctgaa

SEQ ID NO: 19047 - DNA, 601 bp, Human
tcacagcagtgccctcaacctccacctcctcacacttgcagtacaagagagggggcagtggtgccctgtctaaaacaccctgtcccactctggtgcccacaacagccagaggcagcctgtggtgaagatctggaaacagccacccgggaacagctgtccacgtgcaaatgctgcagtggggaatgtgcaccagagcagggtgaggtgcagcagccgtgggtaaggtcgatggtcacttgagatggcaggagtgggagggcccagtggcgctaagtggaggaatcctagggacatatccccmatttcttgcacactgtcagacacatagcagacctccccagagagtgcactaaatgtacagaggccaaaattcaccgactttacatttagtccatggccagagtcagctgaccccctccaagctatctcttgaggttttcctgctctgagacataagcaaccccagtaacaaagacaaaccagggcttcgttcagagacaagaatgcacctggggacctccgatgacaaaccgcccactgggctgcaggtggtagacggtgtcttcgtccaggtacttggccggcaccacggccctgatga

SEQ ID NO: 19048 - DNA, 601 bp, Human
gatccaactgcaggcaggaactgcactgtcataaatacaaccctggctggtgccacctagcaaatgccatgctgcccacttcccaagtgtcctctgggcaacaccagtcaatagtgatgtctttaaaagggtgggagttctatgttaaatgatttggggaagtctgcctgctctactcccccttttagagatccacagttcatactagtatgtctaggctttgagaagtcctgcaagaaaaaacaataagtgttacctccttctactctgtgtttctacactctacttgctactggaaccygggatggagctcaactctggcaaagcacacacggctgagggcccaggcagtgggcagcagcctcacagcagtgccctcaacctccacctcctcacacttgcagtacaagagagggggcagtggtgccctgtctaaaacaccctgtcccactctggtgcccacaacagccagaggcagcctgtggtgaagatctggaaacagccacccgggaacagctgtccacgtgcaaatgctgcagtggggaatgtgcaccagagcagggtgaggtgcagcagccgtgggtaaggtcgatggtcactt

SEQ ID NO: 19049 - DNA, 601 bp, Human
ggtccaccttggtgtagtccttcccagagaaggccccaccaccatgagccccccagccgccataggtgtccacaataatcttacggccagtgacacccgcatccccctgcagagggagagaaatcaagataagaagcagagccagcccctagatgctggagggggctgaagtactgtgatggcagctgaactgcaactcaggaaggatgtcctggggctgcccacagacattttcctaagaccccttagcccagaactctggactccactcccagctcagtcactgacaacatattgaaawcaggtaacctgccaaagcttcattagcaagtgcagaaggtgggccaggggttctctggggtcacagccactccctaatgcctttgttactgagtccatcacaatggagagatccaactgcaggcaggaactgcactgtcataaatacaaccctggctggtgccacctagcaaatgccatgctgcccacttcccaagtgtcctctgggcaacaccagtcaatagtgatgtctttaaaagggtgggagttctatgttaaatgatttggggaagtctgcctgctctactcccccttttagaga

SEQ ID NO: 19050 - DNA, 601 bp, Human
accgagggcagttcttctacacgcctctctccctgaagattctggttttccctcccctaggttttcagagccctggccacagtgcccaacacaatcacacaatcacaacctttggcaaagcgtgcagctttcccaccgggccaacatcccctcactcagggcagaactgggcaggggtcctccactgcaacaggacggtggtgggtggagggggcttacctggacaagcactctccggcagagccctgctttcaccagagacttggccacccagcgggcagcatatgcagctgagcggtcyaccttggtgtagtccttcccagagaaggccccaccaccatgagccccccagccgccataggtgtccacaataatcttacggccagtgacacccgcatccccctgcagagggagagaaatcaagataagaagcagagccagcccctagatgctggagggggctgaagtactgtgatggcagctgaactgcaactcaggaaggatgtcctggggctgcccacagacattttcctaagaccccttagcccagaactctggactccactcccagctcagtcactgacaacatattgaaaacagg

SEQ ID NO: 19051 - DNA, 601 bp, Human
cctgctatcttcaccgagggcagttcttctacacgcctctctccctgaagattctggttttccctcccctaggttttcagagccctggccacagtgcccaacacaatcacacaatcacaacctttggcaaagcgtgcagctttcccaccgggccaacatcccctcactcagggcagaactgggcaggggtcctccactgcaacaggacggtggtgggtggagggggcttacctggacaagcactctccggcagagccctgctttcaccagagacttggccacccagcgggcagcatatgcrgctgagcggtccaccttggtgtagtccttcccagagaaggccccaccaccatgagccccccagccgccataggtgtccacaataatcttacggccagtgacacccgcatccccctgcagagggagagaaatcaagataagaagcagagccagcccctagatgctggagggggctgaagtactgtgatggcagctgaactgcaactcaggaaggatgtcctggggctgcccacagacattttcctaagaccccttagcccagaactctggactccactcccagctcagtcactgacaacat

SEQ ID NO: 19052 - DNA, 601 bp, Human
gacagcggctcggccacaccaatggcataggaaaccttccagcaaggtgcagcgtcagggattgaagcctctgtgtgggccctgcccctttcagaagctttgcccttcttctgaagggaccagcggggaccacatgcctcttgccccacatgctcccctgcaattttcctgctatcttcaccgagggcagttcttctacacgcctctctccctgaagattctggttttccctcccctaggttttcagagccctggccacagtgcccaacacaatcacacaatcacaacctttggcaaagcrtgcagctttcccaccgggccaacatcccctcactcagggcagaactgggcaggggtcctccactgcaacaggacggtggtgggtggagggggcttacctggacaagcactctccggcagagccctgctttcaccagagacttggccacccagcgggcagcatatgcagctgagcggtccaccttggtgtagtccttcccagagaaggccccaccaccatgagccccccagccgccataggtgtccacaataatcttacggccagtgacacccgcatccccctgcagagggagagaaatca

SEQ ID NO: 19053 - DNA, 601 bp, Human
ccatgatgatgacaggacaggctaaatgagagggacctggctttgccctgagggttggtgggtggggaaggcgatcagcagccaggcgtctggggaagaggagcatggccaccaggtgcctccagggtgagaccaggcccagctccccctggctctaaaatacaagcttcctgggaacctcccatgggaactcgcttcttccgaaatggccatagcatgctgtcttctggtagatgggcttcttcaagtccaaatccctgcatgtccagcagaaaggaagggcattggaagatggaacagragcagggtttctttctccatttcaaggacaggagggagcaacgaactgtaacacagccctcctcgcatggcactacgcctccccaccgcagttgcgcgcacccatcctatctgtgccataccctggtctcgttttatagccccacggatgcttagaggttcagggaccaggatctaactccagccttccggtgcttttctcctcccactccacttacctggcccaggccaatgttgacaccactaagctctagaaacggaatagacttgctgacttgattcccagccatttgagctattt

SEQ ID NO: 19054 - DNA, 601 bp, Human
ccagtctgagggagcagcaggagaacaccatgcccatccttacatcaagatccaacctccagcaccaggaagcccctgcctccagctggccatgatgatgacaggacaggctaaatgagagggacctggctttgccctgagggttggtgggtggggaaggcgatcagcagccaggcgtctggggaagaggagcatggccaccaggtgcctccagggtgagaccaggcccagctccccctggctctaaaatacaagcttcctgggaacctcccatgggaactcgcttcttccgaaatggccrtagcatgctgtcttctggtagatgggcttcttcaagtccaaatccctgcatgtccagcagaaaggaagggcattggaagatggaacaggagcagggtttctttctccatttcaaggacaggagggagcaacgaactgtaacacagccctcctcgcatggcactacgcctccccaccgcagttgcgcgcacccatcctatctgtgccataccctggtctcgttttatagccccacggatgcttagaggttcagggaccaggatctaactccagccttccggtgcttttctcctcccactcc

SEQ ID NO: 19055 - DNA, 601 bp, Human
gttaatcccctaatttccagtaacctcaggccttcaggacagagtccatggcctcatttctgaatctgctttgtcattgtttgagcctgttactggcatgagacaacggtgggggagggggtatgtcacaggctcctgagtcaaagctcctagttatacatctaggtctaaacacgtggctgtgggaccctgtggaagttatccagactctctgtgctttgctttcccccatctataaatgggatataaaaggtactacctcatcatgttgcagtgaagaaaaaacgagatcagttattarctgggtccctcgcacattacaggtgcttaggagacatcagtcctgctctaacccctgccacatgcctggcctgggtggggctttctggagaccctggctcagggcactggctgcctgtgaaaggggggtccaggagcccaggcccacaaggagccctgaggcctgttgagatgtgctgacctcacctggcacaggcaaggggagggagggggagctggtcagggtccagctgttgggggagacgagtgagggaattcactcttgacgggggtgccttttccactaaattaacattgcccc

SEQ ID NO: 19056 - DNA, 601 bp, Human
ccaaggactgctcaggccccttgggagcagacccgctccccagacagtcacctggcaaaggcagaatctcctcatgacgtctcagaagcttgtccaacaccagaaggcaagccccgcctatttaacatgaggccataggaccagcctccctggatccgaaagggccactcactccctccaaatgcactcagcctgcaggggatacaagggaccagggaaagagaaagacttgagggcctctgtctaaggggctggccatctgtgctaggacaagttgctgcttctgctccaggaagcccasataggactggactggacttagaccacttaccccagaagtccaaaaacccaatctctgcatgtctctgagtggtcagggggctgggattctaaagctgctggtcagtccctaactccagcctaccctgatgggccaggtaagccaactcaccctcagtcatcttctgggacacatgaagcaaacaaaatagccctgtggttctgtcttcacttttcagacaattgcccacggctcaacaagagctagtgggttaatcccctaatttccagtaacctcaggccttcaggacagagtccatgg

SEQ ID NO: 19057 - DNA, 601 bp, Human
tcattatccttcattaaaaattttaagttacaaacattttgattgatagtcagtcatggtggtgcacctagtccttactctgaaaccaaatatcctgccatctggggactttcaccagccctgtcggttatcttaccgcaacaccaaagaggaggctcagccttccccagttccctgagttcacattgattcaattctacagctcactagacctgcccaagacaggaccaatcaatgtcccgggagggcagagagggtggtggggccacacttagccatatggaaagacagtattctcagwtgagggcaggacttttttgtgggagaggacgcctagctttcagtcctaaaggaagtgatttccctggtaaagggaaggtgattttgccaaggctggagtctaaaggaagatggaactgtctttcaggcgtctccagcagaccctctacagacccgtgttcctgaaggcagagtcctgaaggcagaatacccctgtggcagtggcacagctcagagtgtcccatagacactgattttggccacggagatgctctctgtgtagtggttccggcctttctcatacaggacgtagagctggggg

SEQ ID NO: 19058 - DNA, 601 bp, Human
tgagcagctacggaggggagacaggtgtgacattatgcaccacagctccaggcaccccagcagcagcccctagcccttgctcctcctcctccttgctgctctttcaaatagacaggaacaagccactcactccccacatgtgaacatgctggactcaagacttggcacatgggcacttcaacaccaaagggtacagagttttccccaaaaacctgatacatccatcccacttcaaagcaacatgcccccaagccctcactccagtctctgccctggaacccaaggctcaacgtgggcgtcstgaggacgcagctctgaggtggggccaagaaccaggccccttctgcacctgcgccagtcaccggctgcccacaaccacattcaggagagaagaacctgaggctcacacacctgaagcagcttatcccgagactccaattaccgccaaaggtcttggctgaaggccttggaggctcaggtgtctgcagaattggctacagaggcatcagaggcttccttactggaagctggggtcggtcctaatcaagttacttcgtagacagccttggcaaccccaggctgtcgcttctgagttaagtta

SEQ ID NO: 19059 - DNA, 601 bp, Human
cttaaattctaatattctgtacaagatagctttttattatgaccaactcataagcgagatatatgtcattattaacatcgataacagagaaaggccaaagtaggcaagaggcaaaccccccttggggggacggtgagcagctacggaggggagacaggtgtgacattatgcaccacagctccaggcaccccagcagcagcccctagcccttgctcctcctcctccttgctgctctttcaaatagacaggaacaagccactcactccccacatgtgaacatgctggactcaagacttggcasatgggcacttcaacaccaaagggtacagagttttccccaaaaacctgatacatccatcccacttcaaagcaacatgcccccaagccctcactccagtctctgccctggaacccaaggctcaacgtgggcgtcctgaggacgcagctctgaggtggggccaagaaccaggccccttctgcacctgcgccagtcaccggctgcccacaaccacattcaggagagaagaacctgaggctcacacacctgaagcagcttatcccgagactccaattaccgccaaaggtcttggctgaaggcctt

SEQ ID NO: 19060 - DNA, 601 bp, Human
cctcccaaagtgctgggattacagacatgagccacagcacccagcctgaaatcattcttttctccagacattaacatgatggtcatcccatctccaggattggagcccagtggaaaatgttcctctcggggcctctcagcctcacccccgcctttccgcagctgtggcagctgggaatagaacaggtgggaatacttgcagaaatatttgctgtcttatcagtccccaactaaacagtgtccgaaagtcaaagcaacagctgaaaacccgccagagatgttttcattagacacactgcatrtgacctacacacactgctttggtttctttaaaaaaattttgtttgtttgtcaggaagttgctcatggggactccacaaaactttcccagcagtagtggagagacacgggtaggagttgaatacaggaacctcctgcgcaaaaactcaagagataaagacagtgtagccagctatgttcaaatcctggtgcttaaagcactgaagccacataactggactagctgcttaactccctgaacttgtttcctcttctgtaaaaaggtaataataaactatttcagtgtcattgaaattcttaag

SEQ ID NO: 19061 - DNA, 601 bp, Human
tcaaatgctctacacagccatcaaatctgcttttccatgagtactcaataaaaggaaaattctgaaggcataacagaaaaaacaggatacacaaacttcacctacggttccctccctctattgttttaatagataaatatgcatatgtgaacagtgtggaaggaaatgcatgttaagagtggttatctcagcccagcgcaatggcttatgcttgtaataccagcattttgggaggccaaggttggcggatcacctgaggtcaggagtttgagaccagcctggccaacatggtgaaaccccrcctctaataaaaatacaaaaattagctgggagtggtggcaggcacctgtaatcccagctacccaggaggctgaggcaggagagtcgctagaacccggcaagcagaggttgcagttagctgagatcataccatcgcactccagcctgggcaacaagagtgaaactccatctcaaaaaaaattttttttccctaattttctagaataaacatgaattacttttattttaaaaagagtccagtaagtttctggttaaggtacagcagaatggtggacaccctttgaattgttcttcccgttct

SEQ ID NO: 19062 - DNA, 601 bp, Human
gtcacgtacccagtggccagggtttggtcacacaggcaggcccaccacacactacacaggctttctgggagcacactcacaagacacatgccttcaccacgggcaggtatgtgtcaagaaatgctccctaatcactcactcaccagctcatctgtcacctcaaaactctcaagtctctctcctgcccccagggctcactctgctctccctctgctacttgcccaggtaggtttggctccatggtggggagtgcccacatatgggcatggggaggacagagggcactgcttctctggggcawaagggagggtgggaaagtgtcctgctgtgggactggtaggataaataattcaaatgctctacacagccatcaaatctgcttttccatgagtactcaataaaaggaaaattctgaaggcataacagaaaaaacaggatacacaaacttcacctacggttccctccctctattgttttaatagataaatatgcatatgtgaacagtgtggaaggaaatgcatgttaagagtggttatctcagcccagcgcaatggcttatgcttgtaataccagcattttgggaggccaaggttggcggatc

SEQ ID NO: 19063 - DNA, 601 bp, Human
atggttctccctggcctaagccagagctggggcctgagtctcaaagggaagtgaggtactgccctaccaccctcccggaccacaggccccaggggccctctgatggggcctcctgaattttgggccaggctctagacttacctctaacagccctgtcccactcagaagtgcctggggcccaggcagagttctctcatttcctgaagcagccagggaaaagggtggtttgtggggaagtgggagagggagcccctagcacgcccctctggagtaggctccagaaacacatttatttttaaamaagcagcagcaagtcagcggtcaaaagcagaggctttggagactgacagggttcagatcgcctgcctatgtgatttgaaccacatactccctggccaagaggcctcagacagtctaatctgacacagctcatttcctctgctgtaaaaagcagaacaggcataccttgcaagattatcgtaaaacctagagataacctgtaaagtgtccagcacacagtagatgttcaataagtcgtagttataaagaagatgaaatggaggagggacacagtgagaaaggacacggtagcctatggatg

SEQ ID NO: 19064 - DNA, 601 bp, Human
cactttctatggtcacacagctccctcacatcactctcctgacgtctgagaagtcccacgtcctcgcttaaaacaaggaagagtttgctaaggtcaggtgatacccagacaattgcccacagcttccctgctcaccttcctccccctggccctgggtacccgactatgtatttggtccagctgaccatccatctcagctcatatagtaacacataccacttggggatggttctccctggcctaagccagagctggggcctgagtctcaaagggaagtgaggtactgccctaccaccctccyggaccacaggccccaggggccctctgatggggcctcctgaattttgggccaggctctagacttacctctaacagccctgtcccactcagaagtgcctggggcccaggcagagttctctcatttcctgaagcagccagggaaaagggtggtttgtggggaagtgggagagggagcccctagcacgcccctctggagtaggctccagaaacacatttatttttaaacaagcagcagcaagtcagcggtcaaaagcagaggctttggagactgacagggttcagatcgcctgcctatgtgatt

SEQ ID NO: 19065 - DNA, 601 bp, Human
aaatgcagagaggcagaaggaagtgtccagcatagactacgttctggaaagccttccaacaaggaagtgctgaggctgatagctgctttggattaggatgcaaaatcaaacatccaaagaagccactgcacattcccattaatcagctgaatgggatcaaactgctgaattagccaaaccaagggagtctgacctagagaatctccccagccgtgcttgtgtcagcagttcctgcaatcattatggaaacccaatgacccaatttcctcgaccttcttttcattacagagaaatgtaaagrctttggccttaacatttaaggccaatggaactaggtaagaaacagatttcaaaatgccacagcaaactcccatggaaatctgcctccacggagaaaatcctaatggaaaaagagggttcaaaagcaggttgggagtcactgcacttaccacgaacacttggggccgcagagaggtctgaatcccggacacttggtttcttcttctcagcaggctaaatgaatgatgctccctggctttcaaagagggcagcgctggtttttaacacgtcactttctatggtcacacagctccctcacatc

SEQ ID NO: 19066 - DNA, 601 bp, Human
tcacgggcaggtgggggtggggctgggtgatgtcaagtcccatcagccactcagcgaccagctttccccgtctcccaccccctgcaccccattctctagagaagtggcaggaaaatgcagagaggcagaaggaagtgtccagcatagactacgttctggaaagccttccaacaaggaagtgctgaggctgatagctgctttggattaggatgcaaaatcaaacatccaaagaagccactgcacattcccattaatcagctgaatgggatcaaactgctgaattagccaaaccaagggagtatgacctagagaatctccccagccgtgcttgtgtcagcagttcctgcaatcattatggaaacccaatgacccaatttcctcgaccttcttttcattacagagaaatgtaaaggctttggccttaacatttaaggccaatggaactaggtaagaaacagatttcaaaatgccacagcaaactcccatggaaatctgcctccacggagaaaatcctaatggaaaaagagggttcaaaagcaggttgggagtcactgcacttaccacgaacacttggggccgcagagaggtctgaatcccggac

SEQ ID NO: 19067 - DNA, 601 bp, Human
tgctttgcaagccacctaagtctgctctgaagcctgctggtgctctgaaatccttggagggaaaaatcaccacccaaacgtgtgcagataaacaacactgctaggtgtctgtccacattagagtgccggtgacgcgatgaactctccccggaggctgactcacgggcaggtgggggtggggctgggtgatgtcaagtcccatcagccactcagcgaccagctttccccgtctcccaccccctgcaccccattctctagagaagtggcaggaaaatgcagagaggcagaaggaagtgtccarcatagactacgttctggaaagccttccaacaaggaagtgctgaggctgatagctgctttggattaggatgcaaaatcaaacatccaaagaagccactgcacattcccattaatcagctgaatgggatcaaactgctgaattagccaaaccaagggagtctgacctagagaatctccccagccgtgcttgtgtcagcagttcctgcaatcattatggaaacccaatgacccaatttcctcgaccttcttttcattacagagaaatgtaaaggctttggccttaacatttaaggccaatgga

SEQ ID NO: 19068 - DNA, 601 bp, Human
gaaaaagaaaaaaaagacaatccctggaaagcagttctgtgagcagaggttccctgacatctgtgatagttgtgctggggagggtagggttaaaggaccataccctttccatgtgacactgcgctagacagtgacctggtctagacagtgacctggtgaccactgtcgtcatcatccacactcgctgactgcctgccctgtgcccaggcccggtctcatcaagacctgacatgtcttcaggaagaaacaaggaaaaactacaaaacatgctttctaacccacaaacgtcattcatacatgyggcctcctcaccagaaaacaagtgttcccttgagcaggctgcttccctcattccactttcaaaaattcctccaaggcctcccctgaagctgtgcccacaacaacgaggaccaagacttcaagaaagcagggaaggagagagctgtcattaaggaataatcagggaagagctagtctcagctgtcacagcaagggcaccctctaatcacaaccctcctagcctggtggggtgggggtgacaggtgggaggcaccaacttaggaaatgctgaatcccttaggatcactgtttctcaaaggtg

SEQ ID NO: 19069 - DNA, 601 bp, Human
aattgaagagaaaaaactgtaaggtcctcctctggctcagcctcactagataaatcctaaacagactcctgcctggacccagggtttccctcactatccactctggcaatggggaattcactcttactcaaagaggggcaccacaacaaagagttgctgcattttctcaagctaaatcataatattccatctgcagcagtgtgctggatgagatacgaggctgtacaggtggctcttttaatacctccttttctagtatgacagttttgttttgggtgtgaatgaacagggaagctacgatctcctccctctgttcttcccatgcctcttaagctcctgtgatttatctctgctatgactggaggagcagttctgggagtccctgtacctaaaaagccacaggctgcagcctccaatgacagagggcaggctcacccttcagacccacaacagctggagcattcagaggatgttgtgtttcttaggctcccaaatagcaatgcacaacaaaaatggataagcagagagcaaaggtgcctgtttaaaggagaaagggagctgatgggtgggtgaagatggagaagcaggggacccaggatca

SEQ ID NO: 19070 - DNA, 601 bp, Human
ccttgttccactttcctgtgagacaaaggcagtggaggactcagggggtggctggaggcgacctggagacttggacacaagtcctgccccaaaagcttccaagagatgcctgtcaatcaaacgactgccataaaacaagaggccttgagagttaccatggaggcagcagcggccttgcctggggctggcctgaggtgactcacatcccagggggcaaaacgcatagccacgaaagtcagggcagctccaaactgtcagtgtgctcattcattcaatcagcaaacatctgtggtgcatctaytatgcaccaaagatcatgctgggctctggggataaaaagatgagtaagaaacacccttgtcttaaaacaaaacaaaaatcatctaatgtgacaaatgatacaatccgggtgtttgatggtaggtgcagaagcacaaaagtggaaccaaatctcagagatcacgaatgttttctagagaagagcctatctgatggagactggttttcccaggaggagggaagggcagaaggcacaatgttccagtgagggcctcacactgtggggcgggcagtggagatgatcagggtctcaggcaccatg

SEQ ID NO: 19071 - DNA, 601 bp, Human
agcgtccttcagcccactgccaagtccatctctggctgtgaatgcgcagtcctatgaaaccctgcagatggaaggtccatcatggccagccacccaccttttcggccaatcctcatcattacttcccttctccctcccgcatcagggaatgaatgtctggttttcatctgtaaggtacagtagccgcagggacctgtttgaaggcccccagctgctggtgggacctacccactgggcagtgttctctccatcctctgggccctgcctgccctcctggcaggagcgcggcgtggggctctcrgccgacattagggacgtccgctcatcacacacttcttcctcgctgtcagaggccatgaatgtgagcatagccctgcctctggaagcacctggaaaaaggagcacaaggaccttgttccactttcctgtgagacaaaggcagtggaggactcagggggtggctggaggcgacctggagacttggacacaagtcctgccccaaaagcttccaagagatgcctgtcaatcaaacgactgccataaaacaagaggccttgagagttaccatggaggcagcagcggccttgcctggggctggcct

SEQ ID NO: 19072 - DNA, 601 bp, Human
gagctcaaatttcagcaagcaggattaagactggctgcaagaaaacagtccacacagagacattttttaattctataatgggcaaaacagagaacagggttcaggcaaattcagatgttctgccctgatcgggagagaaaggacacaactaagtggctctcccaacgatatcctactctttctaacgttacaatctcctcccctgggggctgaatgatcacagtgaagcccaaatatccccagctcaaaagtcaatcgtgtatcaggcagactcctctcacacttaccatgtctggccatstgccaaaaaatgcttcccctgctaccatcctaagcttctgtgttacctgtcctagcacccaggcatccaaacaaactctcctattacagtggaaacagtgacctgcatgagagaggtaaacccaaggtggcagagtggacagcgtccttcagcccactgccaagtccatctctggctgtgaatgcgcagtcctatgaaaccctgcagatggaaggtccatcatggccagccacccaccttttcggccaatcctcatcattacttcccttctccctcccgcatcagggaatgaatgtctgg

SEQ ID NO: 19073 - DNA, 601 bp, Human
agtcagtgcacagggacactctctttgcgtgtgactaagatactgggaatttgcagaggaagaaattactttgaactttctgccccacagaatcaagcatgtaaatttgtagctctgaactagagaggctaaacaggtgttaagcatctgagaagacgcaggctctgggaaggtgggcaggcacaaatgaggaggtaacgagggagggcaggacacctgccagacactagcacaaaccgatctgtaagaatttgtgttttggaactgtggcaagtcaaggtcatgggctgccttgctaatraggtgaacagctaaagaaaaagccaaatgaaacaaaaactgaaaatgacagttgcttcagtaccggttctctgcagagagagtcccaatctagacgttcagccaagaaagaagactactcatgaacagaaactgaaacaaccaaagtgtacaaaacttcccggagataacaaacaagaaaaggctgaggagtggcagagcagtggccttaagctggtgtgatttcactcagggcttagggacgatggttccgttctcaaggagaacatggagaagtgagctcaaatttcagcaagcagga

SEQ ID NO: 19074 - DNA, 601 bp, Human
taatgcacggatttttggaaccagaaatgagaagtttgaatgttgctttccagatataaggagcagtctatgagctactagggcatatgaaaagtttgtgaggacaaagtagagaagatttggagctggatgaagcaccataaatgaaggaaggaaggttgctatggtctgcaggcccaagacttaatggttaatgaatcaacttaatggttaatgaatcaaaagatctttccccttcctaatacagggactcaggaggtcactcaattctgttcatgtggccatactgatatgggaggaracaggccaggagataaataaacatttttggctgacaaatcactagctagaggagtcagtgcacagggacactctctttgcgtgtgactaagatactgggaatttgcagaggaagaaattactttgaactttctgccccacagaatcaagcatgtaaatttgtagctctgaactagagaggctaaacaggtgttaagcatctgagaagacgcaggctctgggaaggtgggcaggcacaaatgaggaggtaacgagggagggcaggacacctgccagacactagcacaaaccgatctgtaag

SEQ ID NO: 19075 - DNA, 601 bp, Human
ctcagccctcaccccaccctgctccccccagccccccaactcacagctgtccattcttctctgtgtagaagcgcacagacttgatggtggctaccaccacgatcatgcacagagtgacaggcacaaacagcatgatcacgtgcttcgctccgtatttgagggtcagctcttcctccaggcctggcggccgcccgggaaccccactacagacatagcggtcagggtcctcctcaccgtcctcctcgttctcctggcttctctgtgggaaaccacatcgtgagggccgcggaatgtcccccayggcagcctatccatgtaatgcacggatttttggaaccagaaatgagaagtttgaatgttgctttccagatataaggagcagtctatgagctactagggcatatgaaaagtttgtgaggacaaagtagagaagatttggagctggatgaagcaccataaatgaaggaaggaaggttgctatggtctgcaggcccaagacttaatggttaatgaatcaacttaatggttaatgaatcaaaagatctttccccttcctaatacagggactcaggaggtcactcaattctgttcatgtggccat

SEQ ID NO: 19076 - DNA, 601 bp, Human
caccccctggcaactcagccctcaccccaccctgctccccccagccccccaactcacagctgtccattcttctctgtgtagaagcgcacagacttgatggtggctaccaccacgatcatgcacagagtgacaggcacaaacagcatgatcacgtgcttcgctccgtatttgagggtcagctcttcctccaggcctggcggccgcccgggaaccccactacagacatagcggtcagggtcctcctcaccgtcctcctcgttctcctggcttctctgtgggaaaccacatcgtgagggccgcrgaatgtcccccacggcagcctatccatgtaatgcacggatttttggaaccagaaatgagaagtttgaatgttgctttccagatataaggagcagtctatgagctactagggcatatgaaaagtttgtgaggacaaagtagagaagatttggagctggatgaagcaccataaatgaaggaaggaaggttgctatggtctgcaggcccaagacttaatggttaatgaatcaacttaatggttaatgaatcaaaagatctttccccttcctaatacagggactcaggaggtcactcaattctg

SEQ ID NO: 19077 - DNA, 601 bp, Human
ccaccttgtttcacattcagggaagcagagactcagagaggaagtgatttgtttgcagtcacacagggatcagtggcacagccatgcccaggatcaagagcttgctttctgcagcaggatccagcttgcctgagcactcacgtgcagtagacactcttctaagcccttcactcatattaactcacttaattctcccagtaactgcgttatcaacccattatacgaacaaggaagctgaggcatagggatgttaaaagcatgcccaagtaggtcacaatccaggaggcagtgagccaggccrtgaacctgggcggttcttcatccctgctctttaccgctgctggtgtggagctgcaggtacagtgaccaacacaggctgctgcgccccccaccccctggcaactcagccctcaccccaccctgctccccccagccccccaactcacagctgtccattcttctctgtgtagaagcgcacagacttgatggtggctaccaccacgatcatgcacagagtgacaggcacaaacagcatgatcacgtgcttcgctccgtatttgagggtcagctcttcctccaggcctggcggccgcccgggaac

SEQ ID NO: 19078 - DNA, 601 bp, Human
caaaaaaaaccaacacacacgaaatgaaacaaaagtccctaactttaaaaaaaaaaaaaaaagtttacagaaggtgcttagcagtgaggaccacagaaaggggagggggaagaagtggaggaagcttctcatttttctacgctgctgcctctgcatgtattttactaaaataaacgaaaggctttataagtcttcctcacaaggctggaagtgagctgagaaatatctggtccaaccaccttgtttcacattcagggaagcagagactcagagaggaagtgatttgtttgcagtcacacarggatcagtggcacagccatgcccaggatcaagagcttgctttctgcagcaggatccagcttgcctgagcactcacgtgcagtagacactcttctaagcccttcactcatattaactcacttaattctcccagtaactgcgttatcaacccattatacgaacaaggaagctgaggcatagggatgttaaaagcatgcccaagtaggtcacaatccaggaggcagtgagccaggccatgaacctgggcggttcttcatccctgctctttaccgctgctggtgtggagctgcaggtacagtga

SEQ ID NO: 19079 - DNA, 601 bp, Human
ctgcagcctcgacttctgggctcaggtgttcttccacctcagtctcccaagtagctgagactacaggcatgtaccaccacacctggctaatttttgcattttttgtacagacagggtctcgccacatttcccaggctggtctcaaactcctgggctcaaataatcctctcacctcagtctcccaaagtgctgggattacaggcatgagacaccacacctggccttattcctttctttaaaagaaacaacaacaacaaaaaaaaccaacacacacgaaatgaaacaaaagtccctaactttaaaaaaaaaaaaaaaagtttacagaaggtgcttagcagtgaggaccacagaaaggggagggggaagaagtggaggaagcttctcatttttctacgctgctgcctctgcatgtattttactaaaataaacgaaaggctttataagtcttcctcacaaggctggaagtgagctgagaaatatctggtccaaccaccttgtttcacattcagggaagcagagactcagagaggaagtgatttgtttgcagtcacacagggatcagtggcacagccatgcccaggatcaagagcttgctttctgc

SEQ ID NO: 19080 - DNA, 601 bp, Human
aatcatggctcactgcagcctcgacttctgggctcaggtgttcttccacctcagtctcccaagtagctgagactacaggcatgtaccaccacacctggctaatttttgcattttttgtacagacagggtctcgccacatttcccaggctggtctcaaactcctgggctcaaataatcctctcacctcagtctcccaaagtgctgggattacaggcatgagacaccacacctggccttattcctttctttaaaagaaacaacaacaacaaaaaaaaccaacacacacgaaatgaaacaaaartccctaactttaaaaaaaaaaaaaaaagtttacagaaggtgcttagcagtgaggaccacagaaaggggagggggaagaagtggaggaagcttctcatttttctacgctgctgcctctgcatgtattttactaaaataaacgaaaggctttataagtcttcctcacaaggctggaagtgagctgagaaatatctggtccaaccaccttgtttcacattcagggaagcagagactcagagaggaagtgatttgtttgcagtcacacagggatcagtggcacagccatgcccaggatcaagag

SEQ ID NO: 19081 - DNA, 601 bp, Human
gggaagtatcggggtgaggggagcctaaaatagaacttcagaaagagaagcaaaacaaaattaactttgaaatatgagaaatgatgcttggaacactgcaatgaggaactcaagtgggataatgtgtaaatttaaaagacaacaggctggatgcaatggctcacacatgtaatcccagaactttgggaggccaaggtgggagatcacttgagtccaggagtttgagaccagcctgggcaacactgtgagatctagcctgcacaaaaaaaaattttttaattagccaggtatggtggtgcamacctgtagtcctagctacttgaggggctgggtgggagaacttcttgagcccaggaggttgaggctgcagtgagtcatgatcgcaccactgcactccagcctgggcaatggagtgagaccatgtttcaagaaaaagaaaataaataaaaataaaagacaacagtattaggtcatccacggtgggagacaggatggggtggggaggagtacaaaaaatctgggtctattttcctctaatttgtgtttttctaaaggcggctgtttcacgggccctgccgccatggtgtggggcagacggaga

SEQ ID NO: 19082 - DNA, 601 bp, Human
gaaaaggaaaactaaaaataaatcttcaggggaagtatcggggtgaggggagcctaaaatagaacttcagaaagagaagcaaaacaaaattaactttgaaatatgagaaatgatgcttggaacactgcaatgaggaactcaagtgggataatgtgtaaatttaaaagacaacaggctggatgcaatggctcacacatgtaatcccagaactttgggaggccaaggtgggagatcacttgagtccaggagtttgagaccagcctgggcaacactgtgagatctagcctgcacaaaaaaaaawtttttaattagccaggtatggtggtgcacacctgtagtcctagctacttgaggggctgggtgggagaacttcttgagcccaggaggttgaggctgcagtgagtcatgatcgcaccactgcactccagcctgggcaatggagtgagaccatgtttcaagaaaaagaaaataaataaaaataaaagacaacagtattaggtcatccacggtgggagacaggatggggtggggaggagtacaaaaaatctgggtctattttcctctaatttgtgtttttctaaaggcggctgtttcacgggcc

SEQ ID NO: 19083 - DNA, 601 bp, Human
agctccctccctgcactgtccctgtcccatccctctagcctgggcactctgcacttctatctacctgctccatggatggcagcggcctgaacaaaaaatgctgtgaggcacctgtgtgtaaacagttttaaaataggtaatgcccagcttaatttcctttccatcgttaggggttcaaccccttacctgggagaaaagcctgaagccgctgtctaaaagcttatggcatctttggggacaggcagtgcccatgattctggccagatgggatctgcccttccactactccctggggctactyggcagctataggcagctacaacccaaaagtctcccagggctgcaagacctcagcatggcctctgcacatccttgcccgaaaaggaaaaggaaaactaaaaataaatcttcaggggaagtatcggggtgaggggagcctaaaatagaacttcagaaagagaagcaaaacaaaattaactttgaaatatgagaaatgatgcttggaacactgcaatgaggaactcaagtgggataatgtgtaaatttaaaagacaacaggctggatgcaatggctcacacatgtaatcccagaactttggga

SEQ ID NO: 19084 - DNA, 601 bp, Human
gaccaaggtggagcctgtgactgggactcagtggaggcattacagcctagcagtttaccaccattcagtcccaacctggccctctttactaacatttccttccccgaccttcactgtccttacaatttaccatttgcagcattttctaaaacaaggtggggatgcttggaacagatcacagaaatgtgcatgggcatgacctggaagaccctgtgcacatggaaaggtccttgggaaagtgttttctcttgtcctcccagtctctttgggcccctgggtcaggctgatatcccaaatcaasgggcgatagaacagataatttttcccacaaaccagaaagtacccaggcctagcctaaaaatcagaatgtaaattttggggggtttctatccccctggggttcacagagagccttctccatgaagggttcattttaaatcaggaacgagacagaaacatgtggtccaccatgcagccccacttccactcccctgtgtcaaggccatgagagagggcgacggaggcctgggttcccaaaacggctggcactggggaagactggagctcgatggtcatctttccccgcccaggtcctcatgcc

SEQ ID NO: 19085 - DNA, 601 bp, Human
tagcacagtgcctgtcacaaaatggggacttgatgtgcctttgttgactgcatgtgtaagtccaaatctctacacattgaccccgaggccaggggccatcccgtgtgccttcccttcagttaggattaatgccaatcagccacgctgctgtcaaggaagcccagaagctccttgctccccgaccccctgccctgaagaatccctctccaaagtcccttctcaagagcctggagagctgaggggtggctgcgggatcacaggaatgcaacctgcaccgcagcatgccgctggaggatggacrggatgaagtcagggactgcagcacatcccagcagatgcctgcttcctgtcctaactttctaagcttcttactgtgtaataacaagatactgccctccctggcttctgaaagtggagaccctcctgggatcgcccagtcaactctgaaagccacggccaggaagcaggcccctgtccccccacaggctgcctgctgaccccgagtcaggcagaggcacggggggctcactcacatgagtatatcagggcagggaatatgggctcatttctctcctgggcagtttctaccagcattctcaga

SEQ ID NO: 19086 - DNA, 601 bp, Human
tcacaatcacagggccgtgagctccatgaggcctgggaccctgtggtcttctttcctgctgggtcccccaatgcctagcacagtgcctgtcacaaaatggggacttgatgtgcctttgttgactgcatgtgtaagtccaaatctctacacattgaccccgaggccaggggccatcccgtgtgccttcccttcagttaggattaatgccaatcagccacgctgctgtcaaggaagcccagaagctccttgctccccgaccccctgccctgaagaatccctctccaaagtcccttctcaagakcctggagagctgaggggtggctgcgggatcacaggaatgcaacctgcaccgcagcatgccgctggaggatggacgggatgaagtcagggactgcagcacatcccagcagatgcctgcttcctgtcctaactttctaagcttcttactgtgtaataacaagatactgccctccctggcttctgaaagtggagaccctcctgggatcgcccagtcaactctgaaagccacggccaggaagcaggcccctgtccccccacaggctgcctgctgaccccgagtcaggcagaggcacggggggct

SEQ ID NO: 19087 - DNA, 601 bp, Human
gaggggtccagcttcgccatgccaaccgtccacaccatggcagctgggggaggagaaaaggttcacgtctcaggcggtgctaacagtggctgcctgcagggcctgggggaggtggccagtctgcgtcccagaaagcctgcacaggaccctccatcctgcaggtatctgctcatgctccattgttaggaggccgttgtgggaggggtccagagtcactctctcttgcatttgtctattctgttactgtttgtctcccctcctaaagcataagaaccaggtctatcagagccaagacctcacwgttcacgggtgaatcccccgagccctgggacactcatgacagtcctggcactacctttccatacatggtctccgctcatcctcggaatgcgcctggaatgtgctttcccgtggggccacgctgcaggcaattctcctctacgggctcgaatcctcaactgcatgaaggtacctagaactctgtagctgttccataaactctttcccaggccaccttgcagacgccagagctccagaaattcaggctatttaagccccgccatcaacagaccgagggcatcacaatcacagggccgtgagc

SEQ ID NO: 19088 - DNA, 601 bp, Human
ggctggcagaggaccgagggtccaacacttgctgaatcttcaagccgcatgtgtccggctggttttcaacggacctttccctctgcccctcctgaactcatgcctctcagggaagccaggccgagcagagctgggtgcaggtagggagctgccccccagtgatgagaggctgttagctccccaagatactcacccatctccgggtcgtaggggagctggagggcaccctgagaggaggggtccagcttcgccatgccaaccgtccacaccatggcagctgggggaggagaaaaggttcacrtctcaggcggtgctaacagtggctgcctgcagggcctgggggaggtggccagtctgcgtcccagaaagcctgcacaggaccctccatcctgcaggtatctgctcatgctccattgttaggaggccgttgtgggaggggtccagagtcactctctcttgcatttgtctattctgttactgtttgtctcccctcctaaagcataagaaccaggtctatcagagccaagacctcacagttcacgggtgaatcccccgagccctgggacactcatgacagtcctggcactacctttccatacat

SEQ ID NO: 19089 - DNA, 601 bp, Human
tcccctgggtagccagtcaagggaggctcaaagacttcggggtatgaaggctccccaaaactgtcataggagtcttcttctgggtgtccaggaagagaagatgtccgtcatcaccgtgaggaggggacaacaagagagagaaacaacagctggtcagagtgttaccagggaacaaagctccaagaaggggtccccctgagcaccagcacctgacaccagggcttcccccactccacccacccacgcccagcagaacgatgcaacagaggctggcagaggaccgagggtccaacacttgctsaatcttcaagccgcatgtgtccggctggttttcaacggacctttccctctgcccctcctgaactcatgcctctcagggaagccaggccgagcagagctgggtgcaggtagggagctgccccccagtgatgagaggctgttagctccccaagatactcacccatctccgggtcgtaggggagctggagggcaccctgagaggaggggtccagcttcgccatgccaaccgtccacaccatggcagctgggggaggagaaaaggttcacgtctcaggcggtgctaacagtggctgcctgcagg

SEQ ID NO: 19090 - DNA, 601 bp, Human
ccaaggtgggaggatcacttgagcccaggaagtcaaggttgcagtgagccacaatcgtgctactgcactccagcctgggcaacagagcgagaccctgtctccaaaacaaaacgacaacaaaaaacaaactgcaattttaagtgtagtgctttcctgagttctgtgagtcattctagcaagttattgaacctaagggggtcatgggagccctaaatttgcagccggtcagaagcacaagtggcatctagaccctctagagcttgtggctggtgtctggagggaggccagtcctgcgggcccygtgggatctgtgctaactcctggtctgcagcacaccagttggccttggaataaatacctcccccaagcctgcctggagggtgcgcacctgctcctccttccagacccaccgcagagtgatctttccctagcttgcccctcccgtgtcactggagtcctgtatgccaagccactgtcaccaggctgctcccgtaaggcacctctcaaggcaggggctgttacgacagtgcagcatctccctgctccagggtgctgcctggcacgcagcagtgggctggcattgggtgttaggcaggcaccg

SEQ ID NO: 19091 - DNA, 601 bp, Human
actgatcaggaaattagagcttccaaaatgctctcatttgttttctttagtgcaatggtccctgacacttgtttataggataactttgctcactgtagacaataaaaatggttatgcaataaacacaaaccatggaggcccacctcccctgcccttccagccctgcaggtgtccctcctgctcctggccccagctgtcctccttcccccaccaggtgtgatccatcagcattacttcttcactgtctcttcatttggctggtcctgagttgcatctcttataataaaactaattttggccrggtgctgtggctcagacctataatcccagtactttggaaggccaaggcaggtggatcacttgagcccaggagttcgaaaccagcccgggcaacaagtcaaaaccttgtctctactaaaaatataaatgagccaggtgtggtagcacgtgcctgtaatcccagctactcaggaggccaaggtgggaggatcacttgagcccaggaagtcaaggttgcagtgagccacaatcgtgctactgcactccagcctgggcaacagagcgagaccctgtctccaaaacaaaacgacaacaaaaaaca

SEQ ID NO: 19092 - DNA, 601 bp, Human
ttcagtacattcaaaagcccatataacaccaagacagaggtcctctgaagaacctttcaccttacaacaggtaaatataactgggaattagtctacccattactgatcaggaaattagagcttccaaaatgctctcatttgttttctttagtgcaatggtccctgacacttgtttataggataactttgctcactgtagacaataaaaatggttatgcaataaacacaaaccatggaggcccacctcccctgcccttccagccctgcaggtgtccctcctgctcctggccccagctgtcckccttcccccaccaggtgtgatccatcagcattacttcttcactgtctcttcatttggctggtcctgagttgcatctcttataataaaactaattttggccaggtgctgtggctcagacctataatcccagtactttggaaggccaaggcaggtggatcacttgagcccaggagttcgaaaccagcccgggcaacaagtcaaaaccttgtctctactaaaaatataaatgagccaggtgtggtagcacgtgcctgtaatcccagctactcaggaggccaaggtgggaggatcacttgagcc

SEQ ID NO: 19093 - DNA, 601 bp, Human
gcccaccccacctggcctctagaagctaagatgtggactggggacatggacagctgcctccccaaatcagtggccagtgggaaagcaggggacacctgtggactgggtgacttacaacctgggcagagaaaagcgggcagttctgaaactcaggtaaaaccagtgttgggcacttagagagtaaagaaaacaacaaatagaaatgcaaggccttgggctgggcactgctgtacaatttagtatgaagtctgaatcacagatttttagggaatttaatttcagtacattcaaaagcccatayaacaccaagacagaggtcctctgaagaacctttcaccttacaacaggtaaatataactgggaattagtctacccattactgatcaggaaattagagcttccaaaatgctctcatttgttttctttagtgcaatggtccctgacacttgtttataggataactttgctcactgtagacaataaaaatggttatgcaataaacacaaaccatggaggcccacctcccctgcccttccagccctgcaggtgtccctcctgctcctggccccagctgtcctccttcccccaccaggtgtgatcc

SEQ ID NO: 19094 - DNA, 601 bp, Human
gaaaaatccctagggatcctgagacctgcccccaccacaatgaggaccctgggggcccccaccacgaggcagctggacgcatccccagccactcacaatgaggatggccacgaagcaggccagcgtggtattccagtccccgctgcccgtggcagccgccttgcccaccagcacactgtagaagatgaagtccccgaggccaagcttcacgccccctgtgtgaggagagacagtaacccgtactgaagaggcgtgcacagaatggaaaaagaagagaaactctggcccagaaggcccagcygctcttgcccagcccagcccaccccacctggcctctagaagctaagatgtggactggggacatggacagctgcctccccaaatcagtggccagtgggaaagcaggggacacctgtggactgggtgacttacaacctgggcagagaaaagcgggcagttctgaaactcaggtaaaaccagtgttgggcacttagagagtaaagaaaacaacaaatagaaatgcaaggccttgggctgggcactgctgtacaatttagtatgaagtctgaatcacagatttttagggaatttaatttcagta

SEQ ID NO: 19095 - DNA, 601 bp, Human
agtggtccaggtgagcacagggaaccagggtgccttctatatctttggggccagcagggctcaggtaaggcagtctggtggtggaggagcctgggtccaccatcccatccctgatatacttgtgggcaaaaagaaaaccttctggacactggagcatcaaccttaatcatgccatgcccagggttttcactaaggggcagatgccaagcgcacggctcagacgctcctcctcctctaacgtgacagcgaaatctctgagatgaagtcacggcaggacgtctccccattatgtgtatctggycacgttaactgactacagggcctccacatttcactgctgtggttcacagtaacggggccacccctagtgccccagattcagaccctgtggtgtcccaatggcatggaggagggggaaaacatggtcctcactagctttgcgcccatgggcaaggcccttaagcaattttcttttctgcaaatctgatgtcatcacaaccacctcgagggtatcatcactgcgcaaagctgtcagctgggtcctcggcctggaggctgtgtgctcagccacgctggggccggtacactcctcaccctcccc

SEQ ID NO: 19096 - DNA, 601 bp, Human
accagtcggataacggcgctagacaccccattatcttccctggtcctgcaacagctcttgaggtgttaagggcagaagttctcacccccattagatcacctcacctgttagtgagtgaaccagaaggcaggcctcctgactcctggagcagtgctgtgccccgaggccgtgctgcctcccctgtctggctggagtggtcacatgggatggtaagatgccctcagggaacatgtatttatatgagagctaggtgggctcaactgaaatggcagtaaggttctcagcagctggcaccaagggwatcagagccgccaggcaacctgcccctgggaagcaggtgtgggggctgcccatcctcccctgacccagctgatgcaggcagtggtccaggtgagcacagggaaccagggtgccttctatatctttggggccagcagggctcaggtaaggcagtctggtggtggaggagcctgggtccaccatcccatccctgatatacttgtgggcaaaaagaaaaccttctggacactggagcatcaaccttaatcatgccatgcccagggttttcactaaggggcagatgccaagcgcacggctcaga

SEQ ID NO: 19097 - DNA, 601 bp, Human
cccaagatgcagggagaggggtcaacatttacaacggaccaaactccaagattctaacaggactcatctatttattgatattactattaagccacttcccagcagtgtgactgccgtaacaagaacaggactcagtttctaaaggcaataaaataacaaggacatcatggacaaagcattgggaacactcctcgtagggaactggcttttcctctccagccagagcacccaggtgccaggggccactcccgagcacactctttgcgcatctcagccctcatgccggatgctcttctccccrccctaatctgaccttctcagttcatctggataaacctgctgtgcttcctgtccgtgaagcgaggcgctccccaaagcgggagccaaagtctggtgatgaaacagctggcaccaaagagctggttctgcctcctcctcaccaagtaaacacgtactttattttttaaggaaagaaaagtcttaaaaatatatggcactagagtgtaaaactatacaactgcatccaatgaaaattccctgcagcttgcagcctgtggcacaccatgtccctcagatgtagagctgatgggaggccagggtg

SEQ ID NO: 19098 - DNA, 601 bp, Human
tagtgcgagaatgagaaatcttggtctaatggcactgacttacccaaagtgagagctgagagaaactgtgaagcaatcatgacttcaagagttcttttcacccaaaggtttaggcttgaaatactttcctggggagataaaacacaaaatgaattaaagaaggaaatcgtgggtagctagttacattattctaccatgatgtttaaggcagcatcctaagattttgggcaaaggacactagtgcaataatctttatttcagagtttaatcaaataaataaacaaattttaagactttcatyatttaggtcaaagagaaaagacaggttttagctacaatacaataagagcttgtacagatgtggtttttattagaaggccttttgcatatctgtgtttcatggcccgaggctgcccttataaagcgttctgcacttaccgttttgggaagcagttgttcaaacacaggatctctcaggtgggtatcactgctgcctctgtctcaggtcagtataggagttttgatgtgaagtcagccaagaacagctgaacactacttcggctgaggcccttttataggagggattgcttcctgtgaataa

SEQ ID NO: 19099 - DNA, 601 bp, Human
actaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacagccccagacaagcaaggatatttcagtctgaaatatctatagtgcgagaatgagaaatcttggtctaatgrcactgacttacccaaagtgagagctgagagaaactgtgaagcaatcatgacttcaagagttcttttcacccaaaggtttaggcttgaaatactttcctggggagataaaacacaaaatgaattaaagaaggaaatcgtgggtagctagttacattattctaccatgatgtttaaggcagcatcctaagattttgggcaaaggacactagtgcaataatctttatttcagagtttaatcaaataaataaacaaattttaagactttcattatttaggtcaaagagaaaagacaggttttag

SEQ ID NO: 19100 - DNA, 601 bp, Human
gtgtgtacctttgctgacaataagcactggcctcatcataagtcatagcttccgtggaggtgttgtaagaccaggctccactctctttaatgagaagcactagtgggagaaaaagaaaagaaatggtagagtttggtactgttgtggtttaactctgacaactgtgctttttattgtcttatttttggcaatgtttgtgacatggcccagacttttctcatcttttcaaaagtaagaagtacgtatgaagaaacagcgacttattgtttatctcttttgtgactgccacccactaggtacyttatccacactcactcacaacattatagtatacccattttgtagtagaataataatcagaataactaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacagccccag

SEQ ID NO: 19101 - DNA, 601 bp, Human
ccaggtgtgtgtacctttgctgacaataagcactggcctcatcataagtcatagcttccgtggaggtgttgtaagaccaggctccactctctttaatgagaagcactagtgggagaaaaagaaaagaaatggtagagtttggtactgttgtggtttaactctgacaactgtgctttttattgtcttatttttggcaatgtttgtgacatggcccagacttttctcatcttttcaaaagtaagaagtacgtatgaagaaacagcgacttattgtttatctcttttgtgactgccacccactrggtaccttatccacactcactcacaacattatagtatacccattttgtagtagaataataatcagaataactaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacag

SEQ ID NO: 19102 - DNA, 601 bp, Human
acaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatactacagtaagcttccaaccaggatgagaaccattcacaaagctatatttcaaatttaagtactagaatacattacaaattttaaaaccctaatgctgcactgtctactatagtagccactatctgtggctacttgaattcgttgaaatcaaatracatttaaaattcagttcctcagtgtcaccagccacatttcaagtactcaataaccacatgtggctcataggtacacactggaaaacacagctatggaacatttccattatcacaaaagctctactgcacaacgctgtgctaaggaatcttggagagaagctcatctaactctcttaatgtacaaatttaggaactgagacctcatttcattcaagcgacttgctccatgctacacggctagtcattacagagccagaggccagagcatgaaccaagataccctggactctgtaactcac

SEQ ID NO: 19103 - DNA, 601 bp, Human
cataacaacaacaacaaaaaagcagtgatgacaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatactacagtaagcttccaaccaggatgagaaccattcacaaagctatatttcaaatttaagtactagaatacattacaaattttaaaaccctaatgctgcactgtctactatagtagccactatctgtggctacttgaattcgttgaaatcaaataacatttaaaattcagttcctcagtgtcaccagccacatttcaagtactcaataaccacatgtggctcataggtacacactggaaaacacagctatggaacatttccattatcacaaaagctctactgcacaacgctgtgctaaggaatcttggagagaagctcatctaactctcttaatgtacaaatttaggaactgagacctcatttcattcaagcgacttgctccatgctacacggctagtcattacagagccagaggccagagcatg

SEQ ID NO: 19104 - DNA, 601 bp, Human
gaagcaatgagggatgagttacagaacgttctgtgcattctcagagggatttaccattgcaggctggaataggagcactccattctccagaggacatacactgcatggtctccatgctgcttggcaggtaacccctatcacagctgatagagcaggaagaattgtagctgaagtttcccagtgggtgactgcaaaccaggcttccatgctcaggggattccagggctgtacagttcacaactgaaaaagaaacccaaatcagttctgctcatctctcacctttaacagataagaacactgraaactagaactacagtttggttttttttttttttagtttaaaaatttataaaatttctaatggaatttgtaaaattgactgtaattctaccccttttcttttattcaagaaaatgctgatccataacaacaacaacaaaaaagcagtgatgacaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatact

SEQ ID NO: 19105 - DNA, 601 bp, Human
ttggctggatttgtcacagcatcacactcaaccactgaggatttgaaagagcaccatgaattttacagaagaatgatcttttcacttcctattgagctgggtgcctaacagagtgaggaagctgccttcaaagggtagattccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatasattccagattaggagttatgactagtactgacatacgtaggctattcatttattttagcccatcagagcctgaagaactgatttttctttttttggcctctggttcagaaagataaaattaagagagaaaaagagatactaagactgcttgactatcatggtcttaagttagtcccatggcttggaaaagttaaacagggaaacaagatgagaaatccattgagatttctagagctttattgttttatggtctcccttacaaatcaccagagcctcagaaacacccatttcaagcataga

SEQ ID NO: 19106 - DNA, 601 bp, Human
aactctacctttacacgttggcttctcgttgtcccaattcccagatgaggtacactgaaggctctgggctcccattagttcaaatccttcttcacagtcaaatgtacaggttgtgttccatgggaagcttccagggttttggaaacattccacgaacccattggctggatttgtcacagcatcacactcaaccactgaggatttgaaagagcaccatgaattttacagaagaatgatcttttcacttcctattgagctgggtgcctaacagagtgaggaagctgccttcaaagggtagatyccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatagattccagattaggagttatgactagtactgacatacgtaggctattcatttattttagcccatcagagcctgaagaactgatttttctttttttggcctctggttcagaaagataaaattaagagagaaaaagagatact

SEQ ID NO: 19107 - DNA, 601 bp, Human
atatacgcattgatattagcacggcctagaattagcttgcccatttccagtatgggttgagagaaagaatgttcacagtaagtctccatgtggaacaactctacctttacacgttggcttctcgttgtcccaattcccagatgaggtacactgaaggctctgggctcccattagttcaaatccttcttcacagtcaaatgtacaggttgtgttccatgggaagcttccagggttttggaaacattccacgaacccattggctggatttgtcacagcatcacactcaaccactgaggatttkaaagagcaccatgaattttacagaagaatgatcttttcacttcctattgagctgggtgcctaacagagtgaggaagctgccttcaaagggtagattccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatagattccagattaggagttatgactagtactgacatacgtaggcta

SEQ ID NO: 19108 - DNA, 601 bp, Human
aactcacagctggacccataacggaaactgccagaagcactaggaagacaattcatgtagcctcgctcggggttggacaaggctgtgcactggaaagctgagacatcaaaatgatggtcagaaaatattgcagtggaactagagagtacttggcgtttgttgagtgaacccagttcattcaagcaacacttggagaactgaagattctttataattccctggacaaatgggaagatggctgtgttttctttgaatttcagccccctcactgatcatggcactaattaaaagactaattaaycagaacattagttcctgagcactgttcttctaacacacaaaataaattatggtccaaggaaagatttcacgcagtctgaggacaacatatgggtcatggatgtttatagatggtgccaaaaagaaagaaaagaaagcacccctataaaatttgtctgttttgcagtttggtttttgtgttatgttttgctactggaaatcattctgtgctggctttggctaggacaaggccagtgcctgatagtaaaaactgcttgttttcaatatccttgctctcactttaaagtgaattaaaatttac

SEQ ID NO: 19109 - DNA, 601 bp, Human
caagctcttcaatagttctttttatcttaaaataaaataaaaacaaagactgtaccttcacatgtgggcttctcgttgtcccactcccctgtggggccacattggagccttttggatcccttcaacacaaaaccctgctcacaggagaactcacagctggacccataacggaaactgccagaagcactaggaagacaattcatgtagcctcgctcggggttggacaaggctgtgcactggaaagctgagacatcaaaatgatggtcagaaaatattgcagtggaactagagagtacttggygtttgttgagtgaacccagttcattcaagcaacacttggagaactgaagattctttataattccctggacaaatgggaagatggctgtgttttctttgaatttcagccccctcactgatcatggcactaattaaaagactaattaatcagaacattagttcctgagcactgttcttctaacacacaaaataaattatggtccaaggaaagatttcacgcagtctgaggacaacatatgggtcatggatgtttatagatggtgccaaaaagaaagaaaagaaagcacccctataaaatttg

SEQ ID NO: 19110 - DNA, 601 bp, Human
actactaactcttttcttaatacttctgcttaattatactgcattttatccagattctaattattgtttaaatcagtaagcaagaccatgacttatcaatgagaaagaaatgtattttcaaaaacatttttgaagtacattcataaacttcctcacctttccgtaagcatttccgaagccagaggagaaatggtgctaatgtcaggagggagagtccagcagcagaaagtccagctaccaagggaatgttggactcagtgggagctaaggaagtaagagacgaagaaaggtcatgaggaaraattgatgttaaagtctctccgtcctgtccctttggccttttttctgtacattcattactaggagcagaagagctatctagtttaatacaagaagcagagatgtggcattacaggcctttgagatctgctccaagccacctttgaagctatttccaccattggcaggcagaactctaacttgccaagctcgttcacaataccacaccacaccttggttaataaacactgcacttgcttgctctcttgctctcactccctcttgttttccatttcccctttctcctctcctctctctgtct

SEQ ID NO: 19111 - DNA, 601 bp, Human
gcacctgtaatcccagctactcaggaggctgaggcaggagaattgcttgaacgcaggaggtggaggttgcagtgagccaagatcatgccactgcactccagtctaggcaacagaatgagactccatctcaaaattaaaaaaaaaaaaagtaaaaagaaaagataagaaatatagtaccagcccctatctcagagttcctagcttagaaaaattcccagaatataataagtgcaatgtaagggtcagctatcttcattattattatctatcataaatgaaattacacaataaagctagatcygtttctttcctctccttctacaaaaaataaagcaactttccagaacaatacccaggtgatgatttctcccctgctccctccctaagatattggcaagtttggagggttcaaggagaaacagagcatgtagagaagatacctctctcataaccatttgtgatttacaagtcttacctgattcttttgaacttaaaggatgtaagaaggcttttggtagcttccatctgattcaaggctttggcagctgctgtggaatacatgagaacactaggtaaagcactgtcttccaacatgaagaga

SEQ ID NO: 19112 - DNA, 601 bp, Human
ctgacataagcttaaataaatatatactttaaaaattataaaatattttaagttataatttaaaattctcaataaaactcaaacacaaaccacactggtatttcacacagctaatttctaatgcagtttacataaatatttacaacacttaaacaatttcaaagaaaataacactgtattccatacatagcctgatcacagtagttgttctctcttatttcccagagtttttctgcccctttaaaagaacctctgctgttctgatccttatcacatctctgttttgactgttggctttgtygttgccagtgttcagccagaacttctctgaaacttttttttcaacacatgctaagttaatggaagtgtaggagagttttgattctcacactcctcaaggctagagcagctttggcaattactgactgagaatttttcattgccagtgatcaactgaaaactggagattcctttggaattgttaaatctgcttataaataaacataaatgcttgctcacacaggcattcctctcttccagagcaccctaacatacagaagaaaacaaatagggaataactattagacatcttcattcgtta

SEQ ID NO: 19113 - DNA, 601 bp, Human
cgtgcgcgcgggtggatcaccagcgctgttatttacgcctttccattggaaatctcactatttatacgcggcgacctcgcccagccccccatgcgctgcctgtctggtgcaattactggtctccgggctccgcggcggacgcacgcagagacgctgtgtctcccccaccccccaggccggcaattggctttcttctcatttcatcactgtttggcgtccgtacaccttggtgcgaagggggaaagatcccatttttggaagggagagcgcgcgcgcaggaggggggcgcaggcgcccgagycccccacacaggttacccgcgttctctccgtggccggaggaaaagcaaactccagttttcctgcagagagagacagagagacaaggagttcacggctggagagaggagggtcccagtcgtccggccgccctcgctcccgggaggagcgcagagcccggcgcctggatctttccaggaagcgcccgggtcgcgccggggttgagatggcgaggggggggacccgggcgccccggggacgcacgatcttgggagaagatgagctccaagttggtggcggcgcgcccttggatggagagttgg

SEQ ID NO: 19114 - DNA, 601 bp, Human
tggtgcctcctacgaatacaagggctatttcccggggccactccacaccccaaatgcagggccccggagagcaggtagccccagagtcttaggaagaattacctttggggcattcaccctcgcacctcaactctgcgaatcagcaaaagccgaggctagattctctgcgtctttgtaatgaaaacataacaggcgtccatagccgtctccagctgtgccccgacacagccagcccattttattcttaagatgtatgccgcccagttgtcgtgtgtgcacagagatccccggggccagcccytctctctgagcctcttactccccgatttccaccacgggacgacccaccactgaggtctcaggaggaagggccagaggggagctcccccgggccgcgcacaaccggctgcgctctgacaaccttgacttaggacgcgcccgcgaagccgccagcttccccggggcccctcgcgccccatccagatcccggccacctccgctcacgggagtggtttttatggacccaacagctttcgccaagatcaagcctcgacgttcaaaggaaaacaatgaaataataatgaagggttccttaaaggaa

SEQ ID NO: 19115 - DNA, 601 bp, Human
ctgacaaactggtcttcaaagtcctcaaacacccgcaggctttgcagaacccacgggctcccaggctcggcggggacacgctgttcccaaaaactccaggcttccacggtaacctcagactctcccctgccctccaacctcgatttaacttggatctgatgaataaatagtagcctgggtggcagtcctggcccgggggtctttctgcacccagccaaggggaaaatgtaacggggactctctgtctcctctcctgtggccctgggtctttggcctggtctttattttcctctcactttcraaaggtctggaggacactttgctctcccgggtccacggccagggggagaagagagagttcagaggagcaaaacggtgtctgcgaaggacaaccaaaaagcaaccccacagaagcggccgccgggcgctgcgaaccctcttaaattacacgcaggccctcaagcggctcccagccttgcgtccaggaaggccaactctctgtgtatgaattacagtgccgggtgcccgcagcagtgtgtagggaggaactcctctcactgtcaaaggcaggctgggctcctgcctcttagacggtcagaaa

SEQ ID NO: 19116 - DNA, 601 bp, Human
tctacagggaacggggtaaatactagcaccctgttctgtctttcttccttccacgatccacaccagggccctcccaccccaccccgagctacattcagcgctggacgcttactccaacgtggatttcacattctgtttcacctcctaacagacatgtgcctgcaagaacactccattccttccccccaagtgaatcgtttcctggagacgaccccagctctccctccttcatttctctaagtctgaaccccaggaattgagcccaactgacaaactggtcttcaaagtcctcaaacacccrcaggctttgcagaacccacgggctcccaggctcggcggggacacgctgttcccaaaaactccaggcttccacggtaacctcagactctcccctgccctccaacctcgatttaacttggatctgatgaataaatagtagcctgggtggcagtcctggcccgggggtctttctgcacccagccaaggggaaaatgtaacggggactctctgtctcctctcctgtggccctgggtctttggcctggtctttattttcctctcactttcaaaaggtctggaggacactttgctctcccgggtcc

SEQ ID NO: 19117 - DNA, 601 bp, Human
cccttgctgtcaagggtaaggggctgacatttggaagtttagtctggaaacagtctcaaaggggcacaggcaaggccgctgcaaccaagaagcttgcaaagctgacaaatccagggtgtctacagggaacggggtaaatactagcaccctgttctgtctttcttccttccacgatccacaccagggccctcccaccccaccccgagctacattcagcgctggacgcttactccaacgtggatttcacattctgtttcacctcctaacagacatgtgcctgcaagaacactccattccttcyccccaagtgaatcgtttcctggagacgaccccagctctccctccttcatttctctaagtctgaaccccaggaattgagcccaactgacaaactggtcttcaaagtcctcaaacacccgcaggctttgcagaacccacgggctcccaggctcggcggggacacgctgttcccaaaaactccaggcttccacggtaacctcagactctcccctgccctccaacctcgatttaacttggatctgatgaataaatagtagcctgggtggcagtcctggcccgggggtctttctgcacccagcca

SEQ ID NO: 19118 - DNA, 601 bp, Human
agaagcacgcgatgccctaatgagatgtcccttgctgtcaagggtaaggggctgacatttggaagtttagtctggaaacagtctcaaaggggcacaggcaaggccgctgcaaccaagaagcttgcaaagctgacaaatccagggtgtctacagggaacggggtaaatactagcaccctgttctgtctttcttccttccacgatccacaccagggccctcccaccccaccccgagctacattcagcgctggacgcttactccaacgtggatttcacattctgtttcacctcctaacagacaygtgcctgcaagaacactccattccttccccccaagtgaatcgtttcctggagacgaccccagctctccctccttcatttctctaagtctgaaccccaggaattgagcccaactgacaaactggtcttcaaagtcctcaaacacccgcaggctttgcagaacccacgggctcccaggctcggcggggacacgctgttcccaaaaactccaggcttccacggtaacctcagactctcccctgccctccaacctcgatttaacttggatctgatgaataaatagtagcctgggtggcagtcct

SEQ ID NO: 19119 - DNA, 601 bp, Human
acagatgagaagcacgcgatgccctaatgagatgtcccttgctgtcaagggtaaggggctgacatttggaagtttagtctggaaacagtctcaaaggggcacaggcaaggccgctgcaaccaagaagcttgcaaagctgacaaatccagggtgtctacagggaacggggtaaatactagcaccctgttctgtctttcttccttccacgatccacaccagggccctcccaccccaccccgagctacattcagcgctggacgcttactccaacgtggatttcacattctgtttcacctcctawcagacatgtgcctgcaagaacactccattccttccccccaagtgaatcgtttcctggagacgaccccagctctccctccttcatttctctaagtctgaaccccaggaattgagcccaactgacaaactggtcttcaaagtcctcaaacacccgcaggctttgcagaacccacgggctcccaggctcggcggggacacgctgttcccaaaaactccaggcttccacggtaacctcagactctcccctgccctccaacctcgatttaacttggatctgatgaataaatagtagcctgggtgg

SEQ ID NO: 19120 - DNA, 601 bp, Human
cccagggctggtggaagtggcatctccaacgcccctctgttcctatctcgggcctgctgagcacagatgagaagcacgcgatgccctaatgagatgtcccttgctgtcaagggtaaggggctgacatttggaagtttagtctggaaacagtctcaaaggggcacaggcaaggccgctgcaaccaagaagcttgcaaagctgacaaatccagggtgtctacagggaacggggtaaatactagcaccctgttctgtctttcttccttccacgatccacaccagggccctcccaccccaccccsagctacattcagcgctggacgcttactccaacgtggatttcacattctgtttcacctcctaacagacatgtgcctgcaagaacactccattccttccccccaagtgaatcgtttcctggagacgaccccagctctccctccttcatttctctaagtctgaaccccaggaattgagcccaactgacaaactggtcttcaaagtcctcaaacacccgcaggctttgcagaacccacgggctcccaggctcggcggggacacgctgttcccaaaaactccaggcttccacggtaacctcagac

SEQ ID NO: 19121 - DNA, 601 bp, Human
ctctttgcattcataaatccctgcgtggggagcggagggcacagggctgaggccggggaggttttgcgcaacgtggcgaaccccttcgtgcatcccgcggtggaaagggggccctcgaaaaccaatgcgctttgacgcaaaaactgcgtggggtccataaggcaaaagccgaggaggatactcgctgctttcccaaaaacctgggctttgcacgagcgttgttttcttggcctcatctcagaatcgtttcctcaattatccacttcacctctgttgacataacctaacctttttttcttattttttttttttaaggagagtggggtgtcaaatcctatttttaagggaaagaatttgaggaagagctgccaactgtgggatccccggcgggacgcccgggaaggacacggggaggacccggggcgggttgcagattctaggcctacggagagacgctatccccaccgctgcagcgcaggagggctgggggtccctccgcgatctggcggagctaggagcccctacccgaagcctgtttctcagcagaacagcagaaccgcgtctgagtacctgaatgcgccaccgcgcctgggggctgaac

SEQ ID NO: 19122 - DNA, 601 bp, Human
catctgtagcttcgtctcctaagtataatccagggaaagttttgtttgcatgtgttgcccctataaccaatcccaggggaaccgaaggcagtcaggagccaatatatgggttcaccgggtgtctttgcaccaaggacgaacaaatatctataatatatacaatatacccatctgtataacatatatatttatttgttatttgtataatatatatgtatatatatttgtttgctgttggtgaaaaacaaacgcaatgaacccatcctacaggcctcaggcgtctccaaaagtccaggaaccscagcccgtccctcacccaacctccccgcgctccgggaaggggacggcggcggcccgggcgcaggtggctgtacgcgtgctgtgcgctcccgaggaccaggcgatggctccgggccccccgcccccgcccccgggttcctacctgcacgcgcgcctcggagagccccaggcgctggctgagctcctcgcgcatgaaggcgtcggggtaatgggtctcgtcgaagagtcgctcgagctcgttcagctgctccagcgtgaagttggtgcggctgcgcctctgtttcagcttggtctgcccgtc

SEQ ID NO: 19123 - DNA, 601 bp, Human
agggacagaggacacccctctcctttcatcctaaggaaaccttttcaatgcagccacacgggaagacggaggggaatcaggggccaaaagacacatttttttttaaatgaaaaatcttgtaaaacactctggatcaaacgcatctgtagcttcgtctcctaagtataatccagggaaagttttgtttgcatgtgttgcccctataaccaatcccaggggaaccgaaggcagtcaggagccaatatatgggttcaccgggtgtctttgcaccaaggacgaacaaatatctataatatatacratatacccatctgtataacatatatatttatttgttatttgtataatatatatgtatatatatttgtttgctgttggtgaaaaacaaacgcaatgaacccatcctacaggcctcaggcgtctccaaaagtccaggaaccccagcccgtccctcacccaacctccccgcgctccgggaaggggacggcggcggcccgggcgcaggtggctgtacgcgtgctgtgcgctcccgaggaccaggcgatggctccgggccccccgcccccgcccccgggttcctacctgcacgcgcgcctcggag

SEQ ID NO: 19124 - DNA, 601 bp, Human
gagttgaccttccaggggagctgaactgtcaggcaggggctggaagaagccatttggaggctctcccagcagcacccctgaaataaactcatacctttaagtgaatgtttagaatgcggaggaaggctctgcccgcccgtccctctgcggacacccaaggcccctccgccccccggtgcctggtctcatggggcagcgtgaattcgcgcgctcctcggggagcccccgtgccccgctaatagtctccgctcatccagatgcccaacgtgctcctgcgctccccacagccggagggaggagrgggtggtttgtagcagaggacagggctggagaggggaggagggagatagaaacggtaggtgaaaaaacggaggaaagagaagaccctgtttctctccacctagggacagaggacacccctctcctttcatcctaaggaaaccttttcaatgcagccacacgggaagacggaggggaatcaggggccaaaagacacatttttttttaaatgaaaaatcttgtaaaacactctggatcaaacgcatctgtagcttcgtctcctaagtataatccagggaaagttttgtttgcatgtgttgcc

SEQ ID NO: 19125 - DNA, 601 bp, Human
ctctctccctccccccacttctgtcctgcccagaaccaggagaaaggactagaggagttgaccttccaggggagctgaactgtcaggcaggggctggaagaagccatttggaggctctcccagcagcacccctgaaataaactcatacctttaagtgaatgtttagaatgcggaggaaggctctgcccgcccgtccctctgcggacacccaaggcccctccgccccccggtgcctggtctcatggggcagcgtgaattcgcgcgctcctcggggagcccccgtgccccgctaatagtctcygctcatccagatgcccaacgtgctcctgcgctccccacagccggagggaggagggggtggtttgtagcagaggacagggctggagaggggaggagggagatagaaacggtaggtgaaaaaacggaggaaagagaagaccctgtttctctccacctagggacagaggacacccctctcctttcatcctaaggaaaccttttcaatgcagccacacgggaagacggaggggaatcaggggccaaaagacacatttttttttaaatgaaaaatcttgtaaaacactctggatcaaacgcatct

SEQ ID NO: 19126 - DNA, 601 bp, Human
tcctccgccaaggcggtgagtgaaccagtcactccggctgttgtgggcaaaacacgtgctgggtccctcggcccacagccacccttacgcactgtgcatggcccagggccggtgcccctatgaagggaacctcagaaaaccctcagagtttgggagcagccaggagtctacacagcgcaacgtgaacttgctcttgaacccaacacggaagcttccagcccagctttcggaactggcttttcatttccaaagtgggtcctaccgggctgcagtgcgcctggagaacctgatcctgtttccsagcaaagtcatcctccctcacacccccgccaaaaaggcccctgcctggtgctgacatcgaaattcaccaataatttccaaagctggcgccttcagacctccacctccactgaccatccaggtgacctgccactgtgcctctccatgcccacctggactctccgcctgtctcctccagggcccagaaagcaagccagccacccaaaagcctctggaagggcatttttcaaaaaagaaaatcctcctgaaacgtggaaagcctcattcactctcccttcaacacggcgagaggaaaaaaaaa

SEQ ID NO: 19127 - DNA, 601 bp, Human
agtagctgggattacaggcgcacaccaccacacccagctaacgtttgtatttttagtagagatggggtttcaccatgttggccaggctggtctcgaactcctgacctcaagcgatccaccctcctgggcctcccaaagtgctgggatgacaggcgtgagccactgcacctggcctagaactggaaattgggttttcttttttgatttttgttttgtttttgttttattttgtttttgagacagagtcttgctctctcatccaggctggagtgcagtggtgtgatctcacctcactgcaacstccacctcccaggttcaagcgattctcctgcctcagcctcccgagtagctggaattacaggtgctcaccaccatgcctggctaattttcgtattttagtagagacggggtttcaccatgttggccaggctggtctcaaactcctgacctcaagcgatccaccctcctgggcctcccaaagtgctgggattagaggtgtgagccaccgcacctgacctagaagtagaaattgttaaatcatccgtgccctgcctaagtgagacctatgcgttaccgctgatgaacttaaggtgaaaaagtg

SEQ ID NO: 19128 - DNA, 601 bp, Human
ccaaagtaagtggggagctgagtagggtgtctccagctcagaggtgcagagcccaagccaggggccaggggccaggcagacgccccaggccctcgggcactcgggggtggtgatgaaaagggaatgggtgtctgtcccatctctggtatccaggcacaggcatctgcgcccttcttaaccaggcagcaagccaggtgggggtgcctgactgtgtggacttttcacccctctggtttttgtcagatttctgtttgggcttgtgtgtgttcaccttcccaaaagtggatttttacagcctgatttttttttttttttttttgagatggagtcttggagtctcactctgtcacccagagtggagtgcagtggcgcgatattggctcacggcaacctccacctcccaggttcaagtgattctccctcccaagtacctgggatcacaggtgtgcaccaccacgcccggctaagctttgtgttttcagtagagacggggtttcagcatgttggtcaggctggtctcgaattcctgacctcaggtgatccacctgcctcggcctcccaaagtgctgggatgacaggcgtgagccaccacacccatttt

SEQ ID NO: 19129 - DNA, 601 bp, Human
aggagaaccgcggagggatgcggacccctctccttcgggcctgggccagggagagctggagagctagcggcgaccagcgctcggggtccatttctgagttgtttacttatgatttatacgtttataccttccgcgctccccaccgccaccccccaagtccctgcaccctcagccaaacacgcgcccaaatacaatccccagcctgtccccttggaataaaacggtgaagaagggaggccacgcgtccgccctgccagagccccccccccaagcccgttccgcccgcgcatgcactcccgayccccaaattagggaccgaaggggcaaggggcaccgcagccgggcgctgcgctgcgcgttcaggcagggcgcacgtgggcgctgcgctctctcctcctgtgacccttcacctccttccacgcagctccccgcttccccccatcccatccccaccactaagccagggcagggcgggggcgcccttgggaagcttgggctccgcgaccgaaccccgactccctggaagccccaaatccacgctgggcacccaagcgctgctcactccaaagtaagtggggagctgagtagggtgtctccagct

SEQ ID NO: 19130 - DNA, 601 bp, Human
tcccgggtcaccaggtccccaggcctctccaaggtcaccaggtccccaagcctctcctgggacaccaggtgtccaagcctctcccgggacaccaagtccccaagcctctcccgggacaccaggtccccaagcctctcccggctcaccagatctccaagcctctcccaggacaccaggtccccaagcctctcccaggacaccaggtccccaagcctctccccaggacaccaggtgtccaagcctcttccagagacaccaggtccccaagcctctcctgggacaccagatccccaaggctctytcaggacaccaggtccccaagcctctccaaggtcaccaggtccccaagcctctcccaggacaccaggtccccaaggctctcccgggacaccagatccccaaggccctcccgggtcaccaggtgtccaagcctcttccagagacaccaggtccccaagcctctcccagaacaccaggtccccaagcctctcccagaacaccaggtctccaagcctctccaaggtcaccaggtccccaagcctctccagggacaccaggtccccaagcctctcccaggacaacagatctccaagcctctccc

SEQ ID NO: 19131 - DNA, 601 bp, Human
gcgcccccggaaacccccaacgtgcctcttctcccctagggagcgtcgccccttctccagccgtggagaccaccccacacccgcctttcctccttccccctggcccagaattggcgctgccactggatgcatccgcgggagccgggccaggggaatccgaacagctccctgcaaagcgcatgggaggggggtccacaaatggaacgccctcagggggagctcccgatgcgctctcttcgcagggattcagggactttggctcacaacgttctctcccccaaccagcccccgtaacctctcacgagacaccaggtccccaagcctctccaagatcaccaggtccccaagcctctccaaggtcacctggtccccaaggctctcccgggacaccaggctcccaagcctctcccgggacaccaggtgtccaagcctctcccgggtcaccaggtccccaaggctctctcccgagacaccaggtcccccagcctctccccaggacaccaggtccccaaggctctcccgggtcaccaggtccccaagcctctcccgggacaccaggtgtccaagcctctcccgggtcaccaggtccccaaggctctct

SEQ ID NO: 19132 - DNA, 601 bp, Human
ccccgcgcccccggaaacccccaacgtgcctcttctcccctagggagcgtcgccccttctccagccgtggagaccaccccacacccgcctttcctccttccccctggcccagaattggcgctgccactggatgcatccgcgggagccgggccaggggaatccgaacagctccctgcaaagcgcatgggaggggggtccacaaatggaacgccctcagggggagctcccgatgcgctctcttcgcagggattcagggactttggctcacaacgttctctcccccaaccagcccccgtaaccgctcccgagacaccaggtccccaagcctctccaagatcaccaggtccccaagcctctccaaggtcacctggtccccaaggctctcccgggacaccaggctcccaagcctctcccgggacaccaggtgtccaagcctctcccgggtcaccaggtccccaaggctctctcccgagacaccaggtcccccagcctctccccaggacaccaggtccccaaggctctcccgggtcaccaggtccccaagcctctcccgggacaccaggtgtccaagcctctcccgggtcaccaggtccccaaggct

SEQ ID NO: 19133 - DNA, 601 bp, Human
agattctacagggaccaggtagatgtctttctactcacgtggagtgagctttttcttgggaggaaatgatgacacactgttatgtttcgatttttcaaaattactcagcctttttggttaaaaaaaaaaaaatctagggctgtacatatcttaccaaccacttttccaaagggttacatactctgatgaatgaacctacttcccaaagattcaaaatgcaattcttcttttcgataaaaatttcagcttaactattaaagcctctctctctcttttttttttttaatttccagcttttaaraaaaatggatgaatgaggcaaactctctaataccgttaatgtctgggattctttctctctctctccgtcattttacagcggttgtaacattttgacataaaaaatgttgaaggggacttttggtttgtataaagaatatcagaagatacaaatgagacgggtccaaatggatctacagttcagctcagtgacaagatagaaagtgttatgcggaagaaaaaaagaagttgtttttttttttcttttatccccacctcagggagaagtatctaaatcagaagttaggaaagaaaaccacca

SEQ ID NO: 19134 - DNA, 601 bp, Human
tctaaagagaaacgttcagattctacagggaccaggtagatgtctttctactcacgtggagtgagctttttcttgggaggaaatgatgacacactgttatgtttcgatttttcaaaattactcagcctttttggttaaaaaaaaaaaaatctagggctgtacatatcttaccaaccacttttccaaagggttacatactctgatgaatgaacctacttcccaaagattcaaaatgcaattcttcttttcgataaaaatttcagcttaactattaaagcctctctctctctttttttttttwaatttccagcttttaagaaaaatggatgaatgaggcaaactctctaataccgttaatgtctgggattctttctctctctctccgtcattttacagcggttgtaacattttgacataaaaaatgttgaaggggacttttggtttgtataaagaatatcagaagatacaaatgagacgggtccaaatggatctacagttcagctcagtgacaagatagaaagtgttatgcggaagaaaaaaagaagttgtttttttttttcttttatccccacctcagggagaagtatctaaatcagaagtt

SEQ ID NO: 19135 - DNA, 601 bp, Human
aaattccgtctctaaagagaaacgttcagattctacagggaccaggtagatgtctttctactcacgtggagtgagctttttcttgggaggaaatgatgacacactgttatgtttcgatttttcaaaattactcagcctttttggttaaaaaaaaaaaaatctagggctgtacatatcttaccaaccacttttccaaagggttacatactctgatgaatgaacctacttcccaaagattcaaaatgcaattcttcttttcgataaaaatttcagcttaactattaaagcctctctctctctyttttttttttaatttccagcttttaagaaaaatggatgaatgaggcaaactctctaataccgttaatgtctgggattctttctctctctctccgtcattttacagcggttgtaacattttgacataaaaaatgttgaaggggacttttggtttgtataaagaatatcagaagatacaaatgagacgggtccaaatggatctacagttcagctcagtgacaagatagaaagtgttatgcggaagaaaaaaagaagttgtttttttttttcttttatccccacctcagggagaagtatctaa

SEQ ID NO: 19136 - DNA, 601 bp, Human
tcaggagtttgaggccagccgggccaacacggcaaaaaactgtctccaccaaaaatgcaaaaaaattacccaggcctggtggcaggtgcctgtaatcccagctactcgggaggctgaaaccctgtctctactaaaactaccagaaagttacccaggcctggtggcaggtgcctgtaatcccagctactcaggaggccgaaaccctgtctgtactaaaaataccagaaagttacccaggcctggtggcaggtgcctgtaatcccagctactcgggaggccgaaaccctgtctctactaaaamtaccagaaagttacccaggcctggtggcaggtgcctgtaatcccagctactcgggaggctgaaaccctgtctctactaaaaataccagaaagttacccaggcctggtggcaggtgcctgtaatcccagctactcgggaggctgaaaccctgtctctactaaaaataccagaaagttacccaggcctggtggcaggtgcctgtaatcccagctactcgggaggctgaaaccctgtctctactaaaaataccagaaagttacccaggcctggtggcaggtgcctgtaatcccagctactcgg

SEQ ID NO: 19137 - DNA, 601 bp, Human
ggtgcctgtcatcccagctacttgggaggctgaggcaggagaatttcttgaagccaggaggtagaggatgcagtgagctgggattgcaccactgcactccagcctgggtgacagagtgagacttcatcgaagaaagaaagaagaaagaaaaagaaagaaagaaaaagaaagaaagaaacaaaaaaggaaaagagaaagaaaaagagagaaagataaaaaggaaagaaacagaaagaaagaaaagaaagaaagagagaaagaaagaaaaagaaagaaaggaaggaaggaaggaaggaaggagaagggagagagaagagggcgttggtggtgagaactggtcacagcccaagctgaatttcttacttccttccatccgagagtttcagggagaaagaagcagctagcatacacgtaccccacactcattcagggatcactcatccacctacagaaagtcacccaacttctctcgcaggagaaaagccaaaggcagccagtgtccacagacactcgtgtcccaccctcacagttctctgcgtttgatctgcttcggggacccatttgtgaggatgacacttggccctctttccatattaaatca

SEQ ID NO: 19138 - DNA, 601 bp, Human
caaaaattatccgggaatggtggtgggtgcctgtcatcccagctacttgggaggctgaggcaggagaatttcttgaagccaggaggtagaggatgcagtgagctgggattgcaccactgcactccagcctgggtgacagagtgagacttcatcgaagaaagaaagaagaaagaaaaagaaagaaagaaaaagaaagaaagaaacaaaaaaggaaaagagaaagaaaaagagagaaagataaaaaggaaagaaacagaaagaaagaaaagaaagaaagagagaaagaaagaaaaagaaagaaaggaaggaaggaaggaaggaaggagaagggagagagaagagggcgttggtggtgagaactggtcacagcccaagctgaatttcttacttccttccatccgagagtttcagggagaaagaagcagctagcatacacgtaccccacactcattcagggatcactcatccacctacagaaagtcacccaacttctctcgcaggagaaaagccaaaggcagccagtgtccacagacactcgtgtcccaccctcacagttctctgcgtttgatctgcttcggggacccatttgtgaggatgacac

SEQ ID NO: 19139 - DNA, 601 bp, Human
acaaaaattatccgggaatggtggtgggtgcctgtcatcccagctacttgggaggctgaggcaggagaatttcttgaagccaggaggtagaggatgcagtgagctgggattgcaccactgcactccagcctgggtgacagagtgagacttcatcgaagaaagaaagaagaaagaaaaagaaagaaagaaaaagaaagaaagaaacaaaaaaggaaaagagaaagaaaaagagagaaagataaaaaggaaagaaacagaaagaaagaaaagaaagaaagagagaaagaaagaaaaagaaagraaggaaggaaggaaggaaggaaggagaagggagagagaagagggcgttggtggtgagaactggtcacagcccaagctgaatttcttacttccttccatccgagagtttcagggagaaagaagcagctagcatacacgtaccccacactcattcagggatcactcatccacctacagaaagtcacccaacttctctcgcaggagaaaagccaaaggcagccagtgtccacagacactcgtgtcccaccctcacagttctctgcgtttgatctgcttcggggacccatttgtgaggatgaca

SEQ ID NO: 19140 - DNA, 601 bp, Human
tcgccagcgtacacccaccccataaattcaatttctcacctcctgtggagagacgtatgttgtttccatgctgaatgttcacgcaaacgtgtctctggagggccttccgggaaaccaaacccacgcacatcacatacagagggtccccatcagcccagtccttcctaaacatctcagaaaaagagagaggaggccgggcgcggtgcctcaccccgtaatcccagcactctgggaggctgaggcgggtggatcatgtgaggtcaggagttcaagaccagcctggccaacatggcgaaacccrgtctctactaaaaaatacaaaaattatccgggaatggtggtgggtgcctgtcatcccagctacttgggaggctgaggcaggagaatttcttgaagccaggaggtagaggatgcagtgagctgggattgcaccactgcactccagcctgggtgacagagtgagacttcatcgaagaaagaaagaagaaagaaaaagaaagaaagaaaaagaaagaaagaaacaaaaaaggaaaagagaaagaaaaagagagaaagataaaaaggaaagaaacagaaagaaagaaaagaaagaaagagagaa

SEQ ID NO: 19141 - DNA, 601 bp, Human
ccacagggaaagcaggaacgtgactttcaaaagaaccttgttttgagcaaaaagcaccaagaatcgccagcgtacacccaccccataaattcaatttctcacctcctgtggagagacgtatgttgtttccatgctgaatgttcacgcaaacgtgtctctggagggccttccgggaaaccaaacccacgcacatcacatacagagggtccccatcagcccagtccttcctaaacatctcagaaaaagagagaggaggccgggcgcggtgcctcaccccgtaatcccagcactctgggaggcygaggcgggtggatcatgtgaggtcaggagttcaagaccagcctggccaacatggcgaaacccagtctctactaaaaaatacaaaaattatccgggaatggtggtgggtgcctgtcatcccagctacttgggaggctgaggcaggagaatttcttgaagccaggaggtagaggatgcagtgagctgggattgcaccactgcactccagcctgggtgacagagtgagacttcatcgaagaaagaaagaagaaagaaaaagaaagaaagaaaaagaaagaaagaaacaaaaaaggaaaagaga

SEQ ID NO: 19142 - DNA, 601 bp, Human
cttctccctgtgggtgcttcgcagtcagagagagagaaaagagagagaaaagtggatatgtcagaaacagatttcaccagaacagccactcaaaggaagaagtgttttttgctcaactgcggcgactgacaaccctccacggactatttggccaagttttggggagaggagggaagaaaatacgtatcaatcaggacccaacccagcatcgttcagttcggccagcaacgtgttcctatcagtgtgctggagctggtacggatctcacacaccaaatcctctctctgcaacggcgttacawcggaacacagcccacgttgctctctgggtggtattccttgctctgcgagcgagctcaccgggaagccacagggaaagcaggaacgtgactttcaaaagaaccttgttttgagcaaaaagcaccaagaatcgccagcgtacacccaccccataaattcaatttctcacctcctgtggagagacgtatgttgtttccatgctgaatgttcacgcaaacgtgtctctggagggccttccgggaaaccaaacccacgcacatcacatacagagggtccccatcagcccagtccttcctaaacat

SEQ ID NO: 19143 - DNA, 601 bp, Human
ggagctggaggcttctgcttgttcttaggggaaaacaaatgttagaaaggtcagcatgaaacccagaggcgaggacagaggactctggtatttccctttcatcctgaccagagcttggcaccaaaacctgaaacccgtctcggcttcatttcggttaaacgcccagctgtccccagactctgcggtatccacagatgctcccacgtgctgacgtggccaaggacagcagcaagaccagaacagaaactcaggcttccaaggaaatgggaccatttcgggggcctggctggactttggcggratggagaggccattcctacgacagggcgtctttggagcggcccaaaggcctccttcccgtacgggagacaccaagcccgtcgcaccaccagctttgtaagtggaaaaacgggtgttggacgcggtcagttacgctctaaatcgtacagaggcacagaatctgtcccatctctttatccacggcgctggagaagacagccacagccaaggggccctgtcaccactgcctgtgaaacaacaccccaacggccaccagagaaggtgcatttttctaactcttggcaattgccaggaacacacc

SEQ ID NO: 19144 - DNA, 601 bp, Human
gggagctggaggcttctgcttgttcttaggggaaaacaaatgttagaaaggtcagcatgaaacccagaggcgaggacagaggactctggtatttccctttcatcctgaccagagcttggcaccaaaacctgaaacccgtctcggcttcatttcggttaaacgcccagctgtccccagactctgcggtatccacagatgctcccacgtgctgacgtggccaaggacagcagcaagaccagaacagaaactcaggcttccaaggaaatgggaccatttcgggggcctggctggactttggcgsgatggagaggccattcctacgacagggcgtctttggagcggcccaaaggcctccttcccgtacgggagacaccaagcccgtcgcaccaccagctttgtaagtggaaaaacgggtgttggacgcggtcagttacgctctaaatcgtacagaggcacagaatctgtcccatctctttatccacggcgctggagaagacagccacagccaaggggccctgtcaccactgcctgtgaaacaacaccccaacggccaccagagaaggtgcatttttctaactcttggcaattgccaggaacacac

SEQ ID NO: 19145 - DNA, 601 bp, Human
gaaaactgtggagctaaagggagctggaggcttctgcttgttcttaggggaaaacaaatgttagaaaggtcagcatgaaacccagaggcgaggacagaggactctggtatttccctttcatcctgaccagagcttggcaccaaaacctgaaacccgtctcggcttcatttcggttaaacgcccagctgtccccagactctgcggtatccacagatgctcccacgtgctgacgtggccaaggacagcagcaagaccagaacagaaactcaggcttccaaggaaatgggaccatttcgggggyctggctggactttggcgggatggagaggccattcctacgacagggcgtctttggagcggcccaaaggcctccttcccgtacgggagacaccaagcccgtcgcaccaccagctttgtaagtggaaaaacgggtgttggacgcggtcagttacgctctaaatcgtacagaggcacagaatctgtcccatctctttatccacggcgctggagaagacagccacagccaaggggccctgtcaccactgcctgtgaaacaacaccccaacggccaccagagaaggtgcatttttctaactcttgg

SEQ ID NO: 19146 - DNA, 601 bp, Human
catatactcgctaagctaattctctttaataaattaggcaccagttttttttttttttttttttttttttttaatgtcaaacgtgtccaccgaaagcctctctcctccccagacctcccaaagctggaggagacaagcggcttccagcaaagtgcctccgaaatgtgtgtcgtgggagtggctgccgtgtgccatcctcgctatgtccccgggaaaactgtggagctaaagggagctggaggcttctgcttgttcttaggggaaaacaaatgttagaaaggtcagcatgaaacccagaggygaggacagaggactctggtatttccctttcatcctgaccagagcttggcaccaaaacctgaaacccgtctcggcttcatttcggttaaacgcccagctgtccccagactctgcggtatccacagatgctcccacgtgctgacgtggccaaggacagcagcaagaccagaacagaaactcaggcttccaaggaaatgggaccatttcgggggcctggctggactttggcgggatggagaggccattcctacgacagggcgtctttggagcggcccaaaggcctccttcccgtacgggagac

SEQ ID NO: 19147 - DNA, 601 bp, Human
taaataacaaatgcacatacatcacaaagtaagaagcaggggcttttgcctccttcccacgggacctgcacgtacaatgggctgaactcgtgaagccacatcccctttcaataaatagcacatttcatagctttgaaacgggatattgtctacattccttaaccggcttctcattaaatatcaaatttcaataaaacatttataaatggcatcaacttacccacgtgtgtcgaagaatatcagcatatactcgctaagctaattctctttaataaattaggcaccagtttttttttttttkttttttttttttttaatgtcaaacgtgtccaccgaaagcctctctcctccccagacctcccaaagctggaggagacaagcggcttccagcaaagtgcctccgaaatgtgtgtcgtgggagtggctgccgtgtgccatcctcgctatgtccccgggaaaactgtggagctaaagggagctggaggcttctgcttgttcttaggggaaaacaaatgttagaaaggtcagcatgaaacccagaggcgaggacagaggactctggtatttccctttcatcctgaccagagcttggcaccaaaac

SEQ ID NO: 19148 - DNA, 601 bp, Human
gattactctgtaggaagtggagaaaacgttttctgtttattttgtagtaaggtaagcataattttaaaaaagctgctataggctttttcccccacttttaatgccagtagaggtgaagcaaatttacaaattcttccttaggttttataccaggaaaatgtttgcccaaagaactggctatatttgatggagttgaccactgtctcactacaggttctaatgtttgacaaacagttttattttatgattgcacccagagctcctcatcattacaaagaaagtgtattttgctttttttttyctgctaccaacaggataaacctcctcagctgcagcttgtggtttggaaaagattacttttttaaaaaagctttgaatcttttcctagagatcaacagcaattatgcaactccctgttaactgagttagatttaaaaacacaaacacaaaatataaatcccccaattccaatagctaagcagctgtgctagaaggcacgggaatgcatttattctctcctgtttgattccttagtcatactttagatgcgtggcaaatcagttggacattcagaatgccataggcttctggaaggattact

SEQ ID NO: 19149 - DNA, 601 bp, Human
ggatgaagacaccggatatttgcctgtgtctggggagagagcagacacaaaggagataggatgtttctgtgtcctctcaactatgggttttggccacaagcagattcacctgaaaagtcaccatctcttctccctgatgctttttgtgcatgtgatgtccatggcacagctgcaacttaggtgaaaatatatgtgcaccaatcagattcacaaactccaggctgggagtggtcagagaaggagctgaaatagtacttgctggattccaatgatcaaggactattgtctattttttttttgkttttcaaagtcactagagattgcaaaatgcggtggctttccaggttcataagagatgacagagtgagagagaaatgttttggtttcttctcccaagaaccataaccaagagagttaaaaccaggtggaatggttttgctggcattgtgtggcattagctcaattagtgtagctgcctgttaacataaacagtcatgtcttcatgccattgctggagttcaagtggagatggagaaggtaaaattctaagtgtacacaactggaaatataaatgttagataggattgtatctaagtaaatt

SEQ ID NO: 19150 - DNA, 601 bp, Human
ccttcctctcttctttcagtgttctctttttttttattttattttaaaaaatatattagaatggatttaaagttgtccctataataaaatcactttttttttctgtgcatccaatatttttttctagagtgtggtgggaatctggtggggaagtgaggaggatttattaactgggttccagtgaagagaagtctgagaatttttgttttaaaatgtgagaaaatgtttaagaaggaagtctttttctgtctttgtttttttttcaaagatccttgcaaaacctttaattctgaatattgckaagacaatctatgacgttgtatcataattttgagtttggtgagagcagtttcttaaggatcgtgatgagggacaaaagagggtttggagaaggaaaggtttagacttgtgagcagcactgacgaagagaccttgcagatgaacagacgaataggtagctggaagttgatgctatttgaatgaatgtaagaacaaaatcaaaccactcaaaatgagatttaaaacaattcacagataacgaattttaagaaataatataggagcctaaattagcaaaagaaaatattatcttacacgaaaa

SEQ ID NO: 19151 - DNA, 601 bp, Human
cgctgggtgtgccatccttcaaacattcaatcaaagaacagcaaacacatttaaagcagctgacaccaccaaggctgcatgtgtctgaccatgctgagatggaatgggcctccctgggcccctggaatagaatgcatgtccgagggaggaggcctcgctgtgttgccataaagcagaaaaattactgcccaagtgaccctagcttgggacaagaagcggaagctgacttaaaaatcaaaagaaagcatgcaagcggcagggtagacataaattcttagcactgagtaagttattggcaatytggcaaatgtgtgttcagaagaactagtgtctggtatcatccctgctcagagtgtttgcattttaataagagggtctggctgagtaggctatctacatggagacattaatgccaaatgatgctatctctagtactaggacagtgggtcaaagaaagatttttggggagtgagtcttccgggtcctcttcaaagggatctgtacacagcgtacattctctgcctttaaagcctgagctctaaagccacacactgtctgggctgaaagcaggcggtgccacttagtgtgttaatttgagtaa

SEQ ID NO: 19152 - DNA, 601 bp, Human
ctggtctgagagcctagcagggggtaagcagagagtttgagggtaacagtcaacagtcttacagatggatgacttacctatgttatcatagggaattacgatgctcccagagtcgacccacattttggtatagataaggaggcacagcggcatcattccgagggcaagcagtgtggagcatgtggtcatgctgacgctgaaaggcaatgggcagattgatacatccacctgtggtgttctagggaagatgctgttttatttttattttttaatttaacttttattttaagtttaggggtayatgtgcatgtttgttatataggtcaacttgtgtcatgggggtttgttgtacagattatttcattgcctaggtattaagcctagtacccattagttatgtttcctgatcctctctttcctcccaccctccaccctctaataggccccagtgtctgtgttcccctctatgtgtccatgcgttctcatcatttagctcccacttataagtgagaacatgcagtatttggttttctgtccttgtgttactttgctaaggataatggcctccagctccatccatgttcctgcaaaagacttgatc

SEQ ID NO: 19153 - DNA, 601 bp, Human
ttcaggctgggcgtggtggctcatgcatgttatcccactttgggaggctgaggccggcagatcacttgaggtcaggagtttgagaccagcctgaccaacatggagaaaccccgtccctattaaaaatacaaaaattagccaggcgtggtagtgcatgcttgtaattccagctactagggaggctgaggcaggagaattgcttgaacccagggggtgaaatttgcagtgagccgagatcacgcccctgcactccaggctgggtggcagagtgagactccatctcaaaaaaaaaaaaaatttmttcaattcaagtgtctggatgcaaaatcctatgaccattaactagtgacactctgggttaaggaataggtgcaagctcccatgtccccaaagcttaagcctcctcagtccagactgagggctggggagggggctcctttccctggtgattcaaattgaagaaaagacaggttctcccataaggtcaaggtttggaatttacattctgccatcactctccaaacgcaggggtgactttataatgaaatcaggcaaaaactcctactagggcaataacggtcaggtgtgagcctggtctgag

SEQ ID NO: 19154 - DNA, 601 bp, Human
tttcttcaggctgggcgtggtggctcatgcatgttatcccactttgggaggctgaggccggcagatcacttgaggtcaggagtttgagaccagcctgaccaacatggagaaaccccgtccctattaaaaatacaaaaattagccaggcgtggtagtgcatgcttgtaattccagctactagggaggctgaggcaggagaattgcttgaacccagggggtgaaatttgcagtgagccgagatcacgcccctgcactccaggctgggtggcagagtgagactccatctcaaaaaaaaaaaaartttcttcaattcaagtgtctggatgcaaaatcctatgaccattaactagtgacactctgggttaaggaataggtgcaagctcccatgtccccaaagcttaagcctcctcagtccagactgagggctggggagggggctcctttccctggtgattcaaattgaagaaaagacaggttctcccataaggtcaaggtttggaatttacattctgccatcactctccaaacgcaggggtgactttataatgaaatcaggcaaaaactcctactagggcaataacggtcaggtgtgagcctggtc

SEQ ID NO: 19155 - DNA, 601 bp, Human
cccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaaacccacacctttctgaggcagctcattgggatttttttccaaggtcagtggggaaaaaaacccaggtatttggggcatatagtgtacctggtgattgttactgatttacwattttgcccacatcttgtcttttgttcgtgatagttctgtgggaaatgcctattcctggtataccaggaactctcttgttcttcctttgaccctcatccctaagttacaacaataacttaatctcccactataatttgtttccccagaaacagaaaataaggtttttgggatgagggtgaaatgagacagagtcattactagtaaatttgactcctggagcatgactttgccattaaatcaacttttgggtcaaggtgtggctcacagtcgagtgttagaaacagtgtgtttcgtctagc

SEQ ID NO: 19156 - DNA, 601 bp, Human
caaacattgtaatacagatcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaaacccacacctttctgaggcagctcattgggatttttttccaaggtcagtggggaaaaaaacccaggtatttggggcatatagtgtamctggtgattgttactgatttactattttgcccacatcttgtcttttgttcgtgatagttctgtgggaaatgcctattcctggtataccaggaactctcttgttcttcctttgaccctcatccctaagttacaacaataacttaatctcccactataatttgtttccccagaaacagaaaataaggtttttgggatgagggtgaaatgagacagagtcattactagtaaatttgactcctggagcatgactttgccattaaatcaacttttgggtcaaggtgtggctcacagtcgagtgtt

SEQ ID NO: 19157 - DNA, 601 bp, Human
gggatataatggtcaccactcacgtaaactatggtttttagctctatggaaggcgtccgctgacagagcagccagagagtcaagcagcatgaaggcaaaagcaggtggtagtggagggtcaccctaaagtctcttgtcaggaggttatatatgatattaaggttctctcctggagtctgaagaatcttgtatatcaaaagcccatactgaatagggcatgtcaaggaggacaattttttttttggtctaatggtaatggtaagagtaggagagagagaagaggctacaaacattgtaatamagatcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaaacccacacctttctgaggcagctcattgggatttttttccaaggtcagtggggaaaaaaacccaggtatttggggcatatagtgtacctggtgattgttac

SEQ ID NO: 19158 - DNA, 601 bp, Human
tgtatatcaaaaggagaatattttatggcttaaattattaaattattacagtgagtattgtggaatcaaaattcctcactcagcagacaggttctttgagagggatataatggtcaccactcacgtaaactatggtttttagctctatggaaggcgtccgctgacagagcagccagagagtcaagcagcatgaaggcaaaagcaggtggtagtggagggtcaccctaaagtctcttgtcaggaggttatatatgatattaaggttctctcctggagtctgaagaatcttgtatatcaaaarcccatactgaatagggcatgtcaaggaggacaattttttttttggtctaatggtaatggtaagagtaggagagagagaagaggctacaaacattgtaatacagatcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttcttcaatgggaa

SEQ ID NO: 19159 - DNA, 601 bp, Human
agaagggaatgtatatcaaaaggagaatattttatggcttaaattattaaattattacagtgagtattgtggaatcaaaattcctcactcagcagacaggttctttgagagggatataatggtcaccactcacgtaaactatggtttttagctctatggaaggcgtccgctgacagagcagccagagagtcaagcagcatgaaggcaaaagcaggtggtagtggagggtcaccctaaagtctcttgtcaggaggttatatatgatattaaggttctctcctggagtctgaagaatcttgtrtatcaaaagcccatactgaatagggcatgtcaaggaggacaattttttttttggtctaatggtaatggtaagagtaggagagagagaagaggctacaaacattgtaatacagatcatccccaattagtattcacaaagtttattctaattcagttgtatattccctcaatcaccctaaatcacagaagcagtctttctcagaaatggaaggcatttcagcccagcttcctatcccaataggagtcccttttacaagcatccaggtggcttatcatttagcctttgcttggatgctttctt

SEQ ID NO: 19160 - DNA, 601 bp, Human
ttcttttcttttcactcttgacctcttatgatgaccttttcctccattgaagtgctaattgatttttcattttctccttatttcaaaatttattcacatcacagaatatggtataagtcattcacactgcagttagaattattcagtatttccatgagtcatttctcagaagggaatgtatatcaaaaggagaatattttatggcttaaattattaaattattacagtgagtattgtggaatcaaaattcctcactcagcagacaggttctttgagagggatataatggtcaccactcacrtaaactatggtttttagctctatggaaggcgtccgctgacagagcagccagagagtcaagcagcatgaaggcaaaagcaggtggtagtggagggtcaccctaaagtctcttgtcaggaggttatatatgatattaaggttctctcctggagtctgaagaatcttgtatatcaaaagcccatactgaatagggcatgtcaaggaggacaattttttttttggtctaatggtaatggtaagagtaggagagagagaagaggctacaaacattgtaatacagatcatccccaattagtattca

SEQ ID NO: 19161 - DNA, 601 bp, Human
gtccttgtactttaaccaagatatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcaggttttagcttagattgtgatgtctggctccagccaatggagacaggacacagtagcagggacaagctgcataagggatacgaattacttccctccattgttcaggtgtgcygtcaccattgtgccatctgtgaggagcactctttctgcagaaagtaaaattgccttgctgagaaaactttttgtctgaatgctcatttttccttgtggtactgaggaacaagtattctgtttctgaataaatattttacatataacaatatctttgtttttcaaacttctctctttttccgttttcttttctcttttcctatttttcttttcttttcactcttgacctcttatgatgaccttttcctccattgaagtgctaattgatttttcattttctccttatttcaaaatttattca

SEQ ID NO: 19162 - DNA, 601 bp, Human
taaaggaaaataataataataataaacattagaaataataatttcttttaaagactaactttcttcaagcccccttactttgtgctagtaactctttgttaagccctattctatgtagctgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctattgccyatacctatttagaaaagttttaaattattagccagtcaggttttagcttagattgtgatgtctggctccagccaatggagacaggacacagtagcagggacaagctgcataagggatacgaattacttccctccattgttcaggtgtgctgtcaccattgtgccatctgtgaggagcactctttctgcagaaagtaaaattgccttgctgagaaaactttttgtctgaatgctcatttttccttgtggtactgaggaacaagtattctgtttctgaataaatattttacatataacaata

SEQ ID NO: 19163 - DNA, 601 bp, Human
attttctatgttaaagaactagaaaaaccaacagcaaaaaggtgagcttggaggcctgggcaaacatggtgagcagggttaatatctgtagaaagtaaaaagtttcctcttcaaagtgtcccttgttgttaaaggaaaataataataataataaacattagaaataataatttcttttaaagactaactttcttcaagcccccttactttgtgctagtaactctttgttaagccctattctatgtagctgttagatataaaggaataagtacattctatgtccttgtactttaaccaagayatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcaggttttagcttagattgtgatgtctggctccagccaatggagacaggacacagtagcagggacaagctgcataagggatacgaattacttccctccattgttcaggtgtgctgtcaccattgtgccatctgtg

SEQ ID NO: 19164 - DNA, 601 bp, Human
agccacaatttagaaagcagtgataacatcttgtgaagcagtcagttcatttattttctatgttaaagaactagaaaaaccaacagcaaaaaggtgagcttggaggcctgggcaaacatggtgagcagggttaatatctgtagaaagtaaaaagtttcctcttcaaagtgtcccttgttgttaaaggaaaataataataataataaacattagaaataataatttcttttaaagactaactttcttcaagcccccttactttgtgctagtaactctttgttaagccctattctatgtagckgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcaggttttagcttagattgtgatgtctggctccagccaatggagacaggacacagtagcagggacaagctgcataagggatac

SEQ ID NO: 19165 - DNA, 601 bp, Human
gagaatagactgtgggctattccagcttcctggtgaccttgggcaaataatcaccctgagccacaatttagaaagcagtgataacatcttgtgaagcagtcagttcatttattttctatgttaaagaactagaaaaaccaacagcaaaaaggtgagcttggaggcctgggcaaacatggtgagcagggttaatatctgtagaaagtaaaaagtttcctcttcaaagtgtcccttgttgttaaaggaaaataataataataataaacattagaaataataatttcttttaaagactaacttycttcaagcccccttactttgtgctagtaactctttgttaagccctattctatgtagctgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcaggttttagcttagattgtgatgt

SEQ ID NO: 19166 - DNA, 601 bp, Human
cgtctgcccatagagctgtgtagagaatagactgtgggctattccagcttcctggtgaccttgggcaaataatcaccctgagccacaatttagaaagcagtgataacatcttgtgaagcagtcagttcatttattttctatgttaaagaactagaaaaaccaacagcaaaaaggtgagcttggaggcctgggcaaacatggtgagcagggttaatatctgtagaaagtaaaaagtttcctcttcaaagtgtcccttgttgttaaaggaaaataataataataataaacattagaaataatmatttcttttaaagactaactttcttcaagcccccttactttgtgctagtaactctttgttaagccctattctatgtagctgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctattgcctatacctatttagaaaagttttaaattattagccagtcag

SEQ ID NO: 19167 - DNA, 601 bp, Human
acaggtgtttactgaatcactggagcatgaagttgtaccaaacacgtctgcccatagagctgtgtagagaatagactgtgggctattccagcttcctggtgaccttgggcaaataatcaccctgagccacaatttagaaagcagtgataacatcttgtgaagcagtcagttcatttattttctatgttaaagaactagaaaaaccaacagcaaaaaggtgagcttggaggcctgggcaaacatggtgagcagggttaatatctgtagaaagtaaaaagtttcctcttcaaagtgtcccttsttgttaaaggaaaataataataataataaacattagaaataataatttcttttaaagactaactttcttcaagcccccttactttgtgctagtaactctttgttaagccctattctatgtagctgttagatataaaggaataagtacattctatgtccttgtactttaaccaagatatttatgctgaacatgctcacaggtacattccagcttgcagcctatgccccttccttatttggaaatattattacttttctaagtcctttcacaagcaacgtcctcttttcctttgttgtctat

SEQ ID NO: 19168 - DNA, 601 bp, Human
aacgggataacacataagcagcaccacctgctgaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcctgtctatgtagatgaaaaagcawccactcatggttacacattgaatccataacttggtctttaatcaagtttacacagtagatatcagaggaaagaaaggtagaaagaagaatgagaatgaaagagagtggtggtgaatggattcatgtggtgggactgggagccagatagatttggaactgaacctttctgtattcccaaactgtgggaactgtgcaaatcattgaacccctctgagcttttgtttcctcatttgtaaaatgggtggagttatgtctgccttacagtgctgttgtgagaattaaatgatgaaatggctataa

SEQ ID NO: 19169 - DNA, 601 bp, Human
ctgtttggcccctcctgctaagagtattcatctttttgaggcagcccaagccaacgggataacacataagcagcaccacctgctgaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctyatatgcccatgttctctctgtaaagtgcctgtctatgtagatgaaaaagcatccactcatggttacacattgaatccataacttggtctttaatcaagtttacacagtagatatcagaggaaagaaaggtagaaagaagaatgagaatgaaagagagtggtggtgaatggattcatgtggtgggactgggagccagatagatttggaactgaacctttctgtattcccaaactgtgggaactgtgcaaatcattgaacccctctgagcttttgtttcctcatttgtaaaatgggtggagt

SEQ ID NO: 19170 - DNA, 601 bp, Human
aggtcttaaaaccatctggatatatgacttgtttgtgatgtggtagcttaaatctagctgcaagtcctgtgcttggaatgttagtgtggttaggttttggtcctatattttaatgtgctgaatctgtttggcccctcctgctaagagtattcatctttttgaggcagcccaagccaacgggataacacataagcagcaccacctgctgaaatccatggcagaattgcttttctttcctgaccagatgaggccagatgaagtttttcagggacctggggttgactgggaaagggactctgtytttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcctgtctatgtagatgaaaaagcatccactcatggttacacattgaatccataacttggtctttaatcaagtttacacagtagatatcagaggaaagaaaggtagaaagaagaatgagaatgaaagagagtggtggtgaatggattcatg

SEQ ID NO: 19171 - DNA, 601 bp, Human
gtaattctttatagcaatgagagaacagatgaatacaagaaggaaactccctctcctgggtctttagaccattgcctaagtttttgaagtttgtaggtcttaaaaccatctggatatatgacttgtttgtgatgtggtagcttaaatctagctgcaagtcctgtgcttggaatgttagtgtggttaggttttggtcctatattttaatgtgctgaatctgtttggcccctcctgctaagagtattcatctttttgaggcagcccaagccaacgggataacacataagcagcaccacctgcygaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcctgtctatgtagatgaaaaagcatccactcatggttacacattgaatccataact

SEQ ID NO: 19172 - DNA, 601 bp, Human
ttctttataaattatccagtctcaggtaattctttatagcaatgagagaacagatgaatacaagaaggaaactccctctcctgggtctttagaccattgcctaagtttttgaagtttgtaggtcttaaaaccatctggatatatgacttgtttgtgatgtggtagcttaaatctagctgcaagtcctgtgcttggaatgttagtgtggttaggttttggtcctatattttaatgtgctgaatctgtttggcccctcctgctaagagtattcatctttttgaggcagcccaagccaacgggwtaacacataagcagcaccacctgctgaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcctgtctatgtagatgaaaaagcatccactc

SEQ ID NO: 19173 - DNA, 601 bp, Human
tgtggaactgtgagccaactaaacttcttttctttataaattatccagtctcaggtaattctttatagcaatgagagaacagatgaatacaagaaggaaactccctctcctgggtctttagaccattgcctaagtttttgaagtttgtaggtcttaaaaccatctggatatatgacttgtttgtgatgtggtagcttaaatctagctgcaagtcctgtgcttggaatgttagtgtggttaggttttggtcctatattttaatgtgctgaatctgtttggcccctcctgctaagagtattcrtctttttgaggcagcccaagccaacgggataacacataagcagcaccacctgctgaaatccatggcagaattgcttttctttcctgaccagatgaggccagatgaagtttttcagggacctggggttgactgggaaagggactctgtctttctttacacccacagtgtgtggcttctgcttgtagaggtggatgttgtaactttggtctccagtgggctggtgatcttgctcttttctttccccatgctctgtttgttttacgtatgcctcatatgcccatgttctctctgtaaagtgcc

SEQ ID NO: 19174 - DNA, 601 bp, Human
agtggatgttgcttagtattgattaactaggtagattgaactaggactagaaaacagattctggaatccaaggctatagatattaatttaaagtgaatgcaataatgatgaaaacataatttccttgtagtcttctagccctcctggcaatataagggtcagtgatgacttttgcccagaaattacttagcagaattaaataatgactaagggtactaagagtaggaaaaaaaaagataaatgagggggagtaaggagggaataatggaaaaaaagatgtgaaagagtggcgttgacacaygtactgctgagatgccccagaaaaaccccccttgggtatccttgcatcctgctgttttgggagtgatatggtttggctctctgtccccacccatatctcatgttgaattataatccccagttggaggattacaactaaaggacgggtctgttggaggaggggcctggtgggaggtgattgaattgtggggggcagacttcccccttgttgttcttgtgatagtgagttctcatgtgatctggttgtctataagtgtgcacacctccttctttgctctcttcctctgctccagccatgtag

SEQ ID NO: 19175 - DNA, 601 bp, Human
tcataggttgtttctttttcaaacatccttttaaagcagtataagaaagtgatattgaacggtgaaattctgagagtggatgttgcttagtattgattaactaggtagattgaactaggactagaaaacagattctggaatccaaggctatagatattaatttaaagtgaatgcaataatgatgaaaacataatttccttgtagtcttctagccctcctggcaatataagggtcagtgatgacttttgcccagaaattacttagcagaattaaataatgactaagggtactaagagtaggaaaaaaaaagataaatgagggggagtaaggagggaataatggaaaaaaagatgtgaaagagtggcgttgacacacgtactgctgagatgccccagaaaaaccccccttgggtatccttgcatcctgctgttttgggagtgatatggtttggctctctgtccccacccatatctcatgttgaattataatccccagttggaggattacaactaaaggacgggtctgttggaggaggggcctggtgggaggtgattgaattgtggggggcagacttcccccttgttgttcttgtgatagtgag

SEQ ID NO: 19176 - DNA, 601 bp, Human
gtccaaaattagctcaagatcaccaggtattctgacatctgacttttggttaaaactagctttagctattcaaatttacagcagagaggtgagaacaaaagttgagaaagcgtgctttaaattttccatgagataatatatttgacgaactctcatgtaattatagttctttgcagtaacatgctcacctggccagataaaagagtcatacttcaatttcaccatgttaaatttactgctgtttttgcgacatgtggtttgtttctccatgttatttaacactcatttgtccaatagctgwtttcatataatttagcaccaacaacttctaacttttcataggttgtttctttttcaaacatccttttaaagcagtataagaaagtgatattgaacggtgaaattctgagagtggatgttgcttagtattgattaactaggtagattgaactaggactagaaaacagattctggaatccaaggctatagatattaatttaaagtgaatgcaataatgatgaaaacataatttccttgtagtcttctagccctcctggcaatataagggtcagtgatgacttttgcccagaaattacttagc

SEQ ID NO: 19177 - DNA, 601 bp, Human
atgaaagaaaatgtccaaaattagctcaagatcaccaggtattctgacatctgacttttggttaaaactagctttagctattcaaatttacagcagagaggtgagaacaaaagttgagaaagcgtgctttaaattttccatgagataatatatttgacgaactctcatgtaattatagttctttgcagtaacatgctcacctggccagataaaagagtcatacttcaatttcaccatgttaaatttactgctgtttttgcgacatgtggtttgtttctccatgttatttaacactcatttktccaatagctgatttcatataatttagcaccaacaacttctaacttttcataggttgtttctttttcaaacatccttttaaagcagtataagaaagtgatattgaacggtgaaattctgagagtggatgttgcttagtattgattaactaggtagattgaactaggactagaaaacagattctggaatccaaggctatagatattaatttaaagtgaatgcaataatgatgaaaacataatttccttgtagtcttctagccctcctggcaatataagggtcagtgatgacttttgcccag

SEQ ID NO: 19178 - DNA, 601 bp, Human
gtacctaaagatgacagaagggcaatgtgatcagcagaacaggtgacacaggaaagagaaaaacagaagaacaagcagcctgaagaaagattaggtggtatttcagtcttccttcttgaatacacaaaacagaatacagaattacacacacacacatgcacacacacactcactcaacttcttcacccactccagtaaataatttaatattattggtagataattgataatatcaatgctgtaaattctttcactaaattctgcattaattttttagagtttcttattttgccagcatacrttagttttaatttgtcagaatcttggcttctttagtctttggatctttatatctctaggaaaaatagctcaccaaggtgtgtgtgtgtgtgtgtgtgtgtgtgtgtgtgtgtgtgtgtgtatggcatacaaagatgacattttacatttgtctgctagttcatggtagtagaaataaaaaataattttaaaatattttaaaatgaaagaaaatgtccaaaattagctcaagatcaccaggtattctgacatctgacttttggttaaaactagctttagctattcaaatttacagcagaga

SEQ ID NO: 19179 - DNA, 601 bp, Human
ccatttagatatattgtataacacaaactcacataacagagataacagtaatatgccctgaggacagaatagagtaaaaccaagaggtgatagttcagtggagtgtcttaaagaatgggtagaaatttttcctgtgactgcaataaagaagggcatgctaggctgggcgcagtgtctcatacctgtaatcccagcactttggaaggatcacttgagcacaggagttcaagaacagcattagcaacatagtgagatcccacctctctctctctacacacatataaagaaggacattctaaargagaagactgcatggctaatgacttcaggcccccactcaacagtaatcatataatgagaatgaaaccatttcatggatggaaaaccctatggttttgattgtcacagtggaatatttaatggtgtgaactgggatacttactttaagtatgatctttgctttttggggccatttgtgattaacaaacattccaatggaaacaggaacaacgagagcaaccagagatgtacctaaagatgacagaagggcaatgtgatcagcagaacaggtgacacaggaaagagaaaaacagaagaacaa

SEQ ID NO: 19180 - DNA, 601 bp, Human
atgtcgccccagcttccctttatgattgttacgataatgagaaaatgggtatagaactctatacaactttaaaaaaggtataagcaaatgaaaaccactgttgttatttttttctccttttcacatttaaaacaaaatttggagattataaacattttttgtcaagagaagcaaggaatacaatggacttactttgccccgagcagcagaatctatctatattatctacatacatatccagatcatctagctagaatatagttagtgaatgggattgccaggcaatgaaatggccatatgsatacagacataagaaagatatgttctattttctaagaaagccatttagatatattgtataacacaaactcacataacagagataacagtaatatgccctgaggacagaatagagtaaaaccaagaggtgatagttcagtggagtgtcttaaagaatgggtagaaatttttcctgtgactgcaataaagaagggcatgctaggctgggcgcagtgtctcatacctgtaatcccagcactttggaaggatcacttgagcacaggagttcaagaacagcattagcaacatagtgagatcccac

SEQ ID NO: 19181 - DNA, 601 bp, Human
aaaatgtcgccccagcttccctttatgattgttacgataatgagaaaatgggtatagaactctatacaactttaaaaaaggtataagcaaatgaaaaccactgttgttatttttttctccttttcacatttaaaacaaaatttggagattataaacattttttgtcaagagaagcaaggaatacaatggacttactttgccccgagcagcagaatctatctatattatctacatacatatccagatcatctagctagaatatagttagtgaatgggattgccaggcaatgaaatggccatrtgcatacagacataagaaagatatgttctattttctaagaaagccatttagatatattgtataacacaaactcacataacagagataacagtaatatgccctgaggacagaatagagtaaaaccaagaggtgatagttcagtggagtgtcttaaagaatgggtagaaatttttcctgtgactgcaataaagaagggcatgctaggctgggcgcagtgtctcatacctgtaatcccagcactttggaaggatcacttgagcacaggagttcaagaacagcattagcaacatagtgagatcc

SEQ ID NO: 19182 - DNA, 601 bp, Human
acatgtagcaaccatttgcaattagtctgaagattttctgacttgaaaattatccttgtcagaacaaaaagacaacccatttcaatgacagcctggaagatttggcttccggattcaactactcctattctgtttccttcagtaaatcaggaactttctgaactgtagtttctttatttgtaattggggataaaatgtcgccccagcttccctttatgattgttacgataatgagaaaatgggtatagaactctatacaactttaaaaaaggtataagcaaatgaaaaccactgttgttatttttttctccttttcacatttaaaacaaaatttggagattataaacattttttgtcaagagaagcaaggaatacaatggacttactttgccccgagcagcagaatctatctatattatctacatacatatccagatcatctagctagaatatagttagtgaatgggattgccaggcaatgaaatggccatatgcatacagacataagaaagatatgttctattttctaagaaagccatttagatatattgtataacacaaactcacataacagagataacagtaatatgccctgaggaca

SEQ ID NO: 19183 - DNA, 601 bp, Human
gaacccagcaatcatgagtcaaagcaaatccaagtatgtttgtcagagacaaaacctcagcagtctccttgtccctgggggaagtgatgataaagttgtctttctatgtactccaagccaggaggctgcaatcagcccactggaaatactgacgcttgtcccatgctttaagctttaagaacacaataggacatgtagcaaccatttgcaattagtctgaagattttctgacttgaaaattatccttgtcagaacaaaaagacaacccatttcaatgacagcctggaagatttggcttccrgattcaactactcctattctgtttccttcagtaaatcaggaactttctgaactgtagtttctttatttgtaattggggataaaatgtcgccccagcttccctttatgattgttacgataatgagaaaatgggtatagaactctatacaactttaaaaaaggtataagcaaatgaaaaccactgttgttatttttttctccttttcacatttaaaacaaaatttggagattataaacattttttgtcaagagaagcaaggaatacaatggacttactttgccccgagcagcagaatctatc

SEQ ID NO: 19184 - DNA, 601 bp, Human
caggcaaggtggtgtgggcttgtagtcccagctcctcgggaggctaaggcaggaggatcacttgagccaaggcttcagtgagctatgattgtgccactggactccagcctgggcgacagaatgagaccctgtctcataaaaataaaaaattgttgtgtttaaatcttgacagaaagtctataaggtagaaattattgtccccattctacagatgataaaactcagagaaagagtgaatgctgggcctgaggtcccccgggcagtgtgtggtcggattggaaggcaagcccaggtctgcctractcaaacactgcgctcttcttgctgcccatacccactcctctctttcccaacttcatacatgcatctgtccctacacctgtgttctctctgcctgtggattcgatggattagtcaaaaagaattgtttttgcccggtaccaaatccagaagtgtgaaacccattttaatattcggcgcctttggaggatgagctcaccctgctgccagctggaggaacgcttgtctattccaaggcagcccaactgctttcattaatgtcattccactcagagaataagaatacttagcaatggaagag

SEQ ID NO: 19185 - DNA, 601 bp, Human
tctctactaaaaatacaaaaacaaaattagcctgtcgtggtggcgggcacctgtagtcccagctacttgggaggctgaggtgggagaatggcgtgaacccaggaggcagagcttgcagtgagcagagatcacaccactgcaatcctgcctggacgacagagtgaggggctgtctcaaaaaaaaaagaaaaaaaaagaaaagaaaagaaaaaaagaaaagagagagagagagaaaagcaaaaccaaacaaaaccaaactatatctctggacattttgtgacctaacatttacattagttttsttgcgtgccttcactttatattcctcattacaatgtcatgaggctttaaaaactagcttttttattaaaaaaaatagaatgtaaaaatagaggttaaatattatcagcccttggaaaggaaaatgtagaaagaattttcaactaggtgaaggccagtgggcggtggggcctgatgggaaacgctgggagcttcatgccacaggacaggagaagtaagaattacttaaactacacctagtactttacataaggaacatttttgcttcaaccacttcaattatatgggtatttaaaatatat

SEQ ID NO: 19186 - DNA, 601 bp, Human
tattctgtaccgccatatcccagttaatgtgctagttcttaataaatatacacatggtgcagtgcaacctccaggacatgggtttgatggtcctctgtagaaggacttgaactagaacaacgttcccattccctccctgccttcattcaatctttcccccggagagaagagactcggctgatgggtgatcagaattcctcttttctgtggagctgctggtctctgatagcaagcatttctcagcttatttttaatgtcagctcatcagggtaggctctgccctgcgaggcaagacctgcartgtctatgcatgtgtgagtacatgtctgcacatgtgtgaggcagtggaggaaagggtggtttcaacaagcccatttggttgcagattcaagtcatgttttccaattaagttttatccatagttaaagtgctattctgttatctgaatatctgatttttcttctacttctcaattggtcacaaaggcaagaggaggacagaaaatactccttataggacccctcgaattctaatacctcacatataaaatggccataataatattagctacctcatagggcaattgtgaacattaaatgag

SEQ ID NO: 19187 - DNA, 601 bp, Human
tcacttggtactgaaaccaatacatgaattccaatgaaattccaattttcactttaactcttttctgccaactgtcctaccaaaacaaataattaaatatagttacggtttaagaacgtaatttggaactcgtctgttttgtccacttgatgtctacttttcgtcaggttgaaatcctccatttgccttataaaacgatgactctggctccgttccattttctttgctctctggaatttctgccttgttttttccatgacatttcttgtatgccacataaactagaaaacaatacacagayagttaagtaaattttataataataaactgcaaaattactttgcatagagattataacctatgattcacatggcagatcacattttctgtagactggaggctgcttagagaaagaaatcaccattcttagttctatggctactcatggcgagagggatgactgcacttcaggaagacctagcataaatctttaggagacatttgctcagggcagccacaagcttcttcaggcattcagccctgcacgtggtactcaacaatgataagaacaatagggaggatttattctgtaccgccatat

SEQ ID NO: 19188 - DNA, 601 bp, Human
ccactgtaataataataattcattacatctactttaacatacagaaagtcaggttgtcatctatgggctaggaaattctgcataagaattcagttttggtgttaacgatgttttcattctcggtgttccctatgtcaggtttagtctgagaatattttgggggaatatttcaatgacaatatatctatatgagtatacatacatatataaaacatatacatatatataggaaacaatatttgtcccattaaagaattgggccaccagtcacttggtactgaaaccaatacatgaattccartgaaattccaattttcactttaactcttttctgccaactgtcctaccaaaacaaataattaaatatagttacggtttaagaacgtaatttggaactcgtctgttttgtccacttgatgtctacttttcgtcaggttgaaatcctccatttgccttataaaacgatgactctggctccgttccattttctttgctctctggaatttctgccttgttttttccatgacatttcttgtatgccacataaactagaaaacaatacacagatagttaagtaaattttataataataaactgcaaa

SEQ ID NO: 19189 - DNA, 601 bp, Human
gtgtacctgtctattttctgattgatgggaaatgtgtaggaggtacttagccgctagactgtaaatcttcctttccaccattgggagcatattctctgacactctctaagaaggaagtctgtaccccctctcctccactatctcttaaaattatttagtccattttgtatttgtctaatgatggaaaaatatgaagtacttattcaactgtaaatggaaatcttgcataaaaagatcaatgttatgaatttgaaaagcagaatccctcacccctctactggaagagctaagttgagttccygttcccataatgcttgggtgcaccagcagaatctgaactcagaacatgcaaatgcaaaaagccctttcagccaaaacacttgaaatagactctatgaggcagtgaaaatacccaatgcaaaatggaacaaaaccactaaggaccgagtggttaagattgtgtattctgattgctgcagaatgagggaaaggaaattaaattcgatcttataattgaaagtccaacacttgatgagttattttcccctggcagccgtaaacccctgctaccgtatatcagatagtcctggcttcccttggc

SEQ ID NO: 19190 - DNA, 601 bp, Human
tttgaatttttgtagagacaggttttccccattttggccaggctggtctcaaactcctgacctcaggtgatttgcccgcctcagcctcccaaagtgctgggattacagacgtgagccactgcgccgggcattgttgttaatctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttgrctcttcatgttagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgc

SEQ ID NO: 19191 - DNA, 601 bp, Human
ctggtctcaaactcctgacctcaggtgatttgcccgcctcagcctcccaaagtgctgggattacagacgtgagccactgcgccgggcattgttgttaatctcttactgtgggtaatttagtaattaaactataagaggtatgtatgtatgggggaaaaaacagtaatatagggtttggtgcaatctgtggtttcaaacatctactgggggtcgtagaacatatccccagtggataagggggtactactgtacttgttggctcttcatgttagctctgctaggcagatgtcatttcagagawgaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcgttctctatggtggacaaagttcagaatggaa

SEQ ID NO: 19192 - DNA, 601 bp, Human
tagctctgctaggcagatgtcatttcagagaagaggaagcaagttcagaacggcttggaatcttgctcaggaaatcgggctggttaatgaataacaagagatccagtttcacaaacccaaggcattttgcccccagaatctgggcttcttcacccatttaggctgtcactacttttttttcacttttttatccctgtttaagtcagtctgacccacagttgtcctctgctgacttcagaaataataatctggccagtagacatttggtttcggtcctttaggcccttcgccccaggcatcrttctctatggtggacaaagttcagaatggaagatgggagaaaggtgattctgattctagaagcacccatccctcctaccccattccccacccgcattacctgccatcctgtcagcacagtctgtctctgaagtgctccaagttttctctaagggcccatttggactcccactctcaagactcctcacttgcccagaaagctccttgctgaccttctctgtgtcttcctctcacccattcccttaggcctccctaatatcccctcccagggtctccctatcttgatcccagaatcttcctt

SEQ ID NO: 19193 - DNA, 601 bp, Human
cggtgcagtgttggcctatcaggaccatcggtgtagggtaagtagggaaagtgcttcattgtcagaacagactgggtgcagtggctcacgcctgttatcccagcactataggaggccaaggtgggtgggtcacttgaggttaggagtttgagaccagcctgggcaacatggcaaaaccccatctctagtaaaaattagccaggtgtggtggtacatacctgtaatctcagctacttgagaggctgagacacaagaatcacttaaacccaggaggctaagtctgcagtgagccaagatcaasatcgggccactgctctccagcctgggtgacagagtgagactccatctcaaaaaaaaaaaaaaaattgtcagaataaaggaatcagtcctagtaaactccacaggcaacccaggctgtgacccatgttcttgtagttaccacagagttcacagtgacgcagtcttcatgcacagtggagatgaaatctgctaatctgctaccttcgcttcccagtggccaacaccgtgggttgggtcagggtgagctcaagtgatttcttcttattcttcttcattttttcttttttttttttttgagatg

SEQ ID NO: 19194 - DNA, 601 bp, Human
gactgcctatggagcatccatccctctggctcgggccatggaccctgaagctgaggtcctgctggcatatgagatgaatgggcagcctctgccacgtgaccacggcttccctgtgcgtgtggtggttcctggagtggtgggtgcccgccatgtcaaatggctgggcagagtgagtgtgcagccagaggaaagttacagccactggcaacggcgggattacaaaggcttctctccatctgtggactgggagactgtagattttgactctgctccatccattcaggaacttcctgtccagtcsgccatcacagagccccgggatggagagactgtagaatcaggggaggtgaccatcaagggctatgcatggagtggtggtggcagggctgtgatccgggtggatgtgtctctggatgggggcctaacctggcaggtggctaagctggatggagaggaacagcgccccaggaaggcctgggcatggcgtctgtggcagttgaaagcccctgtgccagctggacaaaaggaactgaacattgtttgtaaggctgtggatgatggttacaatgtgcagccagacaccgtggccccaatctggaac

SEQ ID NO: 19195 - DNA, 601 bp, Human
gtttctttgattgtgacattgttgattgcaaggtttaggaaattaccacagtaaacatgggaagccaattgttagcagttctggcagtccaactgtgtaatccaaatgtgtctaggtcctagctatggtttcgtaccacccagtgtcagttgcctgatccagctggaatattgatggggatcattctgaagtctgtgagtggataggacttccagattggagtagcgattatagatatctcctggttaattggttagttgacagggttacctatcatttttcacctaactttgcctgccawctatgttcgcctctccctgtagaatgtaagaacttagaccacccccatcttcatgtgtttggtggtagatcccacagactaacctatctgttctatcactatgactttcttgactattgagagagtactgaatagttcagcattttcattcttctcccacatccaatatgtgagagcacattttcttgaccatgtcagggaaagctaattaagtggagaaaccagacaaggaagcaggtatgtttcagtgtgacctacggttcttcactcttccctcttactaggttccttcatccattc

SEQ ID NO: 19196 - DNA, 601 bp, Human
gggatctggggtttgcatttctaacagattcccagatgatggggatgctactggtcagagaccacactttgaaaaccacagctccagcctgtaaccatacctgcagctccctggacatgccatgctgtcttcccatgccttgtctttgcctggaagacactctccagccttatcttctttgctacttagttggtcctgcagattcagcttgcataccatatcctctgggaagccttcctttatgccctcttctatccaccagacagagttaggtactccttgtctttgtttctgtcgcgayttcctgtttacatgtctgtctcccatattagatgatgagcttttagagagcagagcctgtattttatctttattcaccattgtccactgaatgactgacacacagtaggtgctcaataaagatgtgttgagcgaatgcgctctactcaccacagccttgttttccttaacaaaaggatgtgaagcccagaagtggggacctgaatgcaaccatctctgtactgcttgtatgaacaatggtgtctgccatgaagatactggagaatgcatttgccctcctgggtttatgggaaggacgtgt

SEQ ID NO: 19197 - DNA, 601 bp, Human
gataagtaagctgtggatttaaaaagccatcgttgctggatctagaattttagatctcgacacagatgggaatggaagctaaatggcctctgttaggtcagatggtacctgtgtgtgaattagaaaaaggtgccttttcctaaaggttctttaatgccaaccactggaaagttataataaatatacagatccgtgatgtttacagtgtgaatgctgccccctaggtttgtgcactgcacaaacctgcatgattgtgagtgatgtccctgatgtctgctctgtggggcagtttcattatcaktaaaatgggccataagggtatgttcatcctaccatgccacagctgagatttgactgtttcccatattcactagactaggagaaatgaatctaaagaattatgtatttcaaggggttgtatatttgactctgaatcatcttttcttttcctcccaaagcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggt

SEQ ID NO: 19198 - DNA, 601 bp, Human
attagaaaaaggtgccttttcctaaaggttctttaatgccaaccactggaaagttataataaatatacagatccgtgatgtttacagtgtgaatgctgccccctaggtttgtgcactgcacaaacctgcatgattgtgagtgatgtccctgatgtctgctctgtggggcagtttcattatcagtaaaatgggccataagggtatgttcatcctaccatgccacagctgagatttgactgtttcccatattcactagactaggagaaatgaatctaaagaattatgtatttcaaggggttgyatatttgactctgaatcatcttttcttttcctcccaaagcttgtgaactgcacacgtttggcagaacttgtaaagaaaggtgcagtggacaagagggatgcaagtcttatgtgttctgtctccctgacccctatgggtgttcctgtgccacaggctggaagggtctgcagtgcaatgaaggtatgcaccaatcacacccttggacagaggatgttctagcaggtatataaaggagatccagtttgctgtcaatcacaacatcggatatacctggactgcttagctacccactactggaca

SEQ ID NO: 19199 - DNA, 601 bp, Human
cagccacctgcaatacctcattcagttccctctaaatgctatgtctgccccccggaacatgcagtgagccacagcagtggagaaatcccatctggcctctgaagtgtgtatgttaaggtaaaaggtgactccaggcagggggcagatcccttgtattttaaaaaaaattaaaatgttacgcaaactatgaacactttgctaggacccaggaagcggtgcatgccagcagtctctagaacataaacttcatcagctttgtagtgaatgtgtctctgggcccaggtttttttgtttttttttwaattctttttattattattattattattatactgtaagttttagggtacatgtgcacaatgtgcaggttagttacatatgtatacatgtgccatgctggtgtgctgcacccatcaactcgtcatttagcattaggtatatctcctaatgctatccctcccccctccccccaccccacaacagtccccagagtgtgatgttccccttcctgtgttcatgtgttctcactgttcaattcccatctatgagtgagaacatacggtgtttggttttttgtccttgtgatagtttactgagaatg

SEQ ID NO: 19200 - DNA, 601 bp, Human
tgtaggttgcctgttcactctgatggtagtttcttgcccaggtttataagagtacatttcatgaactcatctcagcccattcctggctcaagaaatcaccaagattttatgaatagaactgttctaatattcttccagactcctttcaacaattactatcctgttcattccatccaaaaagcagtaggaaagcaaggagacatttctaacagtaactacttaaggacatggtctcctttaatagtccaggatttagaatagtcaacaatagattgtacactggcaagttttatgtatcagkgctggtttctatctgaggaaataagcaataatagaaatttttgaagcaaatagtggggacaataaagagaacaggggaattccactgtgcaaatatgtgataattcaaagtcattcagaacactttgccaggaagaaagttctagtgtattctagaaactaaaaaaatcaaggcttcatgatattttaaggtcttctgccatcccaacagaaacttgatttcagtagtcagatttcctttatgcttattaatagttcttaacctttctaccatctgctttgagtaagaagttgtgattaa

SEQ ID NO: 19201 - DNA, 601 bp, Human
ggtgcaaaatgtgatattttgatatatctatacattgtgaaatgattactgctgttaagctaattaacatatccatcacctcacacagttatctgtgtgtgtgggtgtggtgagagcatttaaaattgctcagcacatttcaagtgtacaatacagtaatattaagtttagctaccacactgtctattagaactccagaacttacttatcctactgtgtaattaaaagtttttgccctttgaccaacatctccccatttcctccaccctgtagtccctgggaaccactatgctactctgcytctataagtttgactttttcagattccacttatagaagagatcttacagtattggtctttatatgcctggcttatttcacttagcatggtgccctccaggttcatccgtgttgttgcaaatgacaggatttccttcttttcaaaggctgaataatatgccattatatatgtgtacacaccacattttctttatccattcatccatggatggacgaatggtcaagtccatattttggctactgtaagcaatgctgcaatggacatgagaaaacagatgtctctttgagatagtgatttcat

SEQ ID NO: 19202 - DNA, 601 bp, Human
ttctttatccattcatccatggatggacgaatggtcaagtccatattttggctactgtaagcaatgctgcaatggacatgagaaaacagatgtctctttgagatagtgatttcatttctcttggatatataccagaaatgggattgctggatcatatggcagttctattttgagtgttttgaagaacttccttattgttttccataatgactgtaccaatttacattcccaccaacagcatacaagggttccctattatctacatccttgccattctagcaggcgtgatgtgatatctcaytgtggttttgattttcatttccctgatgatcagtgaggttgagtatttttcatagacctgttggccatttgtatgtcgtcttttaagagatgtcggctgggcacgatggctcatgcctgtaatcccagcactttgggaggccaaggcgggcggatcacctgaggttgggagttcgagaccagcctgaccaacaacgagaaaccccgtctctactaaaaatacagaattagtcaggcacggtggtgcatgcctttaatcccagctacttggggggctgaggcaggagaatcgcttgaacca

SEQ ID NO: 19203 - DNA, 601 bp, Human
ttcttcactctgttgattgttttctttgctgtgcagaagcttgttagtttgatgcaatcacatttgtctatttgtgcttttgttgtctgtgcttttgaggtcatatccaaaaaaatcattgcccggatcagtatcaagaagcttttcccgtctgttttcttctagtagttttacaatttcaggtcttatgttgtgtctttagtcaattttgttttgagttttgaatataatgagatgaggttctaattttattcttctgcttgtggttatccagttttcccaggactatttattgaagagmttatcctttccctgttgtgtgttcttcatacttttgttgaatctgttaactgtaaatgtgtaaatttatttctgggctgtcaattctgttccgttggtctatatgtctgtttttatgccagtaccatactgtttttattactatagctttgtaatatattttgaaatcaggtaatgtgatgtctctagctttgttcttcttgctcaatattgctttggctattctaggccttctgtggttcaatataaattttagtatcgttttttctatttctgtgaaaaataccattgcaattttgat

SEQ ID NO: 19204 - DNA, 601 bp, Human
cttgtggttatccagttttcccaggactatttattgaagagattatcctttccctgttgtgtgttcttcatacttttgttgaatctgttaactgtaaatgtgtaaatttatttctgggctgtcaattctgttccgttggtctatatgtctgtttttatgccagtaccatactgtttttattactatagctttgtaatatattttgaaatcaggtaatgtgatgtctctagctttgttcttcttgctcaatattgctttggctattctaggccttctgtggttcaatataaattttagtatygttttttctatttctgtgaaaaataccattgcaattttgatagtgattgtattgaatttgtagataacttagttgtgattgatactaaaaataaagactgcattttagctgggtgaataaaatacaaaatcaaaacaaatcatcatagccccaaaagacaagcttttgcattaatttttggttagaagccttctagtaatgttacagttgaccaaaataaggacacccagttaacagaatccatttgccatgtaccaaattctaagaattgtcctggcaggtttagtgagctccaaggga

SEQ ID NO: 19205 - DNA, 601 bp, Human
ctttatatttattctgctaagggcttaacaaatttttgaatgtgtaaatttcaacaaattgggataatttaaaccattatttcttcaaatattttgtctaaccctttctctctggtccttcttggacctccagttacatgtgtgttagatgttttgtctcttgggtccctaaggattaaaaatcatttttttccaacctttttcctacttttcttctttagatgggctatctattgatgttgcttcaagtttattgactctttcttttgttatctccattctgttgctaagtccatacagygattatttgatttcaaatattgtgtttttcagttttagaattccttttgctttttaaaaatagtttctatttccctgctgaagtttctcattgttgcatttgttatgaacatatcttcttttaccttactgagcatagttattatagttgttttaaaattcttgtctattccaacatctgagtcatcacagttggtctctatttattttcttttcctttaaaaaacgggccttaattctccatttcttctttggattgtatcttgaacattgaaaatgttacattatggagactctggaa

SEQ ID NO: 19206 - DNA, 601 bp, Human
ctaagtccatacagtgattatttgatttcaaatattgtgtttttcagttttagaattccttttgctttttaaaaatagtttctatttccctgctgaagtttctcattgttgcatttgttatgaacatatcttcttttaccttactgagcatagttattatagttgttttaaaattcttgtctattccaacatctgagtcatcacagttggtctctatttattttcttttcctttaaaaaacgggccttaattctccatttcttctttggattgtatcttgaacattgaaaatgttacattrtggagactctggaatatgatacattccttttgggaatgttgattttgttttgttttagcaggcaattaacttggtaggattcaaacctcaaactctcactgttaggaatcaggtcaaactcagtttagttcttttatctttagctgggctgctttgagtctatactgagcatgcatggatcaaggatcagccaaagatctgggacttttctctgactctttctgggttttccctctctctccagtggctgtggttttcctgactctgtctctgatgcatcaggccagtagactgcaggtt

SEQ ID NO: 19207 - DNA, 601 bp, Human
atttatttgcagttgaccttaaacaacatgggggctaggggtactgacccttctcacagtagaaaatctacatataatttttgactctccaaagacttaactactaatagccttctgttgacgagaagccttaccaataacatagtcaattaacacagagactagtatctgtatatattttatgccttcatgacatacctttttcttaatttttttggtatttctaggctacacagtttgtctgtgagttttttcaaattatcctaaatctccaaaaaattttccaatatatttattgaaraaaatccacatgtcagtggacccatgcagttgaagcctgtattgttcaagggtcaaccatatcttctgtctctgtagattgcctgttcttgacattttatatgctgtaaacaagattgtataatacgtcgtcatttgtgactagcttcatttgccacaccttttttgaggtttatctatgttgtggcatgtatcagtacttcattccttttttatttctcaccatctgttattataaagaaaaaaattttggatcacagccacctccattcatttatagtatgtcgtctgtggctgcttt

SEQ ID NO: 19208 - DNA, 601 bp, Human
catttcattctaggcctgagaagtaggatatcagtataaaatatcattattgaccccgcctcttcccaccaccgataagaaacagtctgtagttactgctgctctgagggcacctctatcgcctacattgtttactgagtgttggacaattttcaaacatgtctcacattcaattacaaatagtccacagttccctgagtccctatggttcagaataaaattggtatatttcagggttattcattctctactgtgtagatgttaggcaagaaatcctgacaccattacctttattgacacyacagacatttttccttctttcaatattggcagcaacatttttgatttggctgttgagtggatactgatttggggaagttatatttcacttctttgatgtacttcttttgtgagcaactttattcaccttttcctcttagttatctgctatttgcagacttcccaatgaatgagacatctctcgtatatctaaactgaggtcaatgctgttgaacagcaataccatggggttatttgatgagtggaggaagaactagttttttgtttgttgtatttttgtaatcattcatgtaaaaagaaa

SEQ ID NO: 19209 - DNA, 601 bp, Human
tctgtagttactgctgctctgagggcacctctatcgcctacattgtttactgagtgttggacaattttcaaacatgtctcacattcaattacaaatagtccacagttccctgagtccctatggttcagaataaaattggtatatttcagggttattcattctctactgtgtagatgttaggcaagaaatcctgacaccattacctttattgacactacagacatttttccttctttcaatattggcagcaacatttttgatttggctgttgagtggatactgatttggggaagttatattycacttctttgatgtacttcttttgtgagcaactttattcaccttttcctcttagttatctgctatttgcagacttcccaatgaatgagacatctctcgtatatctaaactgaggtcaatgctgttgaacagcaataccatggggttatttgatgagtggaggaagaactagttttttgtttgttgtatttttgtaatcattcatgtaaaaagaaagagggggattgaacagcaaagtctaggggagatatggccatgataatcattttaatattgagactgttcctccctggtccatgaa

SEQ ID NO: 19210 - DNA, 601 bp, Human
tccacagttccctgagtccctatggttcagaataaaattggtatatttcagggttattcattctctactgtgtagatgttaggcaagaaatcctgacaccattacctttattgacactacagacatttttccttctttcaatattggcagcaacatttttgatttggctgttgagtggatactgatttggggaagttatatttcacttctttgatgtacttcttttgtgagcaactttattcaccttttcctcttagttatctgctatttgcagacttcccaatgaatgagacatctctcrtatatctaaactgaggtcaatgctgttgaacagcaataccatggggttatttgatgagtggaggaagaactagttttttgtttgttgtatttttgtaatcattcatgtaaaaagaaagagggggattgaacagcaaagtctaggggagatatggccatgataatcattttaatattgagactgttcctccctggtccatgaaaggagcacagcctcatggcaaagagcgtggactctggatttataaagatctgagtctgaatctgggctgtgagcctctgtctcctcatccataaaatg

SEQ ID NO: 19211 - DNA, 601 bp, Human
aggtatgagtgaccttctgagggaggaatatgtagaatgtaccattactagggtccacgtttcaatgtccctgattccactcaaacaacccatcaggtagaagaagccaattgatggcttccaaaatcttattggctttttcatgagttaatgaaagtaatggctactatttagtaaggttggccataactatatgtaacttcttacttaacattgcctagtgtctcttttttttggcggaagtgggaactggctgggtgaagttaagtaactaaggaattggtcaaaaatggcaaagagsccagatacggtgactcatgcctgcaatcccagtgctttggaagcctgaggtgggaggatcactttaggccagaaatttgagaccggcctgggcaacatagcaagaccccatctcttaaaaaataaaaaaagaattagctggacatggtggcatatacctgtagtcccagctacttgggtgaggtggggggatcacttaaggccaggagtttgaggctgcagtgaactatgatcactcaactgcactccagcctgagccaaggaacaagactttgttgtctctcaaaaaaaaaaaaatggc

SEQ ID NO: 19212 - DNA, 601 bp, Human
agagcccagatacggtgactcatgcctgcaatcccagtgctttggaagcctgaggtgggaggatcactttaggccagaaatttgagaccggcctgggcaacatagcaagaccccatctcttaaaaaataaaaaaagaattagctggacatggtggcatatacctgtagtcccagctacttgggtgaggtggggggatcacttaaggccaggagtttgaggctgcagtgaactatgatcactcaactgcactccagcctgagccaaggaacaagactttgttgtctctcaaaaaaaaaaaaatggcagaggtccatctctcttcagaaccctggatttttccagtactccccacttgacagcctctcaaacacttaggaagtcactttgtcctcccacgcagccatctctgtgttagataggaaaggaacaaatcttatgaggaggagtttaaaagaaatcatgcttcaggtgtcttgcttgtaagtgtttaccccgtactcctaaacacacaaatacaacagcaggatctgacagggcatcaatccaaaataaactttcagggctactacaatagctttggaaataagccaataattatat

SEQ ID NO: 19213 - DNA, 601 bp, Human
ttcttgatctctcctaggaaacttcttattaaacaatgagatggggtcaatgttatggacctttgcgtttatgcctccctagaagtttttatttttttgtatttgaccttttcagccaaaagactttaaccatacggatcatttctcagtagccatattcaccatccaccggatcctcccccctgactcaggagtttgggtctgcagtgtgaacacagtggctgggatggtggaaaagcccttcaacatttctgttaaaggtaagttcatttcccagaaaaagggattgtgtccttgatgyattatgtttttgtattgctgcttctagacagaaatgtatgcgaccactaaaatacctttggggtaatttccaggatagtaagcctttaaaaaattatatgcatgaaactagagtgaagaaattaagagtatgaactgtggagtcacacagccccaggtttgattttgtccctaacagctcataatcttgtgggtggccttgaccaaatgaagttacctttttgagtgtctctgtatttgcaaatgaagcataatttaggtacctcttagggttattgtgaagccttgttaaacacataca

SEQ ID NO: 19214 - DNA, 601 bp, Human
cctttaaaaaattatatgcatgaaactagagtgaagaaattaagagtatgaactgtggagtcacacagccccaggtttgattttgtccctaacagctcataatcttgtgggtggccttgaccaaatgaagttacctttttgagtgtctctgtatttgcaaatgaagcataatttaggtacctcttagggttattgtgaagccttgttaaacacatacaatacttggagttgtgtcaggcacaacatatctggtagtgattatatttcacaagaaggttagcattgccgttgtgacttcctrttcattattgtagagaattatttggagaatccctattttgaggattactcacttaataagaagcccaggctatgctatataattaacatgaatgtcttttcacattcagggctgtgggcatttttcctgctataaattagtatttcaaaattcaaattaatctgagtgtttgtgtgtagatttgtggcttgagtggaagaactaaaatggaggtaagtccacgttaacttggctggtgtacgtagctacagcaaggaattttaaatccgcaagttacttaatcacctgtttagacaagaa

SEQ ID NO: 19215 - DNA, 601 bp, Human
tgtggtgaatacacagaagagtcactgggtctagtttttagtttgtagtgaaagacacggcacacaacatcaatgtgtagaagcttctccagtcgtaagtcactgctgtctctttgctgtcacattgactggcagccataaaatgtaaatagccattagggaatttaatcaatttaatcagcatcttttattatagtatttacaaaaacagatactaggctttaacaccagtgtacagattgatacagtcactttggaaaactggcaacttgtactaaacctaaacatttacttagcctgkgaaccagcagttccacccctaggtatatgctcaaaagaatggctgtattatgttcaaaaaagacatcttcaagaatgttcagagcagttgtattcatagtagccccaaactgaaattaactcaaatgtccatcaacattagaaaggatacactaatcacaaattgtagtatattcatatgtattagtttgctagggtgccataacaaaatactacaggctgagtggcttaagcaacaggaatttattttctcataattctggaggctacaagtccaagatgaaggcatcagcagagttta

SEQ ID NO: 19216 - DNA, 601 bp, Human
aattaggacacaggtacagggtcttccctttgtacttgtgtcctaatttaatcctcttacaaggacaccagtcatattggattatggcaaaccctaataaacttattctaaattaattacttctttaaaggccttatgtccagatacggttacatcctgaggtactaggggttaagactttaatgtgtgatttggggggaatacaatttagcccataaaatcatgcagaggaatgttaaacagtaataaaaaagaattaatttccgcaacagtatggatgaatcttgcaaacatgataacyagtgaaagaaagtacatgctttatgattccatttatataaagctaaagaacaggcaatactaatcttcagtcacagaagtcagaatagaggctacctctgggtagaggatattgactggaaaagggcacacaggtgccttctggagggctgggaatattttctatcttaatctgagtggtggttacatgggtgtacacataggtaaagtcccttgagctaaatacacttaagatattcacgctttacaatatgtatgttccatctcagtaaaaatgattaaaaggcaaaaaataaaatag

SEQ ID NO: 19217 - DNA, 601 bp, Human
tatgtccagatacggttacatcctgaggtactaggggttaagactttaatgtgtgatttggggggaatacaatttagcccataaaatcatgcagaggaatgttaaacagtaataaaaaagaattaatttccgcaacagtatggatgaatcttgcaaacatgataaccagtgaaagaaagtacatgctttatgattccatttatataaagctaaagaacaggcaatactaatcttcagtcacagaagtcagaatagaggctacctctgggtagaggatattgactggaaaagggcacacagktgccttctggagggctgggaatattttctatcttaatctgagtggtggttacatgggtgtacacataggtaaagtcccttgagctaaatacacttaagatattcacgctttacaatatgtatgttccatctcagtaaaaatgattaaaaggcaaaaaataaaatagtagattactaagaggaagcctttgtagcaatttttaaacccttgtagaagtatcacagactgacattaatggctgtaataaaatgtgcatctgctggtttaaagaaaggggtggccttattttatcatacaagg

SEQ ID NO: 19218 - DNA, 601 bp, Human
cattacttgaacaaatttacttacagcactgccctcctttctagcctaagtgaaatgtgtactcagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgrgcaaataaataagtagaatgtacagttcacgaaaatgctgagtgtcttggagaaaattaaagcagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaa

SEQ ID NO: 19219 - DNA, 601 bp, Human
ccctcctttctagcctaagtgaaatgtgtactcagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgagcaaataaataagtagaatgtacagttcackaaaatgctgagtgtcttggagaaaattaaagcagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaacgagttatgcatttctaagaaggctgggcca

SEQ ID NO: 19220 - DNA, 601 bp, Human
cagacttatctaacttaatattggcatgatctgcctccagttaggggatactgcttcttactggctttattatcctgaccttggacaacttcctaagtcgtcacttagtcaatagaatttactttaggcctattatgtttcagcccctgttctaggcactgggaatagagcagtgaataatacagggggaaaaagactcaccatggagcttacattcccacagggagataaacagtgagcaaataaataagtagaatgtacagttcacgaaaatgctgagtgtcttggagaaaattaaagmagaaatgggggtagagaatgctggggcagggctggagtggtgactgtaattttaaatagggtaatcaagccttcctgagaagatatttgagcaaagacttgaaggttatgtctaaggaaggtgagccaaagcattgagacagaaagaaaaggaaaaattactgaacattgcaatgtcctctgaaatctgaaaggttctgcattgtataatacacactcttggggaggaaaaacaaaacgagttatgcatttctaagaaggctgggccaagggaactatagagctcattggaaattcactt

SEQ ID NO: 19221 - DNA, 601 bp, Human
ttgtagactttgaagggataggaaggagccttgagccaaggaatgcaggcagtctctagaagctagaaagaacaaggaaacagatggtctcctaagcctccagaaaggaacacagccttgctaatgccttaattttagcacagtgagatgcatgtctgacttctgacttctagaactataataaatttgagttgtttggctgaaagagagagatatatatatatagagagagaatgaattatgatctagaagaaagaccaatatcaaataatcaaataatcatactacaaagagtaataamccctaaaaatcaccatgaaggaaaagtagaggttctgtgaaagtatacaataccttaattcagtttctatgatagccacctgtgaaatattcacatcagagctaagaattaactgggagaataatgggaggtggagcattccttgcagaagagagacatccacaatcaatctaaagaaaggaggttcgtgctttgttagttggatgaagtgaaaggtcagtgggactggagggtactaggtgaggggaagaggaggctggagagtgggcaggggcttaatcactcaaggcctggctggtc

SEQ ID NO: 19222 - DNA, 601 bp, Human
acatcagctctgagccttactttggggatggaccaatcaaatccaagaagcttctatacaaacccgttaatcactatgaggcttggcaacatattcaaggtaagctttggacaggatagatgccagctggggatgtggcaccaggagaattatttttctccaaatctagaaattcccttctccctgcctcaatcctctacctcaaggtggtggctgttgcagaggattctgtttcagagtattcaagagagagtgcagggggcccctgagctctggggctaactttctgaagtcactgtgygctctagaacacagaaccagctcacaccatgagttactatctatatcaatatttctttttggatctccagtcctgtttttagttattctatcttggctggtcatggggaaaggcacttgtttatgccatgaatatggtagcaggaaagtccagagcctgctggaagggcagagaggcttaatctgcctaaatcctgggggtgattgttgctgctgtattgagttgtttattccttttctcatttcatgtcttgccctgtcctgcagactcttaacacagagagatttttgaaggaatttg

SEQ ID NO: 19223 - DNA, 601 bp, Human
tgaacaaaatgtgacaaaatgccaaaagttcatgaaaacagttgaatttattttgaaacacaaattacaattatatttgttgtatgataatgtaaaatcacaattttaaaaagcaaagagcattatcagtgaccatgctgcttcaattggactattctgtaaaaagacctgccactaacatgcttgtaggcagcatgtcctcctccgcccatacctttgtcttactatgcctatgatttccttaaaatgaccctctattcactatatggagataattaagaaaactatggaaaaaaaaaaagagaagaggaggagggttttgggctgaataacactagctgacctgggtagaccgaataaaatggtattattactgagtccttcacatactattgtagattctatcaaaattcagaattccagggatgtcaggctgatttgctgaattgctgtttccaacatcaatggctaggtcttttgctgtcatatggtggtaataatccatcacctttgtctacaagtggacatccacaaagtggtcttctaagaactgttaaacacatcccagttttttttcttaccaagtaggaatttatcatat

SEQ ID NO: 19224 - DNA, 601 bp, Human
aaagtggtcttctaagaactgttaaacacatcccagttttttttcttaccaagtaggaatttatcatatgataaggcagaaatttatctttgcagtatccatggagaaacagaggctgactaaagcaaataggtaaggagaaaagagacagataccatttgtttatgggtgctattttcaaggacttcagaatgcttcattgtaatagtatgaccattgcaaatcagttttctggtcattttgagcaaacctcctaagcatctttttctctcgatagcttgattgcaatcagtgtacatayttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattaggaaggatgaggccttgaagatggaattgcctctctgtttcactaagacgtagttttgaaaacctaaaattagttcacatcgcaataacaacaaccccggct

SEQ ID NO: 19225 - DNA, 601 bp, Human
attgtaatagtatgaccattgcaaatcagttttctggtcattttgagcaaacctcctaagcatctttttctctcgatagcttgattgcaatcagtgtacatacttgaaaacagtagcaattaaattattctaattgagtattcccccaatctggtattccatatagatttgtgaggttttattctacaaatgaaaagacaaaagcaccagagcagaaatgtgtaagtggcacagaaatacacactttaatgtgtacattgtaacctggaaacatttcaaaagcctaattttcctcatattrggaaggatgaggccttgaagatggaattgcctctctgtttcactaagacgtagttttgaaaacctaaaattagttcacatcgcaataacaacaaccccggcttaaggaatgtaagagaatgccaacttaagtttcctggacgttttctcttctcagtgacaaatgagattgttacactcaactatttggaacctcggacagaatatgaactctgtgtgcaactggtccgtcgtggagagggtggggaagggcatcctggacctgtgagacgcttcacaacagcttctatcggtcagtgga

SEQ ID NO: 19226 - DNA, 601 bp, Human
gtttatttattttcaaaaataatttccaatttttcaaagtaattcatggtcagagtcatgacatcaaatagaataagaagcttttatctaaagaacagcattctcctgctccaccctccacctcccagtcctgcttcctataggtagccactttcatctccttaagctatttcttatatttacctcccttttctaaatcagtggttctcaaacctaagtgtccatcagaatcactcagagagtttgttaaaagatgtttctgggcctcatccccagagtttcggattcaatggttttgagrtgaggatggggccggggttcaaaaatttgcatttctagtagcttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagcttcctgttacccaggtaccctccattgaaatactggagtgatcttttgtaaggttccattcctggttctttgaattgttcactgtgtataaccattctgttactc

SEQ ID NO: 19227 - DNA, 601 bp, Human
ttcatggtcagagtcatgacatcaaatagaataagaagcttttatctaaagaacagcattctcctgctccaccctccacctcccagtcctgcttcctataggtagccactttcatctccttaagctatttcttatatttacctcccttttctaaatcagtggttctcaaacctaagtgtccatcagaatcactcagagagtttgttaaaagatgtttctgggcctcatccccagagtttcggattcaatggttttgaggtgaggatggggccggggttcaaaaatttgcatttctagtagsttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagcttcctgttacccaggtaccctccattgaaatactggagtgatcttttgtaaggttccattcctggttctttgaattgttcactgtgtataaccattctgttactctctcttggtcagtactttatactttcaacttcatatatattt

SEQ ID NO: 19228 - DNA, 601 bp, Human
cagtggttctcaaacctaagtgtccatcagaatcactcagagagtttgttaaaagatgtttctgggcctcatccccagagtttcggattcaatggttttgaggtgaggatggggccggggttcaaaaatttgcatttctagtagcttcccaagtgatgctgctggtcctgggtccacacgttctagataacatgtgtaaaattacttctggacttctcagtggtgtttggtattgactggccttctattgcgttaattaactctgtgaagcctccttgatgctaacctgacctccagcttyctgttacccaggtaccctccattgaaatactggagtgatcttttgtaaggttccattcctggttctttgaattgttcactgtgtataaccattctgttactctctcttggtcagtactttatactttcaacttcatatatatttgatttatatcacctaggaaagtaagaattatcatcttccctattttacagattgaaaagtagagactcagagtacttaataacagtaagatgcatcaccatactaaatcttcgggcttcatatctttgtcttttagagccaggatcttgctctgtc

SEQ ID NO: 19229 - DNA, 601 bp, Human
gtcaccactcccagtccaggctccatatccttttgtttctccaattattatttctacctagaatcccaaaggcaccagcttattatcccagttcacatatttgcctgtgttttactccatttactaaaagtagaaggatatgttatgattgagtgaaaaaaccaggaagaacatccacttttcttctgcagagattgtgcacccttaacagaaacatccttccttcacaccacccacctagtttttatgttactagcagcatccttaaagaaccaaatgagactcaaaagctactctgagrcttatagaagcattacacacaagtaagaaatggctgcttggggacccacctggttgtgaatataaaaaataaacccagaaactatatagagaggaaaaagggacctctacaaccatgacccaagggatccctgatatgtcatcatgttactgctaaaaggcaaatggtagttaattctctctcaagtcactgttggtgagtcaagaggggaagagcataaactgactcagatggaaagtatttatggaacagaacataaaacacttcacagccccacactgtactgtcttcagccctcag

SEQ ID NO: 19230 - DNA, 601 bp, Human
agcattacacacaagtaagaaatggctgcttggggacccacctggttgtgaatataaaaaataaacccagaaactatatagagaggaaaaagggacctctacaaccatgacccaagggatccctgatatgtcatcatgttactgctaaaaggcaaatggtagttaattctctctcaagtcactgttggtgagtcaagaggggaagagcataaactgactcagatggaaagtatttatggaacagaacataaaacacttcacagccccacactgtactgtcttcagccctcagaatgtgttscagccaggaggtctctcagaatatttcaaagtagttctcaggggtaggcgggaaggggattattgaaggttcttcttttcccatcatttgaattttgctgctgtttgcttttcatttcgtctggcagttgcactgtttatgtgtgttgattgagatggtgaaggccagggagtccgggaggggaaggaagagaacactttctgaacatagtgcagaaaggggcagacagggaggcgtatggggtaatcatgttcccaaagggcgggaaaaggggaaatgactatttattgagttactctt

SEQ ID NO: 19231 - DNA, 601 bp, Human
aacttggagagattatgaatttgcccaaggttgcaaaagtaaagtggcatgttcctgtctctctgattttaaaacccatattgtttctattcagtgatgtcttggtagcccaggctcctgtgggtgattatggccaggcatcacgtagtcatagcggataccttgatgtgatcagagcaggaataggcctggccctgccaccacagctgtatgatttctgaaaatcttgctaaggggaaggaacccctaaattgctttacaatgtattgctcaaaatggtaacagaaacggtaaatactckcccataatcccataaccttggcaaatctactgttttgatttttatcagtttccttcctatccttcaccattgtagacataacttttagcatgcctacatgtacttgaagtctctttattgggctttcatacttatcctagttatctatttttccactgaatggctatatcataatttattaaagcagtttcctattttgagtgtttaggtttcttccaattgtttgctgttataaataatgtaatgaatcattttggtagggaaaaaagtatcatatgggccacttgcttgtgtttcttt

SEQ ID NO: 19232 - DNA, 601 bp, Human
ggtatatctcctaatgctatccctcccccctcccccggcaattgaacaatgagaacatatggaaacaggaaggggaacatcacacactggggcctgttatatactttcaaatgaccagatttcatcagaactcactcggtatcaggaggacagcaccaagggggatggtactaaaccattcatgggaagtcacactcatcaaccaatcacctcccaccaggccccacctccaacactggggattacatttcagtatgagatttgggtggggacactaatccaaactatatcagccatatakaaaaataatgatttttctggattctcctaggactccctcctccaagaggtctaaatctcctgcctaaaagtcagaccactctaaatttgacctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgctt

SEQ ID NO: 19233 - DNA, 601 bp, Human
cctggcaaccaatatttccaagctcggaagatgacttttatgttgaagtggagagaaggtctgtgcaaaaaagtgatcagcagaatattaaagttccaggcaacttgacttcggtgctacttaacaacttacatcccagggagcagtacgtggtccgagctagagtcaacaccaaggcccagggggaatggagtgaagatctcactgcttggacccttagtgacagtaagtaattcatgctgctccagcctcatctgagcaataaggggctaccgccatgcagacttagctaacatcactkcaggactattggaaattatgaaagaaagttagttgtgagagaaggctaattagtgccccccacctaatcattttaataacttgcaatatataacatatatttggatttgcaataattcaggcaggtctgtgctaaaatttaccttcccttggtgtgcagttgtttatttagtaaattagtaacaagaagtttttctagggcttgttgaaccatttatggggtagttttgaagaattatcatatatctacatgtacacagatgtcagttaattccagatgggtcttacctaaccataaaaa

SEQ ID NO: 19234 - DNA, 601 bp, Human
ctttcagcatttgttgttgacttatgtaataacccactacaggtgtatcagtatctcctgcaactgttatccctatctatttctattcccctctcccaagagacaaccaaaattatgagtttgttaagtatattttaatttaatgttgtatgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccrcacctgactttttttaaaaatttttttgtagagatgggatctccctatgttgcccaggctggtctggaactcctgggctcaagcaatcctcccgccttcgcctcccaaagtgctggaattacaggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaat

SEQ ID NO: 19235 - DNA, 601 bp, Human
ttatgagtttgttaagtatattttaatttaatgttgtatgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccacacctgactttttttaaaaatttttttgtagagatgggatctccctatgttgcccaggctggtctggaactcctgggctcaagcaatcctcccgccttcgcctcccaaagtrctggaattacaggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcataga

SEQ ID NO: 19236 - DNA, 601 bp, Human
atgtatatattttttgagacaaggtcttgctctgttgcccaggctggtgagcagtggtgccattatggcttctgcagccttggcttcctgggcccaagcaatcctcccacctcagcctcctgagtagctgggaccacaggcacacgccaccacacctgactttttttaaaaatttttttgtagagatgggatctccctatgttgcccaggctggtctggaactcctgggctcaagcaatcctcccgccttcgcctcccaaagtgctggaattacaggcatgagccactgtgccaagcccartgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggaacaagtccggtggt

SEQ ID NO: 19237 - DNA, 601 bp, Human
caggcatgagccactgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgaragtttttctaggaacaagtccggtggtggaactcatgggctatttccctctaaagtggttagtcagtgtgtactatgttcaggagtgtatgacagtgccattttccttatacccatctctatgtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactgg

SEQ ID NO: 19238 - DNA, 601 bp, Human
tgtgccaagcccaatgttctataattttaatatctctgaaagtatacacatgcatacatatcattcttcattttttgaatggacattatgaattttatcgatccatgtttatttagctttgatgcatgtaattttaacttctgtataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggarcaagtccggtggtggaactcatgggctatttccctctaaagtggttagtcagtgtgtactatgttcaggagtgtatgacagtgccattttccttatacccatctctatgtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctctttttt

SEQ ID NO: 19239 - DNA, 601 bp, Human
tataatattctatcttatgaatgtatcttgtcattcatcctctcccttttagagggagatgtaggttttttcattttttactatcatgaacaaaatgcaatgcccattcttatgcatgtctccatgtgcatagacaggtgtgagagtttttctaggaacaagtccggtggtggaactcatgggctatttccctctaaagtggttagtcagtgtgtactatgttcaggagtgtatgacagtgccattttccttatacccatctctatgtctatatcctttccctatatcactcgatagtgtsacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctcttttttgatatacttattgatatcctttgctcatttggaataggttgtctttcttactgatttgtaaaaattatttgtgtaatctaaatactttgttatgtgtattgcaaatatgttctcctaatccctttattgtaaccttgtttgtg

SEQ ID NO: 19240 - DNA, 601 bp, Human
gtctatatcctttccctatatcactcgatagtgtcacacctttttactttgcgtatctcaaaagcaaaatatggtgcctcattgttaatttcaattttgatttccttgatagctagcaaaggtgagcatctttttatgttaattgtcctcttttttgatatacttattgatatactggatgtcctcttttttgatatacttattgatatcctttgctcatttggaataggttgtctttcttactgatttgtaaaaattatttgtgtaatctaaatactttgttatgtgtattgcaaatatrttctcctaatccctttattgtaaccttgtttgtggtggcttttaacccacagacacttgacattttgatgcagctggacctgtcagtatttgcctgtgtgatttatactttttgcattttggaattattccctatcccaaggtcataaacatattctctgtgtttttcctagtagttctagtgttgttttgtgtatttaggtctttaagatataaaaatgttattttggggtgcagtatattttaatatttttattttaatcttatttattcacatatggcatgtcagtggtcccaatgc

SEQ ID NO: 19241 - DNA, 601 bp, Human
tggcttttaacccacagacacttgacattttgatgcagctggacctgtcagtatttgcctgtgtgatttatactttttgcattttggaattattccctatcccaaggtcataaacatattctctgtgtttttcctagtagttctagtgttgttttgtgtatttaggtctttaagatataaaaatgttattttggggtgcagtatattttaatatttttattttaatcttatttattcacatatggcatgtcagtggtcccaatgccacgtattgagtagtccccatggtgagttgtgatgmtttctgtatcatatgccaggttctcatattcattttgcatctatttctggatgttctgttcccttccattgatctgtttgttcctgtaccatttccagcatattaactataaacttgtgaaatgtcagtaactatgggatgaatcactatttcctatttcaaaattatctgaggtgctcactcacctaaactacataagtttcatcctcattagaatgatacactctcaaaatcacactatcattatcatatttataggattaaacaaaaactagttaatagtcactgggagtcgacttg

SEQ ID NO: 19242 - DNA, 601 bp, Human
tagtagttctagtgttgttttgtgtatttaggtctttaagatataaaaatgttattttggggtgcagtatattttaatatttttattttaatcttatttattcacatatggcatgtcagtggtcccaatgccacgtattgagtagtccccatggtgagttgtgatgatttctgtatcatatgccaggttctcatattcattttgcatctatttctggatgttctgttcccttccattgatctgtttgttcctgtaccatttccagcatattaactataaacttgtgaaatgtcagtaactrtgggatgaatcactatttcctatttcaaaattatctgaggtgctcactcacctaaactacataagtttcatcctcattagaatgatacactctcaaaatcacactatcattatcatatttataggattaaacaaaaactagttaatagtcactgggagtcgacttgccttggatgattgtatgaagtttgatggagggtcaatgctggtggtggtagtagggatgtgagattggcagggtaggagttgatccctatagggtcaggaaatccgaggaaggaggatgtgaatgagaacatct

SEQ ID NO: 19243 - DNA, 601 bp, Human
cttatttattcacatatggcatgtcagtggtcccaatgccacgtattgagtagtccccatggtgagttgtgatgatttctgtatcatatgccaggttctcatattcattttgcatctatttctggatgttctgttcccttccattgatctgtttgttcctgtaccatttccagcatattaactataaacttgtgaaatgtcagtaactatgggatgaatcactatttcctatttcaaaattatctgaggtgctcactcacctaaactacataagtttcatcctcattagaatgatacactytcaaaatcacactatcattatcatatttataggattaaacaaaaactagttaatagtcactgggagtcgacttgccttggatgattgtatgaagtttgatggagggtcaatgctggtggtggtagtagggatgtgagattggcagggtaggagttgatccctatagggtcaggaaatccgaggaaggaggatgtgaatgagaacatctcatttttacctgaaaatatttgttaatatgctgtgttgtcattgatcatgtatgttcataagtaaaattaatacttccagttataaagtttg

SEQ ID NO: 19244 - DNA, 601 bp, Human
gatgattgtatgaagtttgatggagggtcaatgctggtggtggtagtagggatgtgagattggcagggtaggagttgatccctatagggtcaggaaatccgaggaaggaggatgtgaatgagaacatctcatttttacctgaaaatatttgttaatatgctgtgttgtcattgatcatgtatgttcataagtaaaattaatacttccagttataaagtttgtgttggtttccagcctagcaattacatctggtccaggggtaagaagtggagtgaattagatttggcgtatcaccccaatmatatgttaaaaataatatatgtgtgttatgttttcctgttggaaaacatttacatggggagtatttgacccttacaatgactttttgaggaaagtagagtaagaatgattatcacagttaacagatgaggaacctgaggcacagaggagggtaagtgacttgcccaaaattatggaactagtacggcatggggattaggattctaatccacattttagttctatttttccccccaccatgctacaaatgtcttgcacttgtctctttggatgggcgacccactgcttcaaagcaactatg

SEQ ID NO: 19245 - DNA, 601 bp, Human
ctaatccacattttagttctatttttccccccaccatgctacaaatgtcttgcacttgtctctttggatgggcgacccactgcttcaaagcaactatgcttctagaggttctttaagtagtgatatcccgtttctaaattgtttaaggtctgattagtgtttcctaaagcattttagaatctattgtagagtcacccagagaacctgctaaaatgtagattgctgggtccagacccgctgaatttaaatcaaaggtttattgagctatccctaagaatgactcctttcaggcataaaatgataagttggtagatgcaaatttatgatttttagttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcctgtgggaagaaaggctattgtatatttttataaaaatatacaaaagacttggtactggatgtaaagaaagttaagacatact

SEQ ID NO: 19246 - DNA, 601 bp, Human
attgctgggtccagacccgctgaatttaaatcaaaggtttattgagctatccctaagaatgactcctttcaggcataaaatggtaagttggtagatgcaaatttatgatttttagttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcmtgtgggaagaaaggctattgtatatttttataaaaatatacaaaagacttggtactggatgtaaagaaagttaagacatactgttgattaattgtgatttttggatactgtaccgtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaatttgtttataagcag

SEQ ID NO: 19247 - DNA, 601 bp, Human
ttggcacaaaaattatattcattatttttctaacaagcttctaaaagacactgctgctttttgtgacaggcttagaagaccactggtttatgaagttgaattttttgagccacaactatacaaatattaactatgtgatcatagtaatctgaaaatgttggtatttctattactccttcaatctcctgtgggaagaaaggctattgtatatttttataaaaatatacaaaagacttggtactggatgtaaagaaagttaagacatactgttgattaattgtgatttttggatactgtaccrtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaatttgtttataagcagtaactttcatgtggaaaaacaatggtgtatggaatgaaacagcctatgtctactcttcgcctactgggacgagtacaaaccccttaaacttttgaagtctcagttttctcatctc

SEQ ID NO: 19248 - DNA, 601 bp, Human
actccttcaatctcctgtgggaagaaaggctattgtatatttttataaaaatatacaaaagacttggtactggatgtaaagaaagttaagacatactgttgattaattgtgatttttggatactgtaccgtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaawttgtttataagcagtaactttcatgtggaaaaacaatggtgtatggaatgaaacagcctatgtctactcttcgcctactgggacgagtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattg

SEQ ID NO: 19249 - DNA, 601 bp, Human
ctggatgtaaagaaagttaagacatactgttgattaattgtgatttttggatactgtaccgtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaatttgtttataagcagtaactttcatgtggaaaaacaatggtgtatggaatgaaacagcctatgtctactmttcgcctactgggacgagtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcc

SEQ ID NO: 19250 - DNA, 601 bp, Human
ttaagacatactgttgattaattgtgatttttggatactgtaccgtctgctagacatagaacataacaatcagatttggaaggttctaaatccaatacctaattctcataaattgccacagtcccctaaagagtaacaagggggagtcaacataatgaaaagaagaaatttaaaatagaaaggatgtaccttgagatacttctcaaaggttctaatttgtttataagcagtaactttcatgtggaaaaacaatggtgtatggaatgaaacagcctatgtctactcttcgcctactgggacragtacaaaccccttaaacttttgaagtctcagttttctcatctctaaaatgtggatcataaaaaatctcagtactgtgtggttatacaagtcaagagagtgtctgcatgtggaagcacattgtaaatagcctcataaatgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgt

SEQ ID NO: 19251 - DNA, 601 bp, Human
agggggagtcaacataatgaaaagaagaaatttaaaatagaaaggatgtaccttgagatacttctcaaaggttctaatttgtttataagcagtaactttcatgtggaaaaacaatggtgtatggaatgaaacagcctatgtctactcttcgcctactgggacgagtacaaaccccttaaacttttgaagtctcagttttctcatctctaaaatgtggatcataaaaaatctcagtactgtgtggttatacaagtcaagagagtgtctgcatgtggaagcacattgtaaatagcctcataartgtaaggtacagttactattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgtggaaaacctcaaggcatctctttctcatcctgcccgtgtccctgaatggaatgtgattccacttttccccaaatccctataatactttgtctactaaaagttattagcacattttctcatgtatacactgacctgcct

SEQ ID NO: 19252 - DNA, 601 bp, Human
ctattaaggacaagagctcgaatccattcttttcctggatcaaataggcttagcctttattggatcacgaacttcccttctagcctgtgccctttagagtttgagtgagaatgtagtgatgctgcggtgcctgtcatcttcacatgtggaaaacctcaaggcatctctttctcatcctgcccgtgtccctgaatggaatgtgattccacttttccccaaatccctataatactttgtctactaaaagttattagcacattttctcatgtatacactgacctgcctgctgctccataaattkagggcaaggacagaccacatgacactaagactatggactacagagccagactgccaggagttgaatcttgtttcttctacttaacagtagtgtcaccatggctaagtcacttaatctctccagacctcagcacttacagaaagattgctatgaagaggaagtgagttaatatatacaagagactagatcaatgcctgacatattgtaagcactatataaatgccagccctcagaagctttccattcttcccagcatcaagaatagtaagtacaggtttgtggaataacagaatttctaag

SEQ ID NO: 19253 - DNA, 601 bp, Human
aacagaatttctaaggccttcatttagtgtcaagatgacagatagatgatatgtgttgccatttctctgtctgtgccactctttcaagtctgtgtggagtccagtagccactaccaattgattggggtaccatatgagaaaacatttgtttgcctttcatgagctgacatgaactctatctcaaaagcataatgatctaggccatggtagtatatcttaagtgaatcttttttctttttaatttctagttcttcctcctcaaccagaaaacatcaagatttccaacattacacactcctcrgctgtgatttcttggacaatattggatggctattctatttcttctattactatccgttacaaggttcaaggcaagaatgaagaccagcacgttgatgtgaagataaagaatgccaccatcactcagtatcagctcaagggcctagagcctgaaacagcataccaggtggacatttttgcagagaacaacatagggtcaagcaacccagccttttctcatgaactggtgaccctcccagaatctcaaggttggttgaatggacaagtatttacataggattaccgtgcagccctataggca

SEQ ID NO: 19254 - DNA, 601 bp, Human
tctattgggtatcattaggttttcttcattaactcgttaaaacaagacaaacaaaacaaaatatctgatagactgtaagctcttagcatcattgaactttaaagcatttctaggtggggaaattgaggtttagggaggtttagtcactctctcaaagttatacctgtagtaattctccctattattcaacattgttcatttgcttgggattctacttggaaataaaagttgaacaaatgacaactaatgattagcatattgctaattgtaacagcacttttgcatgtttttttttttttttaatcttattacaaccctgtgagtcagactcatctccactgagtttggaatataaatgagtagcccgaggtcatatagtggttaggtggcaggattagggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcat

SEQ ID NO: 19255 - DNA, 601 bp, Human
aaaatatctgatagactgtaagctcttagcatcattgaactttaaagcatttctaggtggggaaattgaggtttagggaggtttagtcactctctcaaagttatacctgtagtaattctccctattattcaacattgttcatttgcttgggattctacttggaaataaaagttgaacaaatgacaactaatgattagcatattgctaattgtaacagcacttttgcatgtttttttttttttttaatcttattacaaccctgtgagtcagactcatctccactgagtttggaatataaatcagtagcccgaggtcatatagtggttaggtggcaggattagggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcatattgcaattgaagagagcaaatgtgcaaaggagaatggcccaagccttccaaaacgt

SEQ ID NO: 19256 - DNA, 601 bp, Human
ctgtgagtcagactcatctccactgagtttggaatataaatgagtagcccgaggtcatatagtggttaggtggcaggattagggctgctgttaagttcccattacactgtgtcttctcccacatacggtgtgggtctgtttctctatgtaaactaaactacctgcttcacctctgtcttcctgcacagcaccagcggacctcggaggggggaagatgctgcttatagccatccttggctctgctggaatgacctgcctgactgtgctgttggcctttctgatcatattgcaattgaagagrgcaaatgtgcaaaggagaatggcccaagccttccaaaacgtggtagtgtctcatcttcctactagctaataagggcaagtccaagtacaggcagaaccttcactttaaagatatggaccaggaaatttacttataaagtaaatatttcccttaggcaagcctcatcttctctttggctttcattatgaaatgggagataaaaagtatgactttataatttcttatccaaaccagaacaattttgagagtgaaaagggtgctcttagtaaattatgcaggaaactaggtctgcccctgcct

SEQ ID NO: 19257 - DNA, 601 bp, Human
atgctgcttatagccatccttggctctgctggaatgacctgcctgactgtgctgttggcctttctgatcatattgcaattgaagagagcaaatgtgcaaaggagaatggcccaagccttccaaaacgtggtagtgtctcatcttcctactagctaataagggcaagtccaagtacaggcagaaccttcactttaaagatatggaccaggaaatttacttataaagtaaatatttcccttaggcaagcctcatcttctctttggctttcattatgaaatgggagataaaaagtatgactttwtaatttcttatccaaaccagaacaattttgagagtgaaaagggtgctcttagtaaattatgcaggaaactaggtctgcccctgcctgctgaaatgagacatatggtcatcctagtagtaagtccccagagatgatatcttgcaacagaataaattgaacatttttggtaaggaaggacagagggtaaccagacctcagtgagataggtaatgacgtaatatattagacaagttttcctcacatttgcctatttccagttcccatttctttctagtaagtccctcaatcttatcacccctc

SEQ ID NO: 19258 - DNA, 601 bp, Human
accagaacaattttgagagtgaaaagggtgctcttagtaaattatgcaggaaactaggtctgcccctgcctgctgaaatgagacatatggtcatcctagtagtaagtccccagagatgatatcttgcaacagaataaattgaacatttttggtaaggaaggacagagggtaaccagacctcagtgagataggtaatgacgtaatatattagacaagttttcctcacatttgcctatttccagttcccatttctttctagtaagtccctcaatcttatcacccctcgtatgtgtaagaattrtatatacctgtgtgtgtcttccattcctgtgtaccctcagtctgaagtcagagttcctggcacttggtactgcctcattttttttttcatctaggaattctaaccagtagcaaaggcctataaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgag

SEQ ID NO: 19259 - DNA, 601 bp, Human
tgcctcattttttttttcatctaggaattctaaccagtagcaaaggcctataaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgagtccccgagtttcccttccacggaggacaagaggaacttcactatctgactccatgccagagctggctcaaytcaggctgtcgctggagaagaagggccagcaagggggttgggagtgctggagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcaccctgtggctgccccacataggctctccaagttagt

SEQ ID NO: 19260 - DNA, 601 bp, Human
taaaaatcacactttaccaagaggcatcttatttgagttcttttggtatactaaagcctgaaaatgtatctagtttgtgggttcaggccctgtaaaattaatttgaaccagactttatcaattctgtatataatgcattgagtgcaatgattcaaatgaggtgtaccccatgtgcatgagtccccgagtttcccttccacggaggacaagaggaacttcactatctgactccatgccagagctggctcaactcaggctgtcgctggagaagaagggccagcaagggggttgggagtgctggagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcaccctgtggctgccccacataggctctccaagttagtttccaaaccagaactgaacgcttgctcatttcacaacactgtagggaact

SEQ ID NO: 19261 - DNA, 601 bp, Human
cttcactatctgactccatgccagagctggctcaactcaggctgtcgctggagaagaagggccagcaagggggttgggagtgctggagcctgtcaaaataccggtgctttttcatggtagcaccagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcaycctgtggctgccccacataggctctccaagttagtttccaaaccagaactgaacgcttgctcatttcacaacactgtagggaactcacgtacaactaacgcaaggatggcaaacacatggaatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttt

SEQ ID NO: 19262 - DNA, 601 bp, Human
accagcagctatttgaattcaggagaaagagatactgtgttgggtttggctctaagcttcaatcatcttgtggccagagtggacttagagattctaagccttactacgagagagaaagagtgtgcactaaaaatagagtaggatcaagataatgctaagaaagctctcactgaggcgcaccctgtggctgccccacataggctctccaagttagtttccaaaccagaactgaacgcttgctcatttcacaacactgtagggaactcacgtacaactaacgcaaggatggcaaacacatggmatatgtactgttactccttcctccgtcaccctttacagacattgctaatcaacaggcttttctggggaggcccagaattgtgcccgtgcagccctgtgggcagctggtttatcagggcagtcctgtgtgatgaaaacctatttccctttccagtctagaattaaatacagtatttcttttttcatctggtgtggatgccaaccagaagacattatgccccttagaattatgaaaaatcctgacacaaaatgatgaaataattatttttccagagggaagaaccagctgtgcagttcaact

SEQ ID NO: 19263 - DNA, 601 bp, Human
gagttttggggagcagtgaggatagtgagaggagaggggtgtagaatcttatgaaggcagtttttattgggatctattgtgagcctgattttctaccttgtgcccatgtgaagagggaaaatagcttaataaggcaccagggcagataaatcctgcaggcaaagcagtgcatccaaagaagggcagttactgaagtggacaacctcactataaagaactttaaaaaaatattcccaagatattgaccctccatgaggcttctgtagtatgaacagagcacttgacttatgagtaccattaktccctcatgagatgattgtcacagtttctaagcatgagcagccatgtttatggccaccagcacctcactcctttccttgccacccaatgtgtgtttttttttttaaagcagccatagctcattgtccctgactcaagactgatcagtttatgcaccaaccaatagccttctcttcattctggtgcctgctgtgttctccctctggttaaagtgctagtggagagacaaggcaaaaagaatagaagcagatgcaactcagtttcctgattcccatgcaacttccataagataccatttgga

SEQ ID NO: 19264 - DNA, 601 bp, Human
acagactaaaccagttttctggaaaaaggctaaaactacaaagaagactgtgctgaggctttagtgttgaccccactgcagatctaagagaatgctggctcttaagggatccaggcactttgcactaggaggagataagaagagaaatggccagttgatccagttctaagtttcagcttttgttttattctgaggacaataaaatcttgaggttacgtttacttcatctggttgcagttggtctttagggagagaataaaccatgatattaatgcagcttccttcttgggaaaaaaaaccrcaacaacaaaaatatatcccttaaaattttgcttcgtcatcacattagcacatagctggctcttaaaattttaagataggccgggcgtggtggctcacgcctataatcccagcactttgggaggccgaggcaggcagatcacaaggtcaagatgtcgagaccatcctggccaaccaacatggtgaaaccctgtctctactaaaaatacaaaaaattaactgggcctagtggcgcatgcctgtagtcccagctactcgggatgctgaggcaggagaatcgcttgaacctgggaggcggagg

SEQ ID NO: 19265 - DNA, 601 bp, Human
atatttaaattattttaaaataattcagtaaagatgtgagaaagcacatgtataccataatttaggtctaactttcattatagtgcaacaggtttcaatattacttttcttttttgctagaatttcaatttcttagaagatctttcaagcttttttttttttttttttttttgagatagatagatagggtctcactctgttgcccagtctggagtgcagtagcacgatgtcagcccactgcaacctccccatccctgggctcaagcagtcttcccacttcagcctaagtactcccaagtakctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgttttta

SEQ ID NO: 19266 - DNA, 601 bp, Human
cacttcagcctaagtactcccaagtagctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaat

SEQ ID NO: 19267 - DNA, 601 bp, Human
cttcagcctaagtactcccaagtagctgggactacagggatgcaccaccatgcttggctaatttttattttatttttattttttgtagagattaggtctcagtatactgcccaagctggtctcaaactcctgggctcaagcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttastaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatat

SEQ ID NO: 19268 - DNA, 601 bp, Human
agcaatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaaragagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacat

SEQ ID NO: 19269 - DNA, 601 bp, Human
caatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagaragagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgc

SEQ ID NO: 19270 - DNA, 601 bp, Human
aatccatctgccttggcctcccagagtgccgggattacaagtgtgagccactgcactgggcttcaagttctaattcatacatcattttaaaaacatggtttgcccaaaaaattcttctttaaaaaaaaccagtaaaataactttaactttacatttttagtaggtataaatgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcc

SEQ ID NO: 19271 - DNA, 601 bp, Human
tgtcgatgtttttagcaagtaaattccctttaaaaaaattttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttagkatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatg

SEQ ID NO: 19272 - DNA, 601 bp, Human
attttcgcaaggggataatttattttttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacarttacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcag

SEQ ID NO: 19273 - DNA, 601 bp, Human
ttaaaaattccaagaaaacaaaagtaacaaaactgggcaaataacgttttattaaaaaaaaaaagagagagagaaatgatgtggaacaaaaaagtgacaatgaaccataagtttttctaggaactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatrgatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcagga

SEQ ID NO: 19274 - DNA, 601 bp, Human
aactattgttttattttttcctaaaagcttgagttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgaygtgaagaacgtgtctgagatctggaagagcatgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcaggagggtgtcacccgtcttcctcctgtcccccagtgctccctgggtggtgttgctagatgtgttttttagacaaaatggagtttataggcaatttccacagcacatctcttaaatgtcatagct

SEQ ID NO: 19275 - DNA, 601 bp, Human
gttttctggtatcttgaagcaaaatgcaatctttgaaactaacctctggtggccagagacccaatcagcaatatggtgacttaggatgggttttgaggaggagtagaaggcaggagagacaattacctgttgtggctccttccacatggatatttaattgttgaaaaataataacaacctcaggaatagctagaggcagactagaataacatgcctggctcatgttactaagctccttgatcaaaatggaatgcaaatgaaaaggtgacgtgaagaacgtgtctgagatctggaagagcakgctttgactcactctactgttattactgagtgggtaaaagcatttcaggaagccctctgtgtgagtgcaggtttggtaggaatggagagggggtgggaaggagcaaaaccaagcgttgcagcctggccccttttgagtattgcaggagggtgtcacccgtcttcctcctgtcccccagtgctccctgggtggtgttgctagatgtgttttttagacaaaatggagtttataggcaatttccacagcacatctcttaaatgtcatagctgttcagggccactgatgagtcgatgctctctt

SEQ ID NO: 19276 - DNA, 601 bp, Human
gggccactgatgagtcgatgctctcttccttccctccaggctacttgtacctggccattgagtacgcgccccatggaaaccttctggacttccttcgcaagagccgtgtgctggagacggacccagcatttgccattgccaatagcaccgcgtccacactgtcctcccagcagctccttcacttcgctgccgacgtggcccggggcatggactacttgagccaaaaacaggtttgtccggaggacttcgctttggatatctttcctgtggagttccctctaaagtcagtttcaatatgttygtagggtctgtcaacctctcttctttaactccttcttaaaatctccctcattttaatctctctgtgaatagtccatctatttaaagaaaaattagtactgacaatatgtttatctagcaattttcataattatgaaaattgtataattttcttctatctaatttcatatatgcaaattttataattttcctaatacgtagcgaggtaccttaagctctcttagcctggtttgcctctaaataatgtgtaataacagagacacactacattacagctggaggatttaacaacctgtgtttt

SEQ ID NO: 19277 - DNA, 601 bp, Human
cgcaagagccgtgtgctggagacggacccagcatttgccattgccaatagcaccgcgtccacactgtcctcccagcagctccttcacttcgctgccgacgtggcccggggcatggactacttgagccaaaaacaggtttgtccggaggacttcgctttggatatctttcctgtggagttccctctaaagtcagtttcaatatgtttgtagggtctgtcaacctctcttctttaactccttcttaaaatctccctcattttaatctctctgtgaatagtccatctatttaaagaaaaattartactgacaatatgtttatctagcaattttcataattatgaaaattgtataattttcttctatctaatttcatatatgcaaattttataattttcctaatacgtagcgaggtaccttaagctctcttagcctggtttgcctctaaataatgtgtaataacagagacacactacattacagctggaggatttaacaacctgtgttttttatttgttcgttttctgaaattcttctgccaagatgtggtgtgtcatttggcagaatccattaccagggaattttggaggggaactttaaggga

SEQ ID NO: 19278 - DNA, 601 bp, Human
aaaatttcagtttatccacagggatctggctgccagaaacattttagttggtgaaaactatgtggcaaaaatagcagattttggattgtcccgaggtcaagaggtgtatgtgaaaaagacaatggtaagtgccagacacagacactgatcgcatcctttccgaggtactcccctgtctcctgatgttgcttctgagactgtcagtgctctgtggtgactgaagcatctgactgtatgtcccagtagatactgtgtgccctgggaaacattctttctaaatgttggttcctaacatgattgyagcatctgcattaattaataatgaagaaggcactgtcatgtgtgaccaagtgattgaatgttcaaacctagtggtttggggtcttggttctatccagtccagaccccaaggcatctcactcaggaacctctgaggagcttgcacaatcccctttcatgcacagctgacacagcaaggaaaaaaattaacatattttccaaaagtcaagaagacaaactaaatggtttctaaatcaccaggaggctctacagagaaattcataacttctacaggctcatctaagatttctctcttcactga

SEQ ID NO: 19279 - DNA, 601 bp, Human
gtaagtgccagacacagacactgatcgcatcctttccgaggtactcccctgtctcctgatgttgcttctgagactgtcagtgctctgtggtgactgaagcatctgactgtatgtcccagtagatactgtgtgccctgggaaacattctttctaaatgttggttcctaacatgattgcagcatctgcattaattaataatgaagaaggcactgtcatgtgtgaccaagtgattgaatgttcaaacctagtggtttggggtcttggttctatccagtccagaccccaaggcatctcactcagraacctctgaggagcttgcacaatcccctttcatgcacagctgacacagcaaggaaaaaaattaacatattttccaaaagtcaagaagacaaactaaatggtttctaaatcaccaggaggctctacagagaaattcataacttctacaggctcatctaagatttctctcttcactgaaacctcaatggtcactattcaaacccaaataaaatccactctcccaaacagtaatattttatctttaagtacaagattgcaggagaacctaaccatacagtcttagaggaagagagatactcat

SEQ ID NO: 19280 - DNA, 601 bp, Human
aacaatactcaagaacattttgaaaggaaatcacccataattcaccaccttggcatatatatttttttcattttggcttattgcctttcacagcatacatccttttacatagctacaaccacagtgaacgtaatcattttggatctttccactctcctttctgatgagggtgtgaagctgggtccctttggctcttcgagggccctgcatgcttatcaacatcaacactttcagaagccatgtgtgcctccctgagggctggcttccaggtgatgcttttctccctaaccttttcaggcayactcaaagcagatgcttctctggagcaggggtgggcttgttttcttaaagaagcagaatccatcactcacctacctactccagccttcccaactcctccctcaccacctggtgtcctcaaatctccttcctgaaatccttttccctgctttcctccagcacttgggggatgtgggtaccctgggtgagaaggtggagggataacacaggataactccacaatctacccattctatttggatgctctcctcagcctcccaagactagcactggtttgcttggcatttcataaagggcagtg

SEQ ID NO: 19281 - DNA, 601 bp, Human
ctcctagagaacacagtggctaccttctctggcagccaattttaaaatcagattttcaattctcattgtacttcaaagcatctgcattttttaaagatccccagatgattgagtcctatcctgtggatattctgattcaattggtctagggtgagaaccctgcattagggttttttttttttttttaagttacccagggtgattttaatactggaagtattactgcaaactactatactaagcaatttggggtttcactatcatagattaatatatccatcccgtcatcatggatttgttrgtacaatgtttcatgcttgtgctagattttggggtaacataagtcagacacagtctccaccttcaaagagctcgtagacatatgactcaggattgtaacagttgataaatgcaaagagcaaggaaagcataggtgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctag

SEQ ID NO: 19282 - DNA, 601 bp, Human
tgtggatattctgattcaattggtctagggtgagaaccctgcattagggttttttttttttttttaagttacccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagttgataaatgcaaagagcarggaaagcataggtgctacgggaacacaaagaaggtgcactgaaccaagctgaaaggaagttaaggagggcttcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagt

SEQ ID NO: 19283 - DNA, 601 bp, Human
cccagggtgattttaatactggaagtattactgcaaactactatactaagcaatttggggtttcactatcatagattaatatatccatcccgtcatcatggatttgttagtacaatgtttcatgcttgtgctagattttggggtaacataagtcagacacagtctccaccttcaaagagctcgtagacatatgactcaggattgtaacagttgataaatgcaaagagcaaggaaagcataggtgctacgggaacacaaagaaggtgcactgaaccaagctgaaaggaagttaaggagggcytcctggaggaggtcaaatcctgagtttcatagtaaatgttagataggcagtgaggatgtgagaataagttggatgagctggaggacacagtacatacagaacccctagaggaaaaggaaagcatgaaacctttaggagatgtttaagtaattcactatggctgggggtgtattgcagagaggaagggagagttaaacttcagggttggaagaggaagcaaggataaagtcctgaagggccttgaattccagctaaggatttgggatcttggaaccatagggacattaaagaattttaagg

SEQ ID NO: 19284 - DNA, 601 bp, Human
ggaccccgaaagataaataggacttatactatttgcatgttttgaaatttgaaaacacatgtagctgggacatacacaaagcaatgatttctgagtctacccagcaatcatttgtggagccacagctcaggcaggctgagagcctcttaaagaccctgtcccagttaagtgaaatctcactttgttctctccagggaaggctcccagtgcgctggatggccatcgagtcactgaattacagtgtgtacacaaccaacagtgatgtgtgagtaaacttcttattgccaagggattttttttyccctcccagaaacatatatatttgacagagattttaaaaagatacaggaatgtcctgtacctctcgggaacaaaggtaactaaaaagctcaggaaataaattagcagaataaagccacagagtagacagtttccagaggagtgcagaatcacttgcggcaggttttgggtttccctctgcatactgaagttgtgtattccgcatgtgcttcaagttgcgaattctcggactcaacaggaagaagggacataccggccttcctgtggctcctctcccagacctagatcagaggaagcaacc

SEQ ID NO: 19285 - DNA, 601 bp, Human
ggacttatactatttgcatgttttgaaatttgaaaacacatgtagctgggacatacacaaagcaatgatttctgagtctacccagcaatcatttgtggagccacagctcaggcaggctgagagcctcttaaagaccctgtcccagttaagtgaaatctcactttgttctctccagggaaggctcccagtgcgctggatggccatcgagtcactgaattacagtgtgtacacaaccaacagtgatgtgtgagtaaacttcttattgccaagggatttttttttccctcccagaaacatatayatttgacagagattttaaaaagatacaggaatgtcctgtacctctcgggaacaaaggtaactaaaaagctcaggaaataaattagcagaataaagccacagagtagacagtttccagaggagtgcagaatcacttgcggcaggttttgggtttccctctgcatactgaagttgtgtattccgcatgtgcttcaagttgcgaattctcggactcaacaggaagaagggacataccggccttcctgtggctcctctcccagacctagatcagaggaagcaacccagaatagctgctggggac

SEQ ID NO: 19286 - DNA, 601 bp, Human
ggtcccaagaggttcagcaactgtttccaggtcacataagtattgggtggcagagattggatttaactcagatctgtcaagctccacaacaaatttcatctgttttggacagtaccaccttgtagtctctagttaaagtgatttgggggctctggcaaagtgaacactgtttctttgttgtaacccttccattgagctaagaggagagaaacctacactgtgtgcaagggcctatcctaggatgtagacatttaacatctccttttctcagaaagggtgggtctccctggcttttggggcmggaaaatgagtggtgactctgtttgctgattgttggtttcacacttgtccctcctgcagatggtcctatggtgtgttactatgggagattgttagcttaggtgagtatctatgtttatctaccaggtgagactctaggcaaagtgagtggaagcctctagcactcccttgctgcataattccacaggatgccgtttgtatgtggttctaccagatgtgacttggaaatagaaacatagtgtatttattcccatatttttctttttaaaagccttatacctaacgtcatatttaacactaa

SEQ ID NO: 19287 - DNA, 601 bp, Human
agacatttaacatctccttttctcagaaagggtgggtctccctggcttttggggcaggaaaatgagtggtgactctgtttgctgattgttggtttcacacttgtccctcctgcagatggtcctatggtgtgttactatgggagattgttagcttaggtgagtatctatgtttatctaccaggtgagactctaggcaaagtgagtggaagcctctagcactcccttgctgcataattccacaggatgccgtttgtatgtggttctaccagatgtgacttggaaatagaaacatagtgtattwattcccatatttttctttttaaaagccttatacctaacgtcatatttaacactaatgacctggaggccatgaactttattatatattaattggctccgcttgtacaagttgccaggttaacttctaaaactcttagattatgcagctattaaaagtcacatttttgaaagccatttaatagcatgtgaaaatatgtaataatttcatgtataccctgatcctagttttatcaatattgcatattttaaaaaactggaaggcactacacagaaaggtaataacatttattcttcatgcttt

SEQ ID NO: 19288 - DNA, 601 bp, Human
taaaagccttatacctaacgtcatatttaacactaatgacctggaggccatgaactttattatatattaattggctccgcttgtacaagttgccaggttaacttctaaaactcttagattatgcagctattaaaagtcacatttttgaaagccatttaatagcatgtgaaaatatgtaataatttcatgtataccctgatcctagttttatcaatattgcatattttaaaaaactggaaggcactacacagaaaggtaataacatttattcttcatgctttttaatgtggtacatatacamcatggaatactatgcagccacaaaaaagagaggaatgagttcgtgtcctttgcaggaccatggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaacc

SEQ ID NO: 19289 - DNA, 601 bp, Human
ctggaaggcactacacagaaaggtaataacatttattcttcatgctttttaatgtggtacatatacaccatggaatactatgcagccacaaaaaagagaggaatgagttcgtgtcctttgcaggaccatggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcwttaggacaaatacctaatgtatgtggggcttaaaacctagatgatgggtcgataggtgcagcaaaccacccaccatggcacatgtatctcagaacttaaaatttaaaaaactgttctacaataaaccaacatgcatggcttttgtaattaaaaaactggccataactatcattgataaaatatgagttataaaactatggacttccaatcagaaaaaaaggttaatcttattggtataataaaggttaatcttattggtataatagatgtgctttgtgtggggagacttagaacaggcac

SEQ ID NO: 19290 - DNA, 601 bp, Human
atggatgaagctagaaaccatcatcctcagtaaactaacacaggaatagaaaaccaaacaccacatgttgtcactcataagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaaccacccaccatggcacatgtatctcagaacttaaaatttaaaaaactgttctacaataaacmaacatgcatggcttttgtaattaaaaaactggccataactatcattgataaaatatgagttataaaactatggacttccaatcagaaaaaaaggttaatcttattggtataataaaggttaatcttattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctct

SEQ ID NO: 19291 - DNA, 601 bp, Human
aagtgggggttgaacaatgggaacacatggacacagggaggataacatcacacactagggcctgtcagagggtagggaacaaggggagggagagcattaggacaaatacctaatgtatgtggggcttaaaacctagatgatgggtcgataggtgcagcaaaccacccaccatggcacatgtatctcagaacttaaaatttaaaaaactgttctacaataaaccaacatgcatggcttttgtaattaaaaaactggccataactatcattgataaaatatgagttataaaactatggacttscaatcagaaaaaaaggttaatcttattggtataataaaggttaatcttattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctcttgccataccatgtcttcctcctggccccttatatttagaaaccctggacaggaagcattgcttttcatgccagagagg

SEQ ID NO: 19292 - DNA, 601 bp, Human
tattggtataatagatgtgctttgtgtggggagacttagaacaggcactaaggaagcctgtggtggttccttcccctgaagcaatgatcatgctttggcatagtctatagtgtaagcccagctttgatgtgcagtgagtttgccaagggaggcatgcaggatgctcaccctctcttgccataccatgtcttcctcctggccccttatatttagaaaccctggacaggaagcattgcttttcatgccagagaggacttagagtggcactgtttgtcttccaggaggcacaccctactgcggratgacttgtgcagaactctacgagaagctgccccagggctacagactggagaagcccctgaactgtgatgatgaggtgtaagtcaggcctcatcctggggctattttgtcttaccttccccctgtgtgtttctggggccagctgactctagcaaagtcagccggtatacactatacacaaacacctacacacagagatcccaaataggaacccctccccttttattcacctaatactgttatataatacacaagaagtattagctttacaggcatagaaattcaggaggaatttaatgac

SEQ ID NO: 19293 - DNA, 601 bp, Human
ctgaaacaaattctttaaacatacaacactatccttggggataaagatttcaaagctgttcattaagattaagaaggatacattttcgggctggcaagatggctgaataggaacagctccagtgtgcaactcccagtgagatcaacgcagaaggcaagtgatttctgcatttccaactgaggtacccggctcatctcatagggactggttagacagtgggtacagcccatggagggtgagctgaagcctcacctgggaagcgcaaggggttggggaactcccttcctagcgaaggagggayggtgccatgacgaatggtgcattccagcccagatactaagcttttcccacagtctttgcaacctgcagaccaggagattccctctggtgcctatgccaacagggccatgggttgcaagcaccaaactgggtggccatttcggcagacaccaagctagctgcaggagtttcttttcataccccagtggcacctggaacaccagcaagtaagaactattcactcccctggaaagggggctgaagccagggagccaagtggtctagctcagtggagcccatcaagctaagatccactggcttg

SEQ ID NO: 19294 - DNA, 601 bp, Human
agtttcttttcataccccagtggcacctggaacaccagcaagtaagaactattcactcccctggaaagggggctgaagccagggagccaagtggtctagctcagtggagcccatcaagctaagatccactggcttgaaattctcgctgcaagcacagcagtatgaagttgacctgggggaggacgctccagcttggtgaggggagaggcatctgccattactgaggcttgagtaggcggttttcccctcacaatgtaaaaaaagtcacagggaagttcgaactgggtggagcccaccgccrctcctcaaagccactatagccagactgcctctctagattctttctatctgggcagggcatctctgaaagaaaggcaacagccacagccaggggcttatagataaaactcccatctccatgggacaaagcacctagtggtaagggtggctgttggtgtagcttcagcagacttaaacgttcctgcctgccagctctgaagagagcagtggatctcccagcacagcacttgagctctgctaagggacagactgcctcctcatgtgggtccctgacccgacccctgtgctccctgactgggag

SEQ ID NO: 19295 - DNA, 601 bp, Human
cccagtggcacctggaacaccagcaagtaagaactattcactcccctggaaagggggctgaagccagggagccaagtggtctagctcagtggagcccatcaagctaagatccactggcttgaaattctcgctgcaagcacagcagtatgaagttgacctgggggaggacgctccagcttggtgaggggagaggcatctgccattactgaggcttgagtaggcggttttcccctcacaatgtaaaaaaagtcacagggaagttcgaactgggtggagcccaccgccgctcctcaaagccacyatagccagactgcctctctagattctttctatctgggcagggcatctctgaaagaaaggcaacagccacagccaggggcttatagataaaactcccatctccatgggacaaagcacctagtggtaagggtggctgttggtgtagcttcagcagacttaaacgttcctgcctgccagctctgaagagagcagtggatctcccagcacagcacttgagctctgctaagggacagactgcctcctcatgtgggtccctgacccgacccctgtgctccctgactgggagacatctcccagtagg

SEQ ID NO: 19296 - DNA, 601 bp, Human
gaaaccagtgcaaaaccgctgaaaattccaaaaaccagaatgcctctcctcctccaaaggatcacaactccttgccagcaagggaacaaaactggacgaatgagtttgacaaactgacagaagtaggcttcagaaggtgggtaataacaaactccttcaagctaaacgagcatgttctaacccaatgcaaggaagctaagaacgttgaaaaaaggttagatgaattgcaactagaataaccagtttagagaagaacgtaaatgacctgatggagctaaaaatcacagcacgaatacttctwgaagcatacacaagtatcaatagctgaatggatcaagtggaagaaaggatatcagatactgaagatacacttaaagcatgaagacaagattagagaaaaaataatgaaaaggaatgaacaaagcctccaagaaatacgagactacgtgaaaagaccaaacctgaaagtgatggggagaatggaaccaagttggaaaacactcttcaggatatcacccaggagaacttccccaacctagcaagacaggccaacattcaaattcacaaaatacagagaccaccccaaagatactccttgaga

SEQ ID NO: 19297 - DNA, 601 bp, Human
gagtttgacaaactgacagaagtaggcttcagaaggtgggtaataacaaactccttcaagctaaacgagcatgttctaacccaatgcaaggaagctaagaacgttgaaaaaaggttagatgaattgcaactagaataaccagtttagagaagaacgtaaatgacctgatggagctaaaaatcacagcacgaatacttctagaagcatacacaagtatcaatagctgaatggatcaagtggaagaaaggatatcagatactgaagatacacttaaagcatgaagacaagattagagaaaaartaatgaaaaggaatgaacaaagcctccaagaaatacgagactacgtgaaaagaccaaacctgaaagtgatggggagaatggaaccaagttggaaaacactcttcaggatatcacccaggagaacttccccaacctagcaagacaggccaacattcaaattcacaaaatacagagaccaccccaaagatactccttgagaagagcaaccccaagacacataaatcgttagattcaccaaggttgaaatgaaagaaaaaatgttaagggcagccagagagaaaggtcaggttacccacaaag

SEQ ID NO: 19298 - DNA, 601 bp, Human
taacgtgcaaagatacacataggctcaaaataaagggacagaggcatatttaccaagcaaatggaaagcaataaaaaaaagcaggggttgcaatcctagtctctgataaaacagactaaaccaacaaagatcaaaagagacaaagaaggacattacataatggtaaagggatcaatgcaccaagaacagctaactaactatcttaaatatatatgcacccaatgcaggagcacccagattcttaaagcaagttcttagagacctgcaaagagacttaaagtctcccactattattgtgaggagtcttaacaccccactatcaatattagacggatcaatgagacagaagattaacaaggatattcaggacttgaattcagctctggaccaagtagacctaatagacatctacagaactctccaccccaaatcaacagaatatacattcttctcagcacctcatcacacttaaagctgaccacataactggaagtaaaacattcctaagcaaatgcgaaaaaacggaaatcataacagtttcttagaccacagtgcaatcaaattagaactcaggattaagaaactcactgaaaaccacaca

SEQ ID NO: 19299 - DNA, 601 bp, Human
gcaatcaaattagaactcaggattaagaaactcactgaaaaccacacaactacatggaaactgaacaacctgctcctgaatgactactgggtaaataacgaaatgaaggcagaaataaagatgttctctgaaaccagtgagaacaaagacacaacataccagaatctctgggacacatttaaagcagtgtgtagagggaaatttatagctctaaatgcccacaggagaaagcaggaaagatctaaaattgacaccctaacatcacaattaaaagaactagagaagcaacagcaaacaaatkcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatggataaattcatgga

SEQ ID NO: 19300 - DNA, 601 bp, Human
taacatcacaattaaaagaactagagaagcaacagcaaacaaatgcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctaygcaaataaactagaacatctagaagaaatggataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaac

SEQ ID NO: 19301 - DNA, 601 bp, Human
aacagcaaacaaatgcaaaaactagcagaaggcaagaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatrgataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaacctggcagagacacaacaaaaaagaaaactt

SEQ ID NO: 19302 - DNA, 601 bp, Human
agaaataactaagatcagagcagcattgaaggagacagggacatgaaaaacccttcaaaaaaaatcagtgaatccaggagctagttttttgaaaagataacaaaatagactgctagccagactaatgaagaagagagagaacaatcaaatagatgcaacaaaaatgataaaggggatatcaccactgatcccacagaaatacaaactaccatcagagaatactataaacacctctacgcaaataaactagaacatctagaagaaatggataaattcatggacacatacatcctcctatgtytaaaccaggaagaagtcgaatcccagtcgaagaccagtaacaagttctgaaattgaggcagaattaatagcttacctaccaaaaaaagtccaggaccagacggatccacagctgaattctaccacaggtacaaagaggagctggtaccattccttctgcaactattccaaacaatagaaaaagagggatctttcctaactcattttatgaggtcagcatcatcctgttacccaaacctggcagagacacaacaaaaaagaaaacttcaggccaatatccctgatgaacattgatgcgaaa

SEQ ID NO: 19303 - DNA, 601 bp, Human
gaacaatcaaatagatgcaacaaaaatgataaaggggatatcaccactgatcccacagaaatacaaactaccatcagagaatactataaacacctctacgcaaataaactagaacatctagaagaaatggataaattcatggacacatacatcctcctatgtttaaaccaggaagaagtcgaatcccagtcgaagaccagtaacaagttctgaaattgaggcagaattaatagcttacctaccaaaaaaagtccaggaccagacggatccacagctgaattctaccacaggtacaaagagragctggtaccattccttctgcaactattccaaacaatagaaaaagagggatctttcctaactcattttatgaggtcagcatcatcctgttacccaaacctggcagagacacaacaaaaaagaaaacttcaggccaatatccctgatgaacattgatgcgaaaattctcaataaaatactgggaaacagaatccagcagcacatcaaaaagcttatccaccatgatcaagtctgcttcatccttgggatgcaaggctggttcaacatatgcaaatcaataaacataatccatcatctaaac

SEQ ID NO: 19304 - DNA, 601 bp, Human
ctgtctgcagatgacatgattgtatttctagaaaaccccattgtctcagcccaaaatctctttaagctgataagcaacttcagcaaagtctcaggatacaaaatcagtgtgcaaaaatcacaagcattcctatacaccaatagcagacaaacagagagccaaaccatgagtgaactctcattcacaactgctacaaagagaataaaatatctaggaatccaacttacaagggatgtgaaggacctcttcaaggagaactacaaaccactgctcaaggaaataagagaggacacaaacaaayggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtactaaaacagatatatagaccaaaggaacaagacagaggcct

SEQ ID NO: 19305 - DNA, 601 bp, Human
atagcagacaaacagagagccaaaccatgagtgaactctcattcacaactgctacaaagagaataaaatatctaggaatccaacttacaagggatgtgaaggacctcttcaaggagaactacaaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccmaaaaagagcctgcatagccaagacaatcctaagcaaaaagaacaaaactggaggcatcaagctacctgacttcaaactatactacaaggctacaataaccaaaacaggatggtactggtactaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccc

SEQ ID NO: 19306 - DNA, 601 bp, Human
aacttacaagggatgtgaaggacctcttcaaggagaactacaaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatrctacaaggctacaataaccaaaacaggatggtactggtactaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaaga

SEQ ID NO: 19307 - DNA, 601 bp, Human
aaaccactgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtacyaaaacagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaagaaaacctgggcaataccattcaggacataggcatgggcaaag

SEQ ID NO: 19308 - DNA, 601 bp, Human
actgctcaaggaaataagagaggacacaaacaaatggaaaaacattccatgctcatggacaggaagaatcaatattgtgaaaatggccacactgcccagtgttatccccatcaagctaccattgactttcttcacagaattagataaaactgctttaaatttcatatggaaccaaaaaagagcctgcatagccaagacaatcctaagcaaaaagaacaaaactggaggcatcaagctacctgacttcaaactatactacaaggctacaataaccaaaacaggatggtactggtactaaaasagatatatagaccaaaggaacaagacagaggcctcaggaataacaccacacatctacaaccatctcatctttgacaaacctgacaaaaacaagcaatggggaaaggattccctatttaataaatggcgttgggaaaactggctagccatatgcagaaaactgaaattggaccccttccttacaccttataaaaaattaactcgagatggattaaagacaaacgtaaaatctaaaaccataaaaaccctagaagaaaacctgggcaataccattcaggacataggcatgggcaaagacttc

SEQ ID NO: 19309 - DNA, 601 bp, Human
tctaagagtgaaggaggttgttaatctcactggagcaagaagcatacataccatcctggaaaaacctggacatagttggaccatcactagacagtccctaaaattctaccttttgagattcacttcataaggggtgagaagattttttagtctttaagaaacttatgttaaagtataagctgttctgggatctgtgacaccctaagccaatggttgatagccttccatgcacataaggttccccagagtcatttgttcagcatgtgggctcttggtccccactgtcagtcattgattctgyaagtttagggcaggttccagaattctgcattttaataacagagtagttctgagcacaactgagtaagcactgtcttaggtcagtgtttcccaaactatgttttcacgtgttgtgcaagatataaatacatgatgcaaggggaaaggagttctgcggtcaattactttggaaactttgtgttaaacctgttgtcttagtcatttccggctgctgtaacaacataccataaacatggtggcttataaacaacagagatgtatttctcacagttctgaaggctgggaaatccaagatcaaagc

SEQ ID NO: 19310 - DNA, 601 bp, Human
tggtttcaacacatgatttttgggtggcatgaacattcagtccatagcacctggttaaacaggcatttttttgtttttaatgacagtgcttctaaaagtcctgcctcttaaagggactttatgtgggtggcattttacaagtttgagcatgggccctttaagagacactaacattttgaaatatgcagcattccaaggcaaatgctgctctagacacatacccagttctttctagatgattgcaatagctgagaccaaggtcctgcagaaacagtaccgagggtaggaactaaatctatgrggagttgaaatgagactggcttagggaggtgggagtcctcatagaaacttcctaggggctgtactttggttaagcttcataaccatgcattgggtggcttcattctctcctctcttttcctgccgtgcctaggactgaagcacagttatagaattaaccctttaattctttgctttcgaaggtatgatctaatgagacaatgctggcgggagaagccttatgagaggccatcatttgcccagatattggtgtccttaaacagaatgttagaggagcgaaaggtaagtattaaagtcaggc

SEQ ID NO: 19311 - DNA, 601 bp, Human
aacatctaaaaatagacttaaatctcattgcttacaagcctaagaatctttagagaagtatacataagtttaggataaaataatgggattttcttttcttttctctggtaatattgacttgtatattttaagaaataacagaaagcctgggtgacatttgggagacatgtgacatttatatattgaattaatatccctacatgtattgcacattgtaaaaagttttagttttgatgagttgtgagtttaccttgtatactgtaggcacactttgcactgatatatcatgagtgaataaatrtcttgcctactcacgtctcatccaggagtgtgtctcatagctattgccacatgtccttattatactttaaagaaaaatcgtttaaattatccatccctagcacctagagtagtgcgagtatactccaccagttacggaatctgaagctcatcagattgaaaaggtctcctagaagtgttctactgcttatttctttttcttgcaacaggcagtacacctttgggagtgttccagtgtgaaccaagggcttagaattggaattccttttaattgtgttacaatgttaaataaagtcctcac

SEQ ID NO: 19312 - DNA, 601 bp, Human
aaaatagagtaacagtgtattcccactgcccacttaccgataatgtcatggatatcactccagttttaaatgctattactttttaaactatgaaatagtatttcatggtacttgtgtaccacagtgtattctgctggagatctagtctagttccccacagaggaacattacaatttgtattccaggagttttgttgttgtgacctcaaacacttcctttaaaaagataagctattttgtagtttaaaaaacatttgttctgtttctttctcattcatcttttcttaagtattttacacggttttttttttttggtcactactgtgaatgtgttatttttttgcatttctatctctagctgattatctactcattactcagctatctcatcaaaatattgattttcataataaaaaataataggcagtcatttgctgataaagaaattttggtttcttctcttataaattccatgccaaatatcagggctattgaatttattagaatctctaaaaacagttgaataattctggcaataggaaagatgcccgtcttgctgctattttagtggaaattgattatcatttcattattttgcatta

SEQ ID NO: 19313 - DNA, 601 bp, Human
caacattgggagaaaaggaatgaaactcaagaattccaagatgttcctcccctgccagggtaagatagcagtggttcacagacaatcgcaatgctgggtctgagaaaaataactaaacagaagattagtgaggaccaaggcttcgagatggccaggagaggaaagcttgggagcagggaaggttgagatatatgtgggttactgggaatgcgtgatggtgaagtcacagatgacccacatggtgtctaagtgctaaagaagaattctgggaaaatgaaatgcatttgggaagggaaaatckaattaaaagcctaaactaaaaatacaaaattcttggtaaagtttaggagttatgttaaatgtctcattttggctggtgaagtctcatcagaacagggaaattctctcattcaggggcatctcatcttttctttgaagggaatcaatggtgggggattggagtgttattttcagttaatatgttgcttcactctttggtcattccggtaactgtgaagtcagggtgaagtttaagggaagctttgccaagtaggggatggacttcacctttattgagcctcatagtagctggctcaggtag

SEQ ID NO: 19314 - DNA, 601 bp, Human
gtcagggtgaagtttaagggaagctttgccaagtaggggatggacttcacctttattgagcctcatagtagctggctcaggtaggagttggccgtgatgacaacttctctgcagtttgccctgcgtgaatctccagatgaacttttgtgccatttaaactttcgtgatctcctgctatttaacttcgaatgtttatggacctgtgggttcaattttgtgtgaatcacatcctgctgattgctgagtgggcgtgtgggagggtgtgcctggaggagaacttagactcggccttttccagatragcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagcccaagggaaaaggcaaagacaaagc

SEQ ID NO: 19315 - DNA, 601 bp, Human
gctggctcaggtaggagttggccgtgatgacaacttctctgcagtttgccctgcgtgaatctccagatgaacttttgtgccatttaaactttcgtgatctcctgctatttaacttcgaatgtttatggacctgtgggttcaattttgtgtgaatcacatcctgctgattgctgagtgggcgtgtgggagggtgtgcctggaggagaacttagactcggccttttccagatgagcttcagtgtaagagtgggtttcatgaagagcaaaggtcctaggaaatttaagtaagccatttaccaaygctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagcccaagggaaaaggcaaagacaaagcccttaagagccagaggactcacgagggcctggggctggtgagagtggcggggagagagggctcaccttgg

SEQ ID NO: 19316 - DNA, 601 bp, Human
tcacatcctgctgattgctgagtgggcgtgtgggagggtgtgcctggaggagaacttagactcggccttttccagatgagcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaaygcagcatggtggtggggaggatgactctgtcctccctgacttttagatgagcccaagggaaaaggcaaagacaaagcccttaagagccagaggactcacgagggcctggggctggtgagagtggcggggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactg

SEQ ID NO: 19317 - DNA, 601 bp, Human
aacttagactcggccttttccagatgagcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagsccaagggaaaaggcaaagacaaagcccttaagagccagaggactcacgagggcctggggctggtgagagtggcggggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactgttcaggttttagcactgaacatcacatgtcctagggaacccctcagtttggg

SEQ ID NO: 19318 - DNA, 601 bp, Human
acttagactcggccttttccagatgagcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagcscaagggaaaaggcaaagacaaagcccttaagagccagaggactcacgagggcctggggctggtgagagtggcggggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactgttcaggttttagcactgaacatcacatgtcctagggaacccctcagtttgggc

SEQ ID NO: 19319 - DNA, 601 bp, Human
cttagactcggccttttccagatgagcttcagtgtaagagtgggtttcatgaagagcaaaggtcctaggaaatttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagccmaagggaaaaggcaaagacaaagcccttaagagccagaggactcacgagggcctggggctggtgagagtggcggggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactgttcaggttttagcactgaacatcacatgtcctagggaacccctcagtttgggca

SEQ ID NO: 19320 - DNA, 601 bp, Human
tttaagtaagccatttaccaacgctcagaagaaagaacttgaagagcacttggaaatgagctgtgtctccccaagaaagagggagagaaagaggggagagatgtggtgcagaccctagggaggaaggagttcagaaaaaccatcctcagggtgttcttgctacaaaccaaaaaatgcagcatggtggtggggaggatgactctgtcctccctgacttttagatgagcccaagggaaaaggcaaagacaaagcccttaagagccagaggactcacgagggcctggggctggtgagagtggcsgggagagagggctcaccttgggagaaggatggtcagtgtctggggctttcctggtcatgttccaaatcaggcttggcaggagtcctgctgtgcaaattgcgtttgctgagccctgtcagaggtctcctgtgtctcacatctagggtgaccagcatcctggcttcctcaggactgttcaggttttagcactgaacatcacatgtcctagggaacccctcagtttgggcaagccctgccacatcacacaatcatattagtgccctcagtattctttgcaaacataaaaccatagactcagta

SEQ ID NO: 19321 - DNA, 601 bp, Human
tatttgtttattgcagcactattcacaataacaaagtcatggaaccaacccagatgcccatcaatggtagattggataaagaaaatgtggtacatatacaccatggaatactatgcagccataacaaggaatgagatcatattctttgcaaggacatggatgaagctggaagccatcatcctccacaaactaacacaggaacagaaaatcaaacaccgcatgttctcactcataagtgggagttgaacagtgagaatgcgtagacgcagggaggggaacaacacacaccagggcttgtggsggggtgaggggtgaggggaggaacttagaggataggtcaataggtgcagcaaaccaccatggcatatgtatcccagaacttcaagtaaataataataataataattaataataataataataataaataaacccataaagccatttgagagattcttgggggattcattggaccactgaaaatctacagtgagaaaagaattgccatgttgatgaaacaggaaaactttccttgtccccctcacagagcatgtgacagcgggaggggctcactttctcagtgcgccactgctcaaacctc

SEQ ID NO: 19322 - DNA, 601 bp, Human
ctcactcataagtgggagttgaacagtgagaatgcgtagacgcagggaggggaacaacacacaccagggcttgtggcggggtgaggggtgaggggaggaacttagaggataggtcaataggtgcagcaaaccaccatggcatatgtatcccagaacttcaagtaaataataataataataattaataataataataataataaataaacccataaagccatttgagagattcttgggggattcattggaccactgaaaatctacagtgagaaaagaattgccatgttgatgaaacaggaaractttccttgtccccctcacagagcatgtgacagcgggaggggctcactttctcagtgcgccactgctcaaacctctaggggagcatacagacgggcaggttgtggggctctgacctcaccggcagtgtctagaggtggatgtttacagctcctgaagctccagtgggcgtgggttatggccttcttttagttttgccctctatagtcagcttgtgttaaccagctcaattacaccctctaccttgtcgcaaggacagagggctttctgtatcctgggggcttgccttggtgtaccagaa

SEQ ID NO: 19323 - DNA, 601 bp, Human
gggctttctgtatcctgggggcttgccttggtgtaccagaagaatcgaatcccacctgggcttggagaatgagtgcaaggatttattgagtggatgtagctctcagcagatgggggaagccagaaggggatggaatgggaagggtttcccctggagtcagaccgctcagtggcccgggctcggtggcccgggctcggtggcctgggctctcctccgactgcctcagccaaactccgcgttgttctgctggtcagtggcctgccggtgcctgttggtgagttcttctcaatgtccagctgtycttgcgtccctccgctgatgtgctcctcccgatgtccagctacctgtgtgtctgcctgctagggtcttggggtttttataggcacatgatgggggcgtggcaggccagggtggttttgggaaatgaaacatttaggcaggaaaacaaaaatgcctgtcctcacctaggtccatgggcacaggtctgggggtggagccctcgccagggaccacaccctcttctacccagcacttcccttccctacttccatatcatttaaagggaccacgcccttcccagctcttcccttctgtatcactg

SEQ ID NO: 19324 - DNA, 601 bp, Human
agattctataccatggcctcatatctattttcacaggagcgctaatcccagacttccagcttccagattaattctcttaattggaaccttagatttggcttttccctgccacttcccaactattaatccaaaggttttttttgttgttgtggttgttgtcattgttttcaatttgactctcaaatactctattaaactatgatccaccacactcagaagtatcattttctctaagagactcaaaagtgtattagggagaatttatttaaaaataaaataaatgggatattgtttcttcatrttaaatagaagtatttctccaaaaagctgttggttagaacactgaatttatgtcttacatttctgctcttatagttctgcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggacccctgtttt

SEQ ID NO: 19325 - DNA, 601 bp, Human
aattggaaccttagatttggcttttccctgccacttcccaactattaatccaaaggttttttttgttgttgtggttgttgtcattgttttcaatttgactctcaaatactctattaaactatgatccaccacactcagaagtatcattttctctaagagactcaaaagtgtattagggagaatttatttaaaaataaaataaatgggatattgtttcttcatattaaatagaagtatttctccaaaaagctgttggttagaacactgaatttatgtcttacatttctgctcttatagttcygcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggacccctgttttctagttagtatagcagatttgttttctaatcatattatgttctttctttacgttctgctctttttgcccctcccaggt

SEQ ID NO: 19326 - DNA, 601 bp, Human
cactgaatttatgtcttacatttctgctcttatagttctgcatccacttgtttcattaagcaaactttcccttaaagtgcaggaaagtgaaaaaatcctaagtgcacagcttgataaattatcacaaattcacgtagtgcatacacccttgtaactaaacctccaaaacaagatgccggaagttgccagtcctcagaagccttcacagttactgatcctcccactctgttaaagactgttccttcagaggacccctgttttctagttagtatagcagatttgttttctaatcatattatgytctttctttacgttctgctctttttgcccctcccaggtcctgtggcggtacactggaacccgaccatcgaatcttgcgaacaacacgatacttgttaagtggctaccccaaaacgatctgcttggtatgttgggcggattggatgtataggtcaaaccagggtcaaattaagaaaatggcttaagcacagctattctaaaggattgttgagcttgaaaatattatggccaacatatcctacattgctttttatctagtggggtatctcaacccacattttcttctgcaaatttctgcaag

SEQ ID NO: 19327 - DNA, 601 bp, Human
gctgggattacaggtgtccaccaccacgcccggttaatttttgtattttttagtagagaaagggtttcaccatgtttgtcaggctggtcttgaactcctgacttcaggtgatccacctgcctcggcctgccaaagtgctgagattacaggcatgagccagcgcgtctgacctggatttataaataagataatttagaggttattattcactttataaaaggattctttagtttctatataatttatcatataatttatttagaattttatttcccccattagatttaaaactccaatttayataaaaagttgccataatagacatctgatccataagtttcctgcacagaaagaaatactccattataagaagcatagtatctttaagagaaaaacaactcaaatgcttagaagtacagctttttgcagcactggaacctgtgagaaattttgtccatggagtttatgaatgaaggagctataagatatcacagacaaagtcttagaataagagcaaaggaaaatttgctcaaatgtggccctgaaaacgattcaaagggcaaatgatttctggattaaagttagtatattactgtcaagc

SEQ ID NO: 19328 - DNA, 601 bp, Human
gcacacgcctgtagtcccagccactctggaggctaaggcgggaggattgcttgagcccagaagttggaggctgctatgagccgtgatcatgccactgcactccagcaacctgggcaacagagtgagaccctgtctcaaaaaaaaaaaaaaaaatgaaaagtccacataacctgagcatcatgtgcccagagcgttgggtggtgtggtcccattccttccttccagcggcttcttctggccacctcaatgtcaggatgtcctgctcacatatcaataccattaaaacctgacttctttccckgcactgttgaagctccttcttgaggctcacattatggatataattttgattctttcttcagtggtatagataactacttgtaacctaagaacaacttggtgaaagtcctctaatacattattttttaaaaaaacacaaatcaatgagctcaacttattaactaactttcatctattcatttttgagccatccctgtctgattgtgaatctccatgattccaacactctgagctggggatagtgcctacacaaaataaaaagaagtggaaaattttcaaacatcagtttatgctgacaacc

SEQ ID NO: 19329 - DNA, 601 bp, Human
ttggtctttctttttctcccttccttcctccgtccctctctcctttcctctctccctccctccctccctcccttcctcctttccttgcttccttccctccttctcttccttctttttcaagagatcaataacatttattaagaataagtttcttaattataacctttcaggtgataatagtaacacagcctgggcaacacaataagaccttgtttctacaaaaaatttaaaaattggccagacatagtggtgcatgactaattccagctactctggaggctgaggcaggaggatggcttgmgcccaggagttggaggctgcagttagccatgcttgtgccactacactccagcccgggcaacagggcaagactctgtatctaaaaacaacaacaacaacaataatagaaacaggtttcctttcccaagtttggaaaatctggtagtcttcttaagcagccatgagcataaagagaggattgttcataccacaggtgttccaggcataacgaaactgtctttgtgtttagttacaaggagaacatcatgcgcctctccagccttcacaaggaccgcccggtggagccgctggacctggccgt

SEQ ID NO: 19330 - DNA, 601 bp, Human
cactccagcccgggcaacagggcaagactctgtatctaaaaacaacaacaacaacaataatagaaacaggtttcctttcccaagtttggaaaatctggtagtcttcttaagcagccatgagcataaagagaggattgttcataccacaggtgttccaggcataacgaaactgtctttgtgtttagttacaaggagaacatcatgcgcctctccagccttcacaaggaccgcccggtggagccgctggacctggccgtgttctgggtggagtttgtgatgaggcacaagggcgcgccacacmtgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaatta

SEQ ID NO: 19331 - DNA, 601 bp, Human
atcctccctgccatccacagtgcagtccagcccacccaaagtgactaaccagtcttttggttctacacgtggcaaaggaccaccttctgatttcctgacctcccccagtcactctgtgtggggggactgccagggaactggacaggacctagcaccttcctgaaataaccccttttcaaaccaacatccagcccaatacatgagagtgggtgtcagccctggaaaacccgggacattaaggcacaccatttaatgggggcaagctagaaggatgagatgatgagaccctctgagctcattyccttggggccattgacctatccatgacacccccatgacctctagctcttctgagaaggctgtccttggaatccagttcacagcaaacaaagccaaggagtggaccactgtaaacagggaggaaggcctgatcagatggccagtgtgctcccctggctcacctgcagcatatgagacacgtcaaagagcgagcagtgctggcgtgtgtgcaggtgcgagtcagtgtgactgtcccggtactgcactggcagactccaacccgcaaacgccaccattttcccgccgtgggccaggtggaagt

SEQ ID NO: 19332 - DNA, 601 bp, Human
tccaaccactagactctccatcagcttcacccggtcactaccaagtatcttggtctggggaagagattgaaagcctcaggccattgcaacagctacaatccaaaaggctactaagcaaggatgcatcctccctgccatccacagtgcagtccagcccacccaaagtgactaaccagtcttttggttctacacgtggcaaaggaccaccttctgatttcctgacctcccccagtcactctgtgtggggggactgccagggaactggacaggacctagcaccttcctgaaataaccccttttsaaaccaacatccagcccaatacatgagagtgggtgtcagccctggaaaacccgggacattaaggcacaccatttaatgggggcaagctagaaggatgagatgatgagaccctctgagctcattcccttggggccattgacctatccatgacacccccatgacctctagctcttctgagaaggctgtccttggaatccagttcacagcaaacaaagccaaggagtggaccactgtaaacagggaggaaggcctgatcagatggccagtgtgctcccctggctcacctgcagcatatgagac

SEQ ID NO: 19333 - DNA, 601 bp, Human
tgagaagctgtgtttgactcatctctgtgcccctaagcctgaggtagggactcagcccatttgctggctcatgactaagaaaactcatagagcagaaataaaagggcccacctggtttggtcttagctctgcaatgtctccaaccactagactctccatcagcttcacccggtcactaccaagtatcttggtctggggaagagattgaaagcctcaggccattgcaacagctacaatccaaaaggctactaagcaaggatgcatcctccctgccatccacagtgcagtccagcccacccamagtgactaaccagtcttttggttctacacgtggcaaaggaccaccttctgatttcctgacctcccccagtcactctgtgtggggggactgccagggaactggacaggacctagcaccttcctgaaataaccccttttcaaaccaacatccagcccaatacatgagagtgggtgtcagccctggaaaacccgggacattaaggcacaccatttaatgggggcaagctagaaggatgagatgatgagaccctctgagctcattcccttggggccattgacctatccatgacacccccatgac

SEQ ID NO: 19334 - DNA, 601 bp, Human
atctatgacacctaggacctgctgcttcacctacccaaacctgggacgacttagcccatgtggcaacccacaggacaaaagcttcaaaggtcatcttgatgatcgcaggctctcctaagtactccatagcaatgcccccaaaaaacttccttagcctccccactggatggacaaaaagcctgaggttgagggggtcacatgaatcacctggggatcttgttaaaatgaaggttctgattcagcaggtctgcagcagtgcctgagactatattcctaacaagctccaaagatgctggtttasagaccacactttgttgttgttatttttctttttagactgagtctcactctgttgcccaggccagagtgcagtggtgcaacctcagcttgctgcaacctcagcctcccgagtagctgggactacaagcacgcgccaccacgcccggctaatttttgtgtttttagtagaaacgaggttttgccatgttggccaggctggtctcgaactcctgacctcaggtgatccacccgccttggcctccccaagtgccaggattacaggtgtttgagtcacgtcgcctggccagggaccacatgttga

SEQ ID NO: 19335 - DNA, 601 bp, Human
atcccctccctaccttggggtgcttccctgatctggtgcaacctctgcacccctccccactctgtactgagagtcccatctgacacttaatctatgacacctaggacctgctgcttcacctacccaaacctgggacgacttagcccatgtggcaacccacaggacaaaagcttcaaaggtcatcttgatgatcgcaggctctcctaagtactccatagcaatgcccccaaaaaacttccttagcctccccactggatggacaaaaagcctgaggttgagggggtcacatgaatcacctggrgatcttgttaaaatgaaggttctgattcagcaggtctgcagcagtgcctgagactatattcctaacaagctccaaagatgctggtttagagaccacactttgttgttgttatttttctttttagactgagtctcactctgttgcccaggccagagtgcagtggtgcaacctcagcttgctgcaacctcagcctcccgagtagctgggactacaagcacgcgccaccacgcccggctaatttttgtgtttttagtagaaacgaggttttgccatgttggccaggctggtctcgaactcctg

SEQ ID NO: 19336 - DNA, 601 bp, Human
caccatgttggccaggctattctcgaattcctgacctcatgatccacccaccttggcctcccaaagtgctgggattacaggtgtgagccaccatgcccggcagcatcttcagtttctttttttttttttttttttttttttgagacggggtctcgctctatcgccctggctggaggtgcagtggcgcaatctcggctcactgcaaactccgccgcccaggttcatgccattctcctgcctcagcctcccgagtagctgggactacaggcgcccgccacaatgcccagctaattttttttttgtatttttagtagagacggggtttcaccatgttagccaggatggtcttgatctcctgacctcgtgatccacccgcctcggcctcccaaagtgctgggattacagatgtgagccaccgcatccggccaacatctgcagtttctaatgggcaaaggcacagtggcaccttcagggaagggaggctcaggaaggcttcaggctacataacctttggatgagtcatgggctggctagtcttatcaagggtcaccctgacctccaggaccctatcctttagtgctggcccagctcacccagtgtc

SEQ ID NO: 19337 - DNA, 601 bp, Human
ctcactgcaaactctgcctcccaggttcaagcaatttacctgcctcagtctcccgagtagctgggataacaggcacccgccaccacgcctggctaatttttatattttcagtagagacggggtctcaccatgttggccaggctattctcgaattcctgacctcatgatccacccaccttggcctcccaaagtgctgggattacaggtgtgagccaccatgcccggcagcatcttcagtttctttttttttttttttttttttttttgagacggggtctcgctctatcgccctggctggagktgcagtggcgcaatctcggctcactgcaaactccgccgcccaggttcatgccattctcctgcctcagcctcccgagtagctgggactacaggcgcccgccacaatgcccagctaattttttttttgtatttttagtagagacggggtttcaccatgttagccaggatggtcttgatctcctgacctcgtgatccacccgcctcggcctcccaaagtgctgggattacagatgtgagccaccgcatccggccaacatctgcagtttctaatgggcaaaggcacagtggcaccttcagggaa

SEQ ID NO: 19338 - DNA, 601 bp, Human
cctggaagctgttgccccttgggacccagatgcaataacttgcagggaggggagaggtgatgcagctccctggaggagcagggatggggtgcccaacaggggcaatatctccatttttatagactggcccctttcaaggagaacctattccaagcttgtcttggaggccaggaaggcaggcattgggttggcatttcaggaaccctgtgaacagagaacaatgaagctagagactggcaagtaagaaggaagtttaatttttttttcaggattcagtggagtccattaatgcataccaggrgcaaagatcagcccagggtaaggcaagtctgggaggaagcccaccctgccctacagcagccctggaactcagaataggtggtgagtctgccatggtttgctactgggcagcacactagaccaacttgggaatgtggaagagtgagtctatgttccctcagccatccccaagtttacacacaggcatagcagccctactgtgagtcagcaatcattcctgacttgcagtaaggacaatttgcatttacggaaagcaaactggagggggtagcctaagtccgcactgcccatgttattaccc

SEQ ID NO: 19339 - DNA, 601 bp, Human
gaggaaaggatacagacagcgcctggaattgtcagacatataccaaatcccttctgttgattctgctgacaatctatctgaaaaattggaaaggtatgttcatgtacattgtttagttgaagagagaaattcatattattaattatttagagaagagaaagcaaacatattataagtttaattcttatatttaaaaataggagccaagtatggtggctaatgcctgtaatcccaactatttgggaggccaagatgagaggattgcttgagaccaggagtttgataccagcctgggcaacayagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttc

SEQ ID NO: 19340 - DNA, 601 bp, Human
gccaagtatggtggctaatgcctgtaatcccaactatttgggaggccaagatgagaggattgcttgagaccaggagtttgataccagcctgggcaacatagcaagatgttatctctacacaaaataaaaaagttagctgggaatggtagtgcatgcttgtattcccagctactcaggaggctgaagcaggagggttacttgagcccaggagtttgaggttgcagtgagctatgattgtgccactgcactccagcttgggtgacacagcaaaaccctctctctctaaaaaaaaaaaaaaaaaggaacatctcattttcacactgaaatgttgactgaaatcattaaacaataaaatcataaaagaaaaataatcagtttcctaagaaatgattttttttcctgaaaaatacacatttggtttcagagaatttgtcttattagagaccatgagatggattttgtgaaaactaaagtaacaccattatgaagtaaatcgtgtatatttgctttcaaaacctttatatttgaatacaaatgtactccctgggaagtcttaaggtaatggctactggttatcaaacaaatgtaaaaattgtatatt

SEQ ID NO: 19341 - DNA, 601 bp, Human
aagatgactcacacagcctacataaaagtaattgacaaaatatcatcttatagtaaaatgccacatatctttatgttcagcaagaagagtataatatatgattgttaatgataacccaaacaacaaaagatttcaccttaactggttgtcataagtagtagtatccaccgccttattttgagttggatttttatcatcctatgagccctacaaatttaaagtttttggaacagcacgtgcattgaacccataagaacctactctgcttttctgcatgtattgtccagacaagagaccaaaytgccgaggcatcatttaggtgaattctaattaacatttagctaccttacaaccacaattcaaggttgtttcaaaggcatgtgcttgcatcatcctgattcactaccatgtgttactaacttggatctgcaaagtcattataaaaagctgttttgatggacttatttggatattgctttacccttcttctctcttttcttttatcaatgtaaaaacattatatgttaaatacttggcttttaagagcatagatctgaaatctgcctctagcaaataacccataacacttctaagatatacc

SEQ ID NO: 19342 - DNA, 601 bp, Human
tcaatgtaaaaacattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaatgttttatttcaatctgaacattttacrtaagtgaagactttgttagatatcatttggaatgtggaatctacacagttggcatatcagagaaggttgaattcagtttaataaatgtttatagaaagtgcttgttatcataatgataatagctcaggatgtgcatgacaagcttttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacg

SEQ ID NO: 19343 - DNA, 601 bp, Human
cattatatgttaaatacttggcttttaagagcatagatctgaaatctgcctctagcaaataacccataacacttctaagatatacctgcaaggtcaattgtgttgtaaaaccttgataaccatactttattgttcaaaaaagccttttatgaaggcagaagttaaaaaaaaaaaacaaaaaaaacagagtccacagttatcacctcagctacaatctcatcagttcacaagtaccagcaaaacatgtgataagtcaacaaatgttttatttcaatctgaacattttacgtaagtgaagacwttgttagatatcatttggaatgtggaatctacacagttggcatatcagagaaggttgaattcagtttaataaatgtttatagaaagtgcttgttatcataatgataatagctcaggatgtgcatgacaagcttttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacgatctctaaactg

SEQ ID NO: 19344 - DNA, 601 bp, Human
ttaagcgattgggtacactatctcatttgatcttctgcacaactattaatggtaggtactattatccctatcttatggataagtaaactaagatttaaaaagtacagaacatggtgtgaacactgcttcaaaatttctaaaataggtaaatcacgatctctaaactggagggttgtccaaccactagggacaatagagtactgatatttagtggtcagactgtaatgcgggaagagacaggcatgggctaaacgggtgtagagatcaaataaggggcaggttagtttgtaaacatgtccatatgtaacatttagcacaaatacaggatataggtgctttcagacccagctgcattgataaaaagttaggtggtattgtatctgtcttcctttctcaatgttgcatatctgtgttcttgcccagtttgcttcatctctctagccacacttattggcctacaatggcatcatcaccaaagaaggcaatcccatctccgtgtggctttggtttgctccctaaagtaaaccttgtgtttacttttcccaggtctcatgctttcccatatctgacctgttttgtcctcatggccaggatatgtggg

SEQ ID NO: 19345 - DNA, 601 bp, Human
gatcttctgcacaactattaatggtaggtactattatccctatcttatggataagtaaactaagatttaaaaagtacagaacatggtgtgaacactgcttcaaaatttctaaaataggtaaatcacgatctctaaactggagggttgtccaaccactagggacaatagagtactgatatttagtggtcagactgtaatgcgggaagagacaggcatgggctaaacgggtgtagagatcaaataaggggcaggttagtttgtaaacatgtccatatgtaacatttagcacaaatacaggatrtaggtgctttcagacccagctgcattgataaaaagttaggtggtattgtatctgtcttcctttctcaatgttgcatatctgtgttcttgcccagtttgcttcatctctctagccacacttattggcctacaatggcatcatcaccaaagaaggcaatcccatctccgtgtggctttggtttgctccctaaagtaaaccttgtgtttacttttcccaggtctcatgctttcccatatctgacctgttttgtcctcatggccaggatatgtgggacctttcctacaatgttccaaagtttgt

SEQ ID NO: 19346 - DNA, 601 bp, Human
tagtaattagtggttaagtcttgctcagctctagcttccctattctggaaactaagaaaggtcaattgtatagcagagcaccattctggggtctggtagaaccacccaactcaaaggcaccttagcctgttgttaataagatttttcaaaacttaattcttatcagaccttgcttctttttaaaactttaaatctgttatgtactttggccagatatgatacctgagcaattcttgttctgggttgtcttatgtgaaaaataaattcaaggtccttgggacagataatgtgttttatttawctttgcatatccattacttaaaacagcattggacccacagctggtacaaaattaattactgttgaattgagcaaatatttattctaaatgtctctgtcaaatgacagagtgtggttgtgtggattaagtccctggagagagttctttgttctctcatgttctatgctgtggttcttgctttatgcaaaaagaagtaagttacttaaaacctggacatgatacttaagatgtccaatcttgattccactgaataaaaatatgcttaaaaatgcactgacttgaaatttgttttttgggaaa

SEQ ID NO: 19347 - DNA, 601 bp, Human
gttctggcattatttaatctaggccagaggttgcaaatggtgtcccatagaactaattttggctcctagacctgtcttatttaacctttcatttaaaaaatttgtattggttgccagcaattaaaaattgggagatgtctcacacacacacacacataaacacacacactcatgtgtgcagcctcttttgaagaattggaataactagtcaactgcgtcctccttttccacaagctgtgacagctccctgctcacagagcacctgccctctcctgttcatcatgctctcttctcagtcccrttccttcattatatcacctatttggtcctgagactaagtgagtttgagatctgtgatttagacaaagtggtgaatctagctctgaatcatagtaagtagctctgggaatcatcttgtcttctgttagcccattgagagagaaatagagagagagagagagagaaagaaagaagaagaaacagatctggggagagtcactgaatgggagcatagagacagagaaacagatctagaaaaccaaactgggagaaaatgagagaaaccaaaagagaggtagagaggagcagagaagaaaatgaa

SEQ ID NO: 19348 - DNA, 601 bp, Human
tttagacaaagtggtgaatctagctctgaatcatagtaagtagctctgggaatcatcttgtcttctgttagcccattgagagagaaatagagagagagagagagagaaagaaagaagaagaaacagatctggggagagtcactgaatgggagcatagagacagagaaacagatctagaaaaccaaactgggagaaaatgagagaaaccaaaagagaggtagagaggagcagagaagaaaatgaagaagcaaggcaaggaccaggctttttcattatttcttatggccaagacttcagtatrcgtggacttaattcttccttatgctcctaccttccctagggaaactgatttggagtctctaatagagcccttcttttagaatcacagtttgatgccttaaaactagttatataccttcacatgcttccttaacccacagaagtgatgctaatgaggcccttaataaggagcgtgctattaagatgaagacattcattttttttctccgtccaatgttggattaaggcacattagtgggtaattcagggttgctttgtaaattcatcactaaggttagcatgtaatagtacaaggaagaat

SEQ ID NO: 19349 - DNA, 601 bp, Human
aaaccaaaagagaggtagagaggagcagagaagaaaatgaagaagcaaggcaaggaccaggctttttcattatttcttatggccaagacttcagtatgcgtggacttaattcttccttatgctcctaccttccctagggaaactgatttggagtctctaatagagcccttcttttagaatcacagtttgatgccttaaaactagttatataccttcacatgcttccttaacccacagaagtgatgctaatgaggcccttaataaggagcgtgctattaagatgaagacattcattttttttctccgtccaatgttggattaaggcacattagtgggtaattcagggttgctttgtaaattcatcactaaggttagcatgtaatagtacaaggaagaatcagttgtatgttaaatctaatgtataaaaagttttataaaatatcatatgtttagagagtatatttcaaatatgatgaatcctagtgcttggcaaattaactttagaacactaataaaattattttattaagaaataattactatttcattattaaaattcatatataagatgtagcacaatgagagtataaagtagatgtaa

SEQ ID NO: 19350 - DNA, 601 bp, Human
ctttcgctcacgcaacctcatgcccaaaaccttatcactcttcttccctttgctgtcaaggctgttctcacttcttcactttttgtggacttctccccactacaacatagattctgctatcaccaatctattaaaactgttatactcttgtggaatttatcatttaatttagcttcagtgaaccgttctttccagattattttggcctcagaccatgacttctaagtctgccgtgcttgccacttaagtgatgatgggccagtgggtccccacctaggcctctgtgttagtctgttttcaygttgctgataaagacatacccaagaatgggcaatttacagaagaaaggggtttgagggactcacagttccatgtgactggggaggcctcacaatcatggtggatgatgaaaggcatgtctcacatggaggcagataagagcatagaacttgtgcagggaaacttccctttattaaaccaccaggtcttgtgagacttcttcactatcacgagaataggatgggcaagaccctcccccatgattcaattatctcccactgggtccctcccacaacacatgggaattatgggagctataatt

SEQ ID NO: 19351 - DNA, 601 bp, Human
agcatggttacacaactagctagggcagagctaaaatgtcaggctaggcttctgtgactccaaagccctttctcacttagcatatcatcacttatttttttttttaatcacatatatgatttttttttctttaagagatagaatcttgctctatcacgtgggctggagtgcagtggcacaatcatagctcactgtaaccttgaacttgggctcaagtgatcctcctgccttagcctactgagtagctagggctacagacacacaccaccatgcctagctaattttattttattttatttttttttttgagacagagtctcactctgtcacccaggctggagtgcagtggtgcgatcttggctcactggaacctctgctgcccgggttcaagcgattctcctgcctcagcctcctgagtagctgggattacaggtgcctgccactgtgcccagctaatttttgtatttttagtagagacggggtttcaccatcttggccaggcttgtcttgaactcctgacctcgtgatccactcgcctcggcctcccaaagtgctgggattacaggtgtgagccaccacgcctggccacctacctaatttt

SEQ ID NO: 19352 - DNA, 601 bp, Human
gcctttgtctcattttaaaatactttcattgttagctacccatataataaaaaactaaaagcagtagttttcaagcatgattgtttatgtatgccttaaaagaattttgaaaacctatgtacccctgacacacttttaagttaacttataaatttttcaacatagttttaagtggtggcaaatgatgtagtttcttgtgtattttaaactgcttaagtatgctatacatggatttcttcaaaaccctgaagctgcagtttcagtgcattcaatttatggaaaagaaattaatttataaaaytggttcttattgtcaagtcaatcagctaaatataacttgctttctgtcaggaaaagtctgactttaaaatacagataagtaataactattattaattaattaaattattaaaattaaaataattaaataatttgttaattaaaatgccttattcccctacttatttctgcaatttgactctaagaatagataggacatgtagattgccttaggtttgaaatctgggtgaaataagatactgcctccttcagtatttctgcctttgcttttatgggagcctctttcaagaaaaagtcattc

SEQ ID NO: 19353 - DNA, 601 bp, Human
gtattttaaactgcttaagtatgctatacatggatttcttcaaaaccctgaagctgcagtttcagtgcattcaatttatggaaaagaaattaatttataaaattggttcttattgtcaagtcaatcagctaaatataacttgctttctgtcaggaaaagtctgactttaaaatacagataagtaataactattattaattaattaaattattaaaattaaaataattaaataatttgttaattaaaatgccttattcccctacttatttctgcaatttgactctaagaatagataggacaygtagattgccttaggtttgaaatctgggtgaaataagatactgcctccttcagtatttctgcctttgcttttatgggagcctctttcaagaaaaagtcattctctcatggtccctttgtttgagtcccagaggttttcctactccagaaagtgcaacgtagtgagactagtactatactcccttgcatggtaagtgagaaggctgtctgtataaaatgagggaaggactcatgagagggaagtaggtcaggagaaatgataggttctcaggcaggttaattttaggaaagagtgaataga

SEQ ID NO: 19354 - DNA, 601 bp, Human
atataagtaaggttactatcaatcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttgtgacttactcatactttccttatttggaacttttatgaatatgatatagagactgaaactacaaggaacaaaatgcaatatcaattatacagttgtggcagcactgctrtcaatttgttgatagtgtttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgctattgtattttgagcacatagcatggtacttgcctctaaatagatactattgttaaaatattttttaaggtaatattttaaagtgtatgctatggtacagttcagtttgtgacttttgctagtttat

SEQ ID NO: 19355 - DNA, 601 bp, Human
tcaatcacacctgaaaaatttaaatgttatgaagaaattatctcatttctattaatatgggaactgtgtcttcatctttattactgttctaaggtcaactcaatgtagattttacttgcttatggtttcatattttagctaaatagtaaaataatatggatatacattttgttgtgacttactcatactttccttatttggaacttttatgaatatgatatagagactgaaactacaaggaacaaaatgcaatatcaattatacagttgtggcagcactgctgtcaatttgttgatagtgkttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgctattgtattttgagcacatagcatggtacttgcctctaaatagatactattgttaaaatattttttaaggtaatattttaaagtgtatgctatggtacagttcagtttgtgacttttgctagtttatgccacttacagttagcaa

SEQ ID NO: 19356 - DNA, 601 bp, Human
tggatatacattttgttgtgacttactcatactttccttatttggaacttttatgaatatgatatagagactgaaactacaaggaacaaaatgcaatatcaattatacagttgtggcagcactgctgtcaatttgttgatagtgtttaacacttagaaaaacattttaaaaataatttcacataagtaatgtaatttattagctgtctctgacattttacagtttggaatagtttattttctttttggtgtcctcaccaaaacccaacatcttcaagggcaggaactgtataatttttgcyattgtattttgagcacatagcatggtacttgcctctaaatagatactattgttaaaatattttttaaggtaatattttaaagtgtatgctatggtacagttcagtttgtgacttttgctagtttatgccacttacagttagcaaaatcacttcagcagttcttggaatgttgtgaaaagtgataaaaatcttctgcaacttattcctttattcctcatttaaaataatctaccatagtaaaaacatgtataaaagtgctacttctgcaccacttttgagaatagtgttatttcagtgaat

SEQ ID NO: 19357 - DNA, 601 bp, Human
ttctgtcttctccttagatagtaaccttcttaagaaaatatatatgctaagtgttttactggtttaatatgcttagactactcatctacctcaatacttccttggagatctcctcctcagtcacacagagctcaggacttatatttccttggaactcctgttagggtccaatgtacatgaaattccctagacagacagacagtcagttatatggcttgatttcaaagtttcaaaatgatttaatggactatcaagtagtttattaggagaacagttattatactcttctaaaaataaagaytttaagcaataaagatgtatatgtatataaaatggctgggttattcctagaagtacctttcttagaatttagttaaatttaatatccaagatactatcttttcaaccctgagattgtgaaaagtaacttctatcaatataaactttactacatttgtattgtgttagtgtgttacagtataatctagaacaatgtgtctttctatatgatatatgacattttaatgcctaaaaaaactgatatgtcttagatgattctagtcaggatttacttctagaatagattaaaattctatttgag

SEQ ID NO: 19358 - DNA, 601 bp, Human
agtagaaaacttaatgccttggatgaaatgagccatgggcagggttgtaatgaattgatatgtttaatagtatagatcatttgtgaataatatgacctttgacaagacacaagccattaacatctgtaggcagaagtttccttctttgtaaaatgagggaataaaatagatccctaaagtgtgtaattttagtatttctaaactttatgaaggtttcctaaatgataattcatctatatagtgtttttttgtgtgtttgtttgtttgtttgtttgagatggagtctcgctctgtcacctasgctggagtgcaatggtgcaacctcggctcactgcaacctctgcctcctgggttcaagctaatctcctgcctcagcctcctgagtagctgagattacaggcatgcaccaccatgccgagctaatttttgtatttttagtagagaaggggtttcatcatgttgaccaggctggtcttgaactcctgaccttgtgatccacccacctcagcctcccaaagtgctggtattacaggcgtgtgccaccacgtccagcctgagccactgcgcccagcccatctatatagtttaatatcaatctaaa

SEQ ID NO: 19359 - DNA, 601 bp, Human
ctgaccttgtgatccacccacctcagcctcccaaagtgctggtattacaggcgtgtgccaccacgtccagcctgagccactgcgcccagcccatctatatagtttaatatcaatctaaatgaatttctcagtcctgagcctaaaaatttagttgtaaagaatgatatccttgactaataatagtttctattaatggattgcatctagtgctaggtggcatatatttagtccccacaactaccctggaaggtatttaaaatttttcacatttgcagataaggaaactaaagttcagagttcrgcaacatgcttgaattcaagcagctcctaggatgttaatggtggaggttgggttcaaatccagatctgtctgactcaaaaaatgcatactcctaaccagtgcactatatcccaattccataggagcccttctttgtgattcatagcactttcccatgagttttgttgattttgtgagaaacaaaactctttttcctttggactgtctggaatctctctttttcaaatttttgaaatgtatttctatgccaaaagacaaagatttctagaggaatatgcctaggatgagaattatgtaatt

SEQ ID NO: 19360 - DNA, 601 bp, Human
cagatctgtctgactcaaaaaatgcatactcctaaccagtgcactatatcccaattccataggagcccttctttgtgattcatagcactttcccatgagttttgttgattttgtgagaaacaaaactctttttcctttggactgtctggaatctctctttttcaaatttttgaaatgtatttctatgccaaaagacaaagatttctagaggaatatgcctaggatgagaattatgtaatttaaatcacagctggaaagagagaaagtcctaagttactaagaaatgttcaaacacaaatgrgctttcagtctattggaagacctttatagctagaagtatactgaactgtacttgtccatggacccctgaagaaacaggttaaatcaaagagagttctgggaaacttcatttagatggtatcattcatttgataaaaggtatgccactgttaagcctttaatggtaaaattgtccaataataatacagttatataatcagtgatacatttttagaattttgaaaaattacgatgtttctcatttttaataaagctgtgttgctccagtagacattattctggctatagaatgacatcatac

SEQ ID NO: 19361 - DNA, 601 bp, Human
ttgaaaaattacgatgtttctcatttttaataaagctgtgttgctccagtagacattattctggctatagaatgacatcatacatggcatttataatgatttatatttgttaaaatacacttagattcaagtaatactattcttttattttcatatattaaaaataaaaccacaatggtggcatgaaactgtactgtcttattgtaatagccataattcttttattcaggagtgcttttttgatgatatggagagcataccagcagtgactacatggaacacataccttcgatatattackgtccacaagagcttaatttttgtgctaatttggtgcttagtaatttttctggcagaggtaagaatgttctattgtaaagtattactggatttaaagttaaattaagatagtttggggatgtatacatatatatgcacacacataaatatgtatatatacacatgtatacatgtataagtatgcatatatacacacatatatcactatatgtatatatgtatatattacatatatttgtgattttacagtatataatggtatagattcatatagttcttagcttctgaaaaatcaacaagt

SEQ ID NO: 19362 - DNA, 601 bp, Human
catatatcactatatgtatatatgtatatattacatatatttgtgattttacagtatataatggtatagattcatatagttcttagcttctgaaaaatcaacaagtagaaccactactgatattttattatttcatattacatataaaatatatttaaatacaaatataagaagagtttttaatagatttttaataataaaggttaagagattcgaaagctcaaagtagaaggcttttatttggattgaaattaaacaattagaatcactgttgatattttattatttcatattacatatraaatatatttaaatataaagataagagtttttaatagattttataataaatgttaagagattaaaaaactgaaaatagaaggcttttatttggattgaaattaaaggccaggcatggtggttcatgcctgtaatcccagaattttaggagactgagtggggaggattgcttgagcccaggggtcaagaccagcctgggcaacacagtgagacaccgtatctacaaaataattaaaaaattagctgggcatggtggtgtgtgcctgtatgctaccattaactaaggaggctgaggtgggag

SEQ ID NO: 19363 - DNA, 601 bp, Human
accaatcagctctctgtaaaaccaatctgctgtctgtaaaatggaccaatcagcaggatgtgggtggggccagataagagaataaaagcaggctgcctgagccagaagtggcaacctgctggggtctgtagaagctttgttcttttgttctttgcaataaattttgctactgctcactttttgggtccgcattgcgtttatgagctgtgacactcactgggaaggtctgcagcttcactcctgaagccagcgagatcacgaacccaccagaagaaagaaactcctaacacatccgaacatyagaaggaacaaactcaggacacgcggcctttaagaactataacactcactgcaagggtccttggcttcattctcgaagtcagtgagaccaagaacccaccaattccggacacaatttgactgcagaaaatggatgtccaaccctgtggtttccctgggccacattggaagaagaaaggagttgtcttgggccacacataaaatacacttactatagcagatgagctaaagaaaagaaaaaagtccatgcgtaatctttgtgatatgtgccaccaccaataagcaaaattgttctcttatt

SEQ ID NO: 19364 - DNA, 601 bp, Human
ctatagaaggcagctgtcactcagcaccagctaagggcttcccatgagggaactggggatcaggtttcccagatctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagkcccatgctaccttcagagaataaatgacccagaaaaagaaccacctctcctaaggaagtataaatttgtaaataactgagacccaaacttacaactatacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccat

SEQ ID NO: 19365 - DNA, 601 bp, Human
tcccagatctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagtcccatgctaccttcagagaataaatgacccagaaaaagaaccacctctcctaaggaagtataaatktgtaaataactgagacccaaacttacaactatacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccatttgatctctgagtgtggtaatacatgttatttgccctgctgttgtaaataaacaaaccaaatggag

SEQ ID NO: 19366 - DNA, 601 bp, Human
ctttttatgtaacaggataagacagagatccagctttttttgggtaattatttcctattttaaaatacgggtagttgattaaataaaaacaaacgaatgaacaccatatgggcacaacaaaacacatctgtggcttggattcagcttgtgaatgattactgcagatatttattctagaggacacccctgggtatgtcctaatataaaacctaaatctaaactcaagtcccatgctaccttcagagaataaatgacccagaaaaagaaccacctctcctaaggaagtataaatttgtaaatmactgagacccaaacttacaactatacatttttcttattgttgggctgttgctaacctcaattaagaaggcttgatgatatttgtaaagtgtcatcactccaccatggtccagtaacatctgatcactccaccatggtccagtaacatctgaatggtcaagaaatatctaaacgtatgtaccaaaaatttgtgtatactactgtaccaataaaccatttgtttccatttgatctctgagtgtggtaatacatgttatttgccctgctgttgtaaataaacaaaccaaatggaggcttgatg

SEQ ID NO: 19367 - DNA, 601 bp, Human
gcttggcagtgcatcattgactagatggagaagaaatgaaaataatacattaggaagcagtttcctggttcttttgaaaacaactagagagtcttgttgttgactggaatatctgaagatcctgtttaatgctttcattctatgattgttaagaatatgtcatagaactgctgtatcctgtttctttatgtcttcccttctgtttgttgattagaaatccctgagtggctttacattattagtacagtagatatgtagtatattcccataataccactgctgctattgactaatagtaatwattttagggcagctttatgacagttggtttatgttttagggtgtcatttgacttgtgaagcattgaaatctgggtattaagcacactgttttctatgtggtatggaatgattcttaaagccctgagaaaatggaaaataaaaatatttttcctttttaccataatcacctatgactgtcactctatcataaactgcataaactttataacctcaaaacattttggaaatgaaatgacagaacttgcttactcaattgcttctatatacaccaaatatttttttaaagtattatgttaagt

SEQ ID NO: 19368 - DNA, 601 bp, Human
ttgaaatctgggtattaagcacactgttttctatgtggtatggaatgattcttaaagccctgagaaaatggaaaataaaaatatttttcctttttaccataatcacctatgactgtcactctatcataaactgcataaactttataacctcaaaacattttggaaatgaaatgacagaacttgcttactcaattgcttctatatacaccaaatatttttttaaagtattatgttaagtccttgaaaatattttgttctactcaatagaagcagtttaggttggtagttctatgtggaaacmgtgaggaaataattttatattatgatgactagaccagtctttgaacatcactttggttattgttccattagtaaatattataattatttctgagatttactcaccttcaaagaatgttggcaatgccagcattattaacactcctctagttagaacaaagaggaaatgtaataacaaaacataataatagccaaataaagagtgacttagaatgtacacccttatctaggatcctgagtaattcgattattcttaggaaatacacttttgtgctagaacaaagacttttgaaatagctaa

SEQ ID NO: 19369 - DNA, 601 bp, Human
ctgtctagacaatgaattcctcaagggcaaggagcatggcttattcacctcagtaatttcagtgcctagcattgtgcctggtacaaagtggacacttgtatataaccttttttaattgaagcaacaagttgtcaaccttacaaatgtgaatccgtgattcagatgacaggttgaaatgtagattgtctgcgaagagggcagaaagagagtatgacaaaggaggacaagacagtggggcaggcagggagagagagcagccagggtttcggtagaggtatgtcaaaaaggtatggaagtcagmggagaaggagacccctatgttatagaatacaaatggaagggaaatgatgacaacagtaagttgtcattaaatgcaaggttgcaaaagtaagattgtaaagcaggatgagtacccacctattcctgacataatttatagtaaaagctatttcagagaaattggtcgttacttgaatcttacaagaatctgaaacttttaaaaaggtttaaaagtaaaagacaataacttgaacacataattatttagaatgtttggaaagaaacaaaaatttctaagtctatctgattctatttgctaatt

SEQ ID NO: 19370 - DNA, 601 bp, Human
aaacatgtcctgagtcactaaatgctgacatttgtttttcatgttaagagtgtaaataactggtcccaaatataatattattacatcagataaaaactggaatgtgaacctcttaacttgattgtgaaagtatttgccaatggtgcctcttgataattatttgaggctcacttcagaactcctctggaagggttaatttttaaatagtcattttataaattaacatttttgacatatgtgatggctctcaaattttttcttttatgccagtttgaatcatttctgctcaatttttttttttaattgggatggagtctcactctgttgcccaggctggagtgcagtgatgcaatcttggctgactgcaacctccacctcctcggttcaagcgattctctcgcatcagcctccagagtagctgggattacaggcgcgcaccaccatgcctggataatttttgtattattactagagatggggtttcaccacgttggccaggctggtcttgaactcctgaactcctgacctcaagtgatccacctgcctcagcctcttaaagagctggaattataggtgtgagccactgcaccaggccctgttc

SEQ ID NO: 19371 - DNA, 601 bp, Human
aatttaagaatttgaatttctgagtatttatgataagtgttgaaataacttcttatatgtgacagtgaatactggcagagcaaatgccaaatcaatgccaaatctgtaggatcatttgattgtaggaacagaattctactcaaaccgaaagcaggcatttgctggagttacagaaaggcctcatggaacaccgagaaggtggtgccattcgactcttaaagaagctgcaacaggcacaagagagtcagctgcagctcttcttcttgagtctatatctgtcctgggtccattcctttttgtrgttgcttcattcctttctctctctgaagactggtttttctggtctaccagggctatgccacattgactttatgtagtgtctccattctggcctcctgaatttacaggagagttcctctgtacaaactcaaagtcctggagagaacagaaaacagcttccttttggctcaggggtccaactgcagtctactctgctgctatgaggatagtgggttcaccacctttgttgttctctcagctagggcagtgggaaatgactctatgaaaggaatatacatgggcaggcaaatgtactaatcct

SEQ ID NO: 19372 - DNA, 601 bp, Human
cagatgctgtttggacactcttcccctgcttttggtctctttgtaaagcagctcatctggatacaggatctcttttccccattgcccattctaatatatgttaccgttattacttatagaataatagtagaagagacaaatatggtacctacccattaccaacaacacctccaataccagtaacattttttaaaaagggcaacactttcctaatattcaatcgctctttgatttaaaatcctggttgaatacttactatatgcagagcattattctattagtagatgctgtgatgaactgmgatttaaaaattgttaaaattagcataaaattgaaatgtaaatttaatgtgatatgtgccctaggagaagtgtgaataaagtcgttcacagaagagagaaataacatgaggttcatttacgtcttttgtgcatctataggagaaggagaaggaagagttggtattatcctgactttagccatgaatatcatgagtacattgcagtgggctgtaaactccagcatagatgtggatagcttggtaagtcttatcatctttttaacttttatgaaaaaaattcagacaagtaacaaagtatga

SEQ ID NO: 19373 - DNA, 601 bp, Human
gatctgttctcagtaaggcgaagatcttgctgcttgatgaacccagtgctcatttggatccagtgtgagtttcagatgttctgttacttaatagcacagtgggaacagaatcattatgcctgcttcatggtgacacatatttctattaggctgtcatgtctgcgtgtgggggtctcccccaagatatgaaataattgcccagtggaaatgagcataaatgcatatttccttgctaagagtcttgtgttttcttccgaagatagtttttagtttcatacaaactcttcccccttgtcaacayatgatgaagcttttaaatacatgggcctaatctgatccttatgatttgcctttgtatcccatttataccataagcatgtttatagccccaaataaagaagtactggtgattctacataatgaaaaatgtactcatttattaaagtttctttgaaatatttgtcctgtttatttatggatacttagagtctaccccatggttgaaaagctgattgtggctaacgctatatcaacattatgtgaaaagaacttaaagaaataagtaatttaaagagataatagaacaatagacatattatca

SEQ ID NO: 19374 - DNA, 601 bp, Human
acaaatgtatggattttattgacaagtgatattttcttacagtaataaatataatgcagtcttcttaagagtcagtttggagttgagaaggcagtgtacccttgatggaaacagtcagactggtggtaccatcttcttcagaactgcatctaagaggctgtgctggctgggaatcatacagctgtgggcaacaactgcatcagccccaaggcttccctccagaccaaaaggtgattcatggcccctggttaatatcaccctaggttctcccctgtcccagttttaacataatatttcataraaatactagtgccataaaaagtcaatatttcaaatataaaaattattttatacaaatgtaattcataatcattcttttaaaatacagcattgttatatatgtttgaaacattattaaaataaatatttcctagagaaaaaattttgcttcacaaaattataaaacagaagcatataaaactaattcatgattggtgcttcttcagtgtgtctctcattctctcttagtgtagacagcatgaagtacatacatctagcctgaaaacataccaccatcaacctatacatctaaatgcttgga

SEQ ID NO: 19375 - DNA, 601 bp, Human
acaggcagcctcttcatcttctcattgttttttcctaattctactccttcatgttcccagttcctctcaaactgggaaagatagtaagcccatataactgcacttctaatctcagaagtttttttttctaattacaattgttgttttataaaagctgggaatactctttcatttaacaatctttttcaacagtcatttgttgttgaggccctccaatgtgccaggcattgcactagacactgggacacagagacaaataagattcattttctgctctcaaaaagcagagataacgccaggygtggtggctcacacctgtaatcccagcactttgggaggccaaggtgggcgggtcacttgaggtcaggagttcaaggccagcctggccaacatggtgaaacctcatctccactaaaaatacaaaaattagccaggtgtggtggcgggaacctgtaatcctagctactcaggaggctgaggcaggagaatcgcttgaacccaggaggcggaggttgcagtgagccaagatcacaccactgtacaccagactgggcaacaagagcaaaacactgtctcaaaaaaaaaaaaaagaagcagagac

SEQ ID NO: 19376 - DNA, 601 bp, Human
gaaacttctcatggaggtcttacagatgccccttgaggttggggtgcatagagttttcaaaaatatcctggctgggcacggtggctcatgcctaatcctagcactttgggaggctaagacaggaggattgcttgagcccaggagtttgagaccagcctgggcagcatagagagactccttctgtaaaaaaaaaaaaaaaaaaaaaaaaaaaaaattcaattagctgggcatgatgctgcacatctgtagtcccagctactcaggaggctgagacaggaggtatcacttgagccaggagttygaggctgcagtgagccatgactgtgcactccagtctgggtgacagaatgaggccctgtctctaaaaacaaaactaaacaaaacaaatttctagcgtaattcccaaagtagataactttcagtggtagtgggaataccgcagattcctgttttgagtgggattttcagtggtgtgcaggagctggctggtatcggctctcaggagctaacggtgcacatctcttcccaactctgccttcagtgatatcacattggtagcttaaaatcaacgatgggagagtattcacaccattgacagagg

SEQ ID NO: 19377 - DNA, 601 bp, Human
ggttagtcactcattttcctttatttgtaaggaaaaaaataattccttaggtgaagcagagactttgctagggttgagatctataagaaacttctcatggaggtcttacagatgccccttgaggttggggtgcatagagttttcaaaaatatcctggctgggcacggtggctcatgcctaatcctagcactttgggaggctaagacaggaggattgcttgagcccaggagtttgagaccagcctgggcagcatagagagactccttctgtaaaaaaaaaaaaaaaaaaaaaaaaaaaaaaatcaattagctgggcatgatgctgcacatctgtagtcccagctactcaggaggctgagacaggaggtatcacttgagccaggagttcgaggctgcagtgagccatgactgtgcactccagtctgggtgacagaatgaggccctgtctctaaaaacaaaactaaacaaaacaaatttctagcgtaattcccaaagtagataactttcagtggtagtgggaataccgcagattcctgttttgagtgggattttcagtggtgtgcaggagctggctggtatcggctctcaggagctaacggtgc

SEQ ID NO: 19378 - DNA, 601 bp, Human
cagaatgcacagatacacacacatacacacaagaccattaaacagagaaaataccacttaagaggtgcagatgaaggtaatggaatacagataagtcatgatttcctatattgttgatataatcaaatcataattttgcattgagtttcctggcagccaaaggaaaaagaaggttagtcactcattttcctttatttgtaaggaaaaaaataattccttaggtgaagcagagactttgctagggttgagatctataagaaacttctcatggaggtcttacagatgccccttgaggttgggrtgcatagagttttcaaaaatatcctggctgggcacggtggctcatgcctaatcctagcactttgggaggctaagacaggaggattgcttgagcccaggagtttgagaccagcctgggcagcatagagagactccttctgtaaaaaaaaaaaaaaaaaaaaaaaaaaaaaattcaattagctgggcatgatgctgcacatctgtagtcccagctactcaggaggctgagacaggaggtatcacttgagccaggagttcgaggctgcagtgagccatgactgtgcactccagtctgggtgac

SEQ ID NO: 19379 - DNA, 601 bp, Human
aatccagtgtttcttgaagcattaatagaagccttggcaaggcgggccccctcctcccaattgtaattgctggaactcttcagttcaccccagttccacccttgccccccggccttccttccccagcacacttcatcatccctatggcctgcctggacctggcatttgggtcatttgagtaacagctgctctgaggaattcacattggaacaaagaccccctcttgtgccagtctgagatggcatttctcacctccatagtctgctcgggaggcatacactctctcttggtctcctgcccyctttccaccacacatcatcatctctgtccctccatgggcatcacctcccacctccacatacccctgccaatcccccacacatatcattcatttgctcacagacaccagccaagcccccagcctcctgtgaggtctctcaccgggtccagcatgaagcagttgaccccacagtccatggcaaggaccagcatggtggcactgccatacagtgcgtagccggctgccaccaggttccggcctggttgcagagcatccttctcagaaggctcatcagttgatttctagagcaagaaagaaatc

SEQ ID NO: 19380 - DNA, 601 bp, Human
aggctggggaatgatgggccaggcctgaacgggacgacatgaaggagaagccgtatgctggctcacagtggccaggctgcctgcattcaggtccccacactgccactcattggctggaagccttgagccaattacttcacctctcctcgtccattttgtcatctataaaatggattattcagagtatctgattcattgggttattgtgaagattaaatgagttatctaatgttatatgcatcagcagttattattgtcatcatcattattatttgacacaaagcaagggagacttttttttaaggaggaataagtttatttctcctccatccactcaaaatatatcttaacaccagtggcattatggagacagcatttggttagggagtgccaagcattctacagcatttgatggtggaaatagtcatgctttttatttctgctctctaggaatgtaaggtgcacagcaggtcagggtactgctgtgtgagacaaaaggtccaggtagaggcaattctccggatgcaggcagggcaggtgctcactgggcagagtgcttctcatacaccttcaggaactcgagcacgtcgtcgggggaccc

SEQ ID NO: 19381 - DNA, 601 bp, Human
ggccttccttccccagcacacttcatcatccctatggcctgcctggacctggcatttgggtcatttgagtaacagctgctctgaggaattcacattggaacaaagaccccctcttgtgccagtctgagatggcatttctcacctccatagtctgctcgggaggcatacactctctcttggtctcctgccctctttccaccacacatcatcatctctgtccctccatgggcatcacctcccacctccacatacccctgccaatcccccacacatatcattcatttgctcacagacaccagcyaagcccccagcctcctgtgaggtctctcaccgggtccagcatgaagcagttgaccccacagtccatggcaaggaccagcatggtggcactgccatacagtgcgtagccggctgccaccaggttccggcctggttgcagagcatccttctcagaaggctcatcagttgatttctagagcaagaaagaaatcaaagaatgtttttgttttgttttgtgattcttttttacagttcaaccattaacaggaggcattctcaaggtgctcttctaatgaaatagggcatcttcccagaggggcct

SEQ ID NO: 19382 - DNA, 601 bp, Human
aaaaagaaagaaagaaagactgcaccagttaactgaaggtttgtgtaaatgtacacgaataaatgtgggagctatttttgaagaagcaatgtcgtccactgcttcagttggcacacccattcgtctcaggaaaacagccttttggtgactaaagtagaaaagctagaaatggatggatacagtttatggcaaacagaatatctacagccccatcaggtccataaatgcattttagttggccagcatagtgttgcacacatgcagaaacattatgttttttacaatccagtgtttcttgaascattaatagaagccttggcaaggcgggccccctcctcccaattgtaattgctggaactcttcagttcaccccagttccacccttgccccccggccttccttccccagcacacttcatcatccctatggcctgcctggacctggcatttgggtcatttgagtaacagctgctctgaggaattcacattggaacaaagaccccctcttgtgccagtctgagatggcatttctcacctccatagtctgctcgggaggcatacactctctcttggtctcctgccctctttccaccacacatcat

SEQ ID NO: 19383 - DNA, 601 bp, Human
gatcacgccactgcactccagcctgggagacagggcaagactacatctcagaaaaaaaaaaaagaaagaaagaaagactgcaccagttaactgaaggtttgtgtaaatgtacacgaataaatgtgggagctatttttgaagaagcaatgtcgtccactgcttcagttggcacacccattcgtctcaggaaaacagccttttggtgactaaagtagaaaagctagaaatggatggatacagtttatggcaaacagaatatctacagccccatcaggtccataaatgcattttagttggccarcatagtgttgcacacatgcagaaacattatgttttttacaatccagtgtttcttgaagcattaatagaagccttggcaaggcgggccccctcctcccaattgtaattgctggaactcttcagttcaccccagttccacccttgccccccggccttccttccccagcacacttcatcatccctatggcctgcctggacctggcatttgggtcatttgagtaacagctgctctgaggaattcacattggaacaaagaccccctcttgtgccagtctgagatggcatttctcacctccatagt

SEQ ID NO: 19384 - DNA, 601 bp, Human
gcgaaaccccgtctctactaaaaatacaagtgtggtggcaggcgcctgtagtcccagctactcaggagctgaggcaggagaatcgctcgaacccaggaggcagaacttgcagtgagccgagatcacgccactgcactccagcctgggagacagggcaagactacatctcagaaaaaaaaaaaagaaagaaagaaagactgcaccagttaactgaaggtttgtgtaaatgtacacgaataaatgtgggagctatttttgaagaagcaatgtcgtccactgcttcagttggcacacccattcrtctcaggaaaacagccttttggtgactaaagtagaaaagctagaaatggatggatacagtttatggcaaacagaatatctacagccccatcaggtccataaatgcattttagttggccagcatagtgttgcacacatgcagaaacattatgttttttacaatccagtgtttcttgaagcattaatagaagccttggcaaggcgggccccctcctcccaattgtaattgctggaactcttcagttcaccccagttccacccttgccccccggccttccttccccagcacacttcatcatcc

SEQ ID NO: 19385 - DNA, 601 bp, Human
aaaagttaaaaaagttggccaggcatggtggctcatgcctgtaatcccagcactttgggaggctgaggcgggcagatcacctgaggttaggagttcgcgaccagcctgaccaacatggcgaaaccccgtctctactaaaaatacaagtgtggtggcaggcgcctgtagtcccagctactcaggagctgaggcaggagaatcgctcgaacccaggaggcagaacttgcagtgagccgagatcacgccactgcactccagcctgggagacagggcaagactacatctcagaaaaaaaaaaaaraaagaaagaaagactgcaccagttaactgaaggtttgtgtaaatgtacacgaataaatgtgggagctatttttgaagaagcaatgtcgtccactgcttcagttggcacacccattcgtctcaggaaaacagccttttggtgactaaagtagaaaagctagaaatggatggatacagtttatggcaaacagaatatctacagccccatcaggtccataaatgcattttagttggccagcatagtgttgcacacatgcagaaacattatgttttttacaatccagtgtttcttgaagcatta

SEQ ID NO: 19386 - DNA, 601 bp, Human
cacagtcagcaaacatcagtggtgcccgaaattccatcctgggctcaggtggaactttgctctggttctgccactaactcccccaccccacccctacccaggtcaccacatttggcgactttaactagtgctattaccctacccttgtttatttgttaagtgcccatgcttccaaggaggtgaaagtccacttccctgacagcctgggacaaaggcagcctgtgttgagttagccttcctgccacacacagacccggcctcacctccagcagcctatctcgcacagaaggttcctattccytgtctgttcctggggttcagtttgccagcaaaaagcactttacacatagttcactaatgtcataggaggacatctctaaaagttaaaaaagttggccaggcatggtggctcatgcctgtaatcccagcactttgggaggctgaggcgggcagatcacctgaggttaggagttcgcgaccagcctgaccaacatggcgaaaccccgtctctactaaaaatacaagtgtggtggcaggcgcctgtagtcccagctactcaggagctgaggcaggagaatcgctcgaacccaggaggcagaac

SEQ ID NO: 19387 - DNA, 601 bp, Human
caaatcacagtcagcaaacatcagtggtgcccgaaattccatcctgggctcaggtggaactttgctctggttctgccactaactcccccaccccacccctacccaggtcaccacatttggcgactttaactagtgctattaccctacccttgtttatttgttaagtgcccatgcttccaaggaggtgaaagtccacttccctgacagcctgggacaaaggcagcctgtgttgagttagccttcctgccacacacagacccggcctcacctccagcagcctatctcgcacagaaggttcctrttccttgtctgttcctggggttcagtttgccagcaaaaagcactttacacatagttcactaatgtcataggaggacatctctaaaagttaaaaaagttggccaggcatggtggctcatgcctgtaatcccagcactttgggaggctgaggcgggcagatcacctgaggttaggagttcgcgaccagcctgaccaacatggcgaaaccccgtctctactaaaaatacaagtgtggtggcaggcgcctgtagtcccagctactcaggagctgaggcaggagaatcgctcgaacccaggaggc

SEQ ID NO: 19388 - DNA, 601 bp, Human
ggcccggcaaatcacagtcagcaaacatcagtggtgcccgaaattccatcctgggctcaggtggaactttgctctggttctgccactaactcccccaccccacccctacccaggtcaccacatttggcgactttaactagtgctattaccctacccttgtttatttgttaagtgcccatgcttccaaggaggtgaaagtccacttccctgacagcctgggacaaaggcagcctgtgttgagttagccttcctgccacacacagacccggcctcacctccagcagcctatctcgcacagaargttcctattccttgtctgttcctggggttcagtttgccagcaaaaagcactttacacatagttcactaatgtcataggaggacatctctaaaagttaaaaaagttggccaggcatggtggctcatgcctgtaatcccagcactttgggaggctgaggcgggcagatcacctgaggttaggagttcgcgaccagcctgaccaacatggcgaaaccccgtctctactaaaaatacaagtgtggtggcaggcgcctgtagtcccagctactcaggagctgaggcaggagaatcgctcgaaccc

SEQ ID NO: 19389 - DNA, 601 bp, Human
cagcctggctttgcagcaagcgcaaacaaagaggaagcacttagcacctccctggcgggaggctcagccccgtcaggcaccgcagacagaagggctggaatcaaatcccagcagccctgcattgcgcttccaaacattcaggactgaggagggcaaaagactatcaaacacacagaagcttccctacagggatgctcccctgcaatctggaaacaagaagggattgaatgttttctctgcttccaccaactcaaaggtaacaagagaaggcaccagaagaatgggaagcagtcagggcccrgcaaatcacagtcagcaaacatcagtggtgcccgaaattccatcctgggctcaggtggaactttgctctggttctgccactaactcccccaccccacccctacccaggtcaccacatttggcgactttaactagtgctattaccctacccttgtttatttgttaagtgcccatgcttccaaggaggtgaaagtccacttccctgacagcctgggacaaaggcagcctgtgttgagttagccttcctgccacacacagacccggcctcacctccagcagcctatctcgcacagaaggttcc

SEQ ID NO: 19390 - DNA, 601 bp, Human
tagaaaagaaagccatctcacaacagttgctgggtgcagagcgcagggcccagccagactgtccatggtgcaaaggagggaagtctgtgtacagagacaaaacataaaagctcccagaaagttgaagccgctggaaacccgagtacagctgtagcagtgttttcagcagaaaccgtcagcctggctttgcagcaagcgcaaacaaagaggaagcacttagcacctccctggcgggaggctcagccccgtcaggcaccgcagacagaagggctggaatcaaatcccagcagccctgcattgygcttccaaacattcaggactgaggagggcaaaagactatcaaacacacagaagcttccctacagggatgctcccctgcaatctggaaacaagaagggattgaatgttttctctgcttccaccaactcaaaggtaacaagagaaggcaccagaagaatgggaagcagtcagggcccggcaaatcacagtcagcaaacatcagtggtgcccgaaattccatcctgggctcaggtggaactttgctctggttctgccactaactcccccaccccacccctacccaggtcaccacatttggcga

SEQ ID NO: 19391 - DNA, 601 bp, Human
tgaggtgagaacttcatcgtgggctcagtgtagacggaagcccaatccactccatccctgcttcctttcacctttagggtaagtcatcaaccaatagatttccacactgctcaggagccccacatgaggcccaaggccctcgatcccaaggatccctttcatctccgggggatgcccctgcctccagaacggcctctggtgccagatgcccagaacctgcaccaccctccccgggccctcacttactggggggaacttcttcctctggatgtactcagtgacggcagggtcaaagtccttrgcgtagccctcgttaaggctgtagattttacctttcttttttatcttcacatccttgtccaccaaaatgaactccccgatggcctttttagacaaggaaggaaaggtggagagatgacgagcgcactgggtcccccaggcctggatgaggcgagcgatgggctgggctacgctgggctggggtcgcggcgcacgggcaccactcatcttggggccccgagacacctgccaggctctctgggaactgtgaatggggtgaggggaagcaagacaatgctgcagaagccatcagggtgataac

SEQ ID NO: 19392 - DNA, 601 bp, Human
aaagtagcaaaggctgacatggagactgatttttgatgtctcagggtgagaattccagtctccagtactgaggtgagaacttcatcgtgggctcagtgtagacggaagcccaatccactccatccctgcttcctttcacctttagggtaagtcatcaaccaatagatttccacactgctcaggagccccacatgaggcccaaggccctcgatcccaaggatccctttcatctccgggggatgcccctgcctccagaacggcctctggtgccagatgcccagaacctgcaccaccctccccrggccctcacttactggggggaacttcttcctctggatgtactcagtgacggcagggtcaaagtccttggcgtagccctcgttaaggctgtagattttacctttcttttttatcttcacatccttgtccaccaaaatgaactccccgatggcctttttagacaaggaaggaaaggtggagagatgacgagcgcactgggtcccccaggcctggatgaggcgagcgatgggctgggctacgctgggctggggtcgcggcgcacgggcaccactcatcttggggccccgagacacctgccagg

SEQ ID NO: 19393 - DNA, 601 bp, Human
agttatctaatgttatatgcatcagcagttattattgtcatcatcattattatttgacacaaagcaagggagactttttttaaggaggaataagtttatttctcctccatccactcaaaatatatcttaacaccagtggcattatggagacagcatttggttagggagtgccaagcattctacagcatttgatggtggaaatagtcatgctttttatttctgctctctaggaatgtaaggtgcacagcaggtcagggtactgctgtgtgagacaaaaggtccaggtagaggcaattctccrgatgcaggcagggcaggtgctcactgggcagagtgcttctcatacaccttcaggaactcgagcacgtcgtcgggggaccccaagatcaccggcgccctctggtgaatgtctgtgggaatgacgtctaacacggcctccttcccagtggtggccattcccccagccttctccatgacgtaggccatggggttgcattcgtacagcagtctcagctggaaaacaagaccgggtagcggcctccttgtatcagaaggtattgcgtaaaaaagagacttttctgcagcaaaacatgcagagctg

SEQ ID NO: 19394 - DNA, 601 bp, Human
ctgaacaaggctggggaatgatgggccaggcctgaacgggacgacatgaaggagaagccgtatgctggctcacagtggccaggctgcctgcattcaggtccccacactgccactcattggctggaagccttgagccaattacttcacctctcctcgtccattttgtcatctataaaatggattattcagagtatctgattcattgggttattgtgaagattaaatgagttatctaatgttatatgcatcagcagttattattgtcatcatcattattatttgacacaaagcaagggagactttttttaaggaggaataagtttatttctcctccatccactcaaaatatatcttaacaccagtggcattatggagacagcatttggttagggagtgccaagcattctacagcatttgatggtggaaatagtcatgctttttatttctgctctctaggaatgtaaggtgcacagcaggtcagggtactgctgtgtgagacaaaaggtccaggtagaggcaattctccggatgcaggcagggcaggtgctcactgggcagagtgcttctcatacaccttcaggaactcgagcacgtcgtcggg

SEQ ID NO: 19395 - DNA, 601 bp, Human
cacgccttccaggatgacgatgatctcgaggtcctggtggtggtgcaggtcgctgggtgccaggtcgtagagtgggctgttggcatcaatgacatggtagatgatcagcggggccaccaggaagatgctgttgccacccacgccgttctccatggggatgtccacctggtggaggggcaccacctcgccctcggggctggtggtcttgcgtaccacctgcatgtggatggtggcgctgatgatcatgctcttgcggaggtcacccacacgtagcatgaagcagaggcggccgtggcgcagrgcgatcaccgcatgcttgctgaagatgagggtctcagccctgcggtgggcttgggcagtcttcatgaagatgcagccaagcatgatggcgttgatcatgagccccacgatgttctgcacgatgaggatcaggatggccagtgggcactcctcagtcaccatgcgccccccaaagccaatagtcacttggacctcaatggagaaaaggaaggcagacgagaaggagtggatgctggtgacacagggctcagcagtgccctcgctgggggccaggtcaccgtgggcgaaggcgatgagccac

SEQ ID NO: 19396 - DNA, 601 bp, Human
gccttgtaacaccctggatgagcagcagggggaggctgagctgaggctggcccagcctcacaccaggccctggccgggctacataccacatggtccgtgtgtacacacgcgtgtggggggcccgagagaccatggctcaggacagggaatctggagagatgctgaacttgggcttggccttggccatgggcacgctgcgcttgcgcaggggcccgcgggctgaggcgagggtcagagcttccagtaggctgtggtcctcatcaagctggcgggccgtgcagagtggtgtgggcactttgayggtgttgccaaacttggagtagtccacagagtaacgtccgtcctcctcagctacaatgggcacaaagcgctggccccacaggatctcatcggccaggtaggaggtgcgggcctgggtggtgatgcccgtggtttccaccacgccttccaggatgacgatgatctcgaggtcctggtggtggtgcaggtcgctgggtgccaggtcgtagagtgggctgttggcatcaatgacatggtagatgatcagcggggccaccaggaagatgctgttgccacccacgccgttctccatggggatgtc

SEQ ID NO: 19397 - DNA, 601 bp, Human
cagtgcaaaaatacaaaaattagctggatgtgcttgtttgaacccaggaggcagaggttgcagtgagccgagatcgcaccactgcactccagcctgggtgacagagtaagactgtctcaaaaaaattaaaaataaggagaacgtgttaggggatgcctgtaccatggaaagagctcattgtattgtatataccggactcgaaggttctggacaccagggttacctgggcagtggccacatttaggaagtaatcgaccagctccttggcgttgtactcggggctgcgagggtcctccaccascggctgatcgacacacagcacatcccagcacagattccttggcgggttgtaaccattgggaagcacacctgcaggtcacaccaagttcaaggggtggcccatcacccagaccttccctggtttcaaagccggccatgtcccacccaggatgggcttcagaatttgtgtcccaatgcaaaaggaaatgcagggcctttgttcccagactataggaattccaggacagtgacaacagagcagatatcaagcccagggcccttctgagtgtgtggcaccatggctggccctgccctcaccaag

SEQ ID NO: 19398 - DNA, 601 bp, Human
acaatagaacaatagaaaacaaagacagcactgagagctatgcacataacccaaggcccccggatgcaagcgcacatgtgcacaagggtaccacagggtaggcgcactgacctgcgcatttaccagccggatgagcttgtcaaggttcttgaaccacatgttggcattctcatattggaagtccgagcccatggtcatcacagtgtggttggtgcggtaataccggccctgcaggcaagaggggagtcctgaagccagaggatcctgggccatccctgtgtatagctgtgttttgatgtayatggggtcaaggatgttgggtgcacaggcatgggtgggggtatggcacttgggagcgtggggacacagataaaagtagccaccagttgttgagcagttctcttggacccactacctagaagagggcatccagtcaccatgccatgctatctcttgcccagcctatgctatctcttctaatgaggaatgcacataaatccaggagggggacattgtgatggtgaatagaatagcatcttcctccagggggcatgagaacatgattacaggggctcacacctgtaatcccagctactcagga

SEQ ID NO: 19399 - DNA, 601 bp, Human
ccggcctcatgctggacttcttacctacagaactgtaagacaatgtatttctgttgttttgagctgctaagtgtgtggtcatttgttatagaatgaccacaatagaacaatagaaaacaaagacagcactgagagctatgcacataacccaaggcccccggatgcaagcgcacatgtgcacaagggtaccacagggtaggcgcactgacctgcgcatttaccagccggatgagcttgtcaaggttcttgaaccacatgttggcattctcatattggaagtccgagcccatggtcatcacartgtggttggtgcggtaataccggccctgcaggcaagaggggagtcctgaagccagaggatcctgggccatccctgtgtatagctgtgttttgatgtatatggggtcaaggatgttgggtgcacaggcatgggtgggggtatggcacttgggagcgtggggacacagataaaagtagccaccagttgttgagcagttctcttggacccactacctagaagagggcatccagtcaccatgccatgctatctcttgcccagcctatgctatctcttctaatgaggaatgcacataaatccagg

SEQ ID NO: 19400 - DNA, 601 bp, Human
ctcgaattcctgacctcgtgatctgcccggctcagcctcccaacatgctgggattacaggcatgagccattgcgcccggcctcatgctggacttcttacctacagaactgtaagacaatgtatttctgttgttttgagctgctaagtgtgtggtcatttgttatagaatgaccacaatagaacaatagaaaacaaagacagcactgagagctatgcacataacccaaggcccccggatgcaagcgcacatgtgcacaagggtaccacagggtaggcgcactgacctgcgcatttaccagcyggatgagcttgtcaaggttcttgaaccacatgttggcattctcatattggaagtccgagcccatggtcatcacagtgtggttggtgcggtaataccggccctgcaggcaagaggggagtcctgaagccagaggatcctgggccatccctgtgtatagctgtgttttgatgtatatggggtcaaggatgttgggtgcacaggcatgggtgggggtatggcacttgggagcgtggggacacagataaaagtagccaccagttgttgagcagttctcttggacccactacctagaagagggca

SEQ ID NO: 19401 - DNA, 601 bp, Human
tacatggcaaaaggggaattaaggttgcagatggaattgaggttgttcatcagccaaacttaaagtagggaaattaggccacacagtggctcacatctgtaatcccagcaccttgggaggccgagcggggtggatcacgaggtcaagaaatcgagaccatcctggccaacatggtgaaaccctgtctactaaaaatacaaaaattagctgggcgtggtggcacgcgactgtagtcccagctacttgggaggctgagacagaagaatcacttgaacccaggaggcggaggttgcagtgagcsgagagcacgccactgcactccagcctgggcgacagagcgagactccgtctctaagtaaataaataaaatgtggaagagagaggcagaagaggtgagaatgagagaaagggatgtgattacagaaacagggtcagaaagatgctatgtggctggctttgaagatggagccaagaatagattttgaatgtgggtaacttctagatgttggaaaaagcaaggaaattatattctctcctagagactgcagaaggaacacagccttgccaacaccttgattatagcctggtgagactcaggctg

SEQ ID NO: 19402 - DNA, 601 bp, Human
aagtgtccatgtcctgatccccagaacctattaccacattagattacatggcaaaaggggaattaaggttgcagatggaattgaggttgttcatcagccaaacttaaagtagggaaattaggccacacagtggctcacatctgtaatcccagcaccttgggaggccgagcggggtggatcacgaggtcaagaaatcgagaccatcctggccaacatggtgaaaccctgtctactaaaaatacaaaaattagctgggcgtggtggcacgcgactgtagtcccagctacttgggaggctgagrcagaagaatcacttgaacccaggaggcggaggttgcagtgagccgagagcacgccactgcactccagcctgggcgacagagcgagactccgtctctaagtaaataaataaaatgtggaagagagaggcagaagaggtgagaatgagagaaagggatgtgattacagaaacagggtcagaaagatgctatgtggctggctttgaagatggagccaagaatagattttgaatgtgggtaacttctagatgttggaaaaagcaaggaaattatattctctcctagagactgcagaaggaacac

SEQ ID NO: 19403 - DNA, 601 bp, Human
gctggtctccaactcctgtcttcaagtgatccgcccacctcagattacaatcccaacactttgggaggccaaggcggacggatcacctgaggtcaggagttttgagaccagcctggccaacatagtgaaaccctgcctctactaaaaatacaaaaattagccagggttggtggcacatgcctgtagtcccagctacttgggaggctgaggcaggagaatcactagaacccaggaggcagaggttgccatgaggcaagatcatgccactgcactccagcctgggtgacaaagcaagactcttgtctcaataaataaataaataaataaaattttaaaaagaaaaaataaataaaaataaatgacataaaagagctgttttggtgaaatagcagtgctgggagcgagtggaaggtgggaatggagattgcaccgtagtgaggacaagattgatgggaaggggtgtctgagatgggagaggggagacaagtttctgtgctgatgagagtgactgactgtgcacacagccacagccacaggccacttagtgcaaaacactaacacatctgtgttgggtaaaatgataactgcccaaaagtgtcca

SEQ ID NO: 19404 - DNA, 601 bp, Human
taattccaactttattattaaaaacttttgtggaaaaactaagtgtgacattatagggcaggaataatcgttttgcaggactgtcagattgttaccaaaaaacacaactttttttttttgggacggagtcttactttgttgcccaggctgtagtgcagtggctcaatctcagctcactgcaagctccacctcttgggttcacgccattctccagcctcagcctcatgagtacctgggactacaggtgcccgccaccacacccggctaattttttgcattttttagtagagacggagtttcmccgtgttagccaggatggtctcgatctcctgacctcatgatccgcccgcctcagcctcccaaagtgctgggattacaggcatgagccaccgtgcccggcctagacacaatttttataatgaatggaggtgcactttcacctgagcaaggtggaggaacaagaaagtgacctatgtgaggaaaaggatgtttgttttgcacgagctgtgtcccccaatgtacacagtaggtgctcaataaacttttttttttttttttttttttgagactgagtctgactctgtcgcccaagctggagtgc

SEQ ID NO: 19405 - DNA, 601 bp, Human
cacactgagctccttgtggctcctggaattctgcacactctcctgctcgaaggcttttatgcctgttattctctccccacctggatctctcttccttcaaatagccacacggctccctccctcaggtcatatcttaaatgtcacctttatcgggaacaccttccctgaaacgtccctgccaaaattgcgaaccaccacctgccaccaactctgacatgtctgtcaagtgtcacccatgatcacactgggtcctcataacagtcccaggaaaggacactgaggctcagacaaaggtcacttrctcaaggacacacaatgaggggagttgtgacaggaggtcataagcctagggacctgctgacccagagtccacacagctcaccatgacacttcaaatttgtcacaggagcaggaaaggggattgaaatggggtctcacctcattttcgatggttaaagcaggggaccaggatcttctggggatgggctgtggtgcgcgggcctggggcttccagcgaggcacctgggctactgaataggtgctgaagcccagggcgggcagtgaggctgagaacagcagctccggagggtgcgcctggctg

SEQ ID NO: 19406 - DNA, 601 bp, Human
gactgagtctcactctgtagcccaggctagagtacagtggtgcaatcttggctcactgcaccccccacctcccgggttcaagtgattctcgtgcctcagctatccaagtagctgggattacaggtgcccaccaccccgcctggctaattttcatatttttagtagagacagggtttcaccatgttggccaggctggtctcaaacccctgaactcaagtgatctgctcaccttggcctcccaaagtactaggattacagacataagccactgtgcccagccggatttttattttttttttttgagacagaaacttgctgtgtcgcccaggctggagtgcaggggcgcaatctctgctcactacagcctctgcccctgggttccagcaattctcctgcctcagcctcctgggtagctgggattacaggcacatgccaccatgcctggctaatttttgtatttttagtagagacggggtttcgccatgttggtcaggctggtctccaactcctgacctcaggtaatccacccgccttggcctcccaaagggctgggattacaggcgtgagccactgcacctggcctgggttttttgtttttttt

SEQ ID NO: 19407 - DNA, 601 bp, Human
ccgagcaccaccaccccaccctcaggcctggtgatcttcccttaccagaagaaggtctggcgaacaggcagcaggagttgctgattcatgttcataatctccatcaacagccctgtgtcaggatcaaacgttgcccggatgtgctgggcagaaaagggtccacagatgggtttgtgtgtgtatgtgtgtgtgttttctttttttaatttttcttttttctttttttttttttgagactgagtctcactctgtagcccaggctagagtacagtggtgcaatcttggctcactgcaccccccmcctcccgggttcaagtgattctcgtgcctcagctatccaagtagctgggattacaggtgcccaccaccccgcctggctaattttcatatttttagtagagacagggtttcaccatgttggccaggctggtctcaaacccctgaactcaagtgatctgctcaccttggcctcccaaagtactaggattacagacataagccactgtgcccagccggatttttattttttttttttgagacagaaacttgctgtgtcgcccaggctggagtgcaggggcgcaatctctgctcactacagcct

SEQ ID NO: 19408 - DNA, 601 bp, Human
gtcacctatactggcgttgtacctggagttggggcaggtgagagtcaggtaaggggccctagctccatgccgagcaccaccaccccaccctcaggcctggtgatcttcccttaccagaagaaggtctggcgaacaggcagcaggagttgctgattcatgttcataatctccatcaacagccctgtgtcaggatcaaacgttgcccggatgtgctgggcagaaaagggtccacagatgggtttgtgtgtgtatgtgtgtgtgttttctttttttaatttttcttttttctttttttttttttgagactgagtctcactctgtagcccaggctagagtacagtggtgcaatcttggctcactgcaccccccacctcccgggttcaagtgattctcgtgcctcagctatccaagtagctgggattacaggtgcccaccaccccgcctggctaattttcatatttttagtagagacagggtttcaccatgttggccaggctggtctcaaacccctgaactcaagtgatctgctcaccttggcctcccaaagtactaggattacagacataagccactgtgcccagccggatttttattttttttt

SEQ ID NO: 19409 - DNA, 601 bp, Human
acacccctctcccagcctgtgccactcaccccacaggtatcggccccaccgaccactctagctccaggtgccgctgtcctgggtacaggcgaaccacctgggaacaccaagctgagaagttctggtgcacctcctgcaccaagggtgtctgcgggcacacgggtgaggtggatgtcagtctgtacctgagcagaggtgagtcctacaaatgtcccccaaccctggccataaaccccattaaggcctacatcaaggtcaaccttcagtcaccgccacataattcttttttttttttttttttgagacggagtctcgctcttttgcccaggcgggagtgcagtggcgcgatctcggctcactgcaagctccgcctcccgggttcacaccattctcctgcctcagcctcccgagtagctgggactacaggcacccgccaccacacccggctaattttttgtatttttagtagagatggggtttcaccgtgttagcaaggatggtctcgatctcctgacctcgtgatcagcccgcctcggcctcccaaagtgctgggattacaggcgtgagccaccgcgcctggcccacataattcttttttctt

SEQ ID NO: 19410 - DNA, 601 bp, Human
cggctcactgcaagctccgcctcccggcttcacgccattctcctgcctcagcctcccgagtagctgggactacaggtgcccgccaccacacccggctgatttttttgtatttttagtagagacggggtttcaccatgttagccaggacagtctcgatctcctgaccttgtgatctgcccgcctcggcttcccaaagtgctgggattacaggcgtgagccactgcaccctgcctggctcccccgcccttcactctcccttcgtcctctgtctcccacactcatgtaatcagcaaatttcccycaccacccctgggccccaacacaccacagaccaccccctcagtgctctcagtcaccccccacctcctctccaggatctcccggccattgctgtctgtgtagaagcgtccctttgtctccagcggtgtgtcaaaacggctgatgacctccttcccccaggtgtcgctgtacccaatgggatggcaaggttgtgagccttggataaacccctctgcccttgcttccacacccctctcccagcctgtgccactcaccccacaggtatcggccccaccgaccactctagctccaggtgccgctg

SEQ ID NO: 19411 - DNA, 601 bp, Human
ccctgggagcggtcagtcagcacagtcagctgcatgtttccatcctgggagttgaagggtgaaagtagagggcagtcaaccccaaccccaggcagctttgagatgctgcagataaggggtgattccctttctatcgaggtggggaggtgcaggatgggggagagctaccgtgatgtaaatccgggtgttgactggatagtagtttcctgccacgggctccgtctggttcagtttccaggtgggtcgataatcccgcctggggttgggggtgagctgatcaggcttgggatctggctccccmactctttttttttttttttttttttgagatggagtctcgctctgtcacccaggctggagtgcagtggcgcgatctcggctcactgcaagctccgcctcccggcttcacgccattctcctgcctcagcctcccgagtagctgggactacaggtgcccgccaccacacccggctgatttttttgtatttttagtagagacggggtttcaccatgttagccaggacagtctcgatctcctgaccttgtgatctgcccgcctcggcttcccaaagtgctgggattacaggcgtgagccactgca

SEQ ID NO: 19412 - DNA, 601 bp, Human
ctattcatataactgaaaaaaaaattctttgggagtgtttttcttcctttgctacagaattattttttattaaataacttctgtgatgtattttctggaatcagtgtgctactatgtgaaaacaagttaagaaagctactgagatgcagtggttaaaataatcacagatcaagctctttgcttttcttttaataaaataaataaagttccaaaccctgagaacaagtttcactggagtgaatactgcaggggcatttgcctggacattttaccccatggacaccgctggccccgggagcargtgacacctcgctgggcaggtccctgggcctctgcacacagtcccggggcccctggagcaggtgacacctcgccgggcaggtccctgggcctctggacacagtcccagggcccctggagcaggtgacacctcgccgggcaggtccctgggcctctgcacacagtcccggggcccctggagcaggtgacacctcaccgggcaggtccctgggcctctggacacagtcccggggcccctggagcaggtgacacctcactgggcaggtccctgggcctctgcacacagtcccggggcccctgg

SEQ ID NO: 19413 - DNA, 601 bp, Human
ggtccctgggtctctggacacagtcttggggccatggcacagcactggcacctctgccctcaccagcctttcccaggactggaggccttgtctgtcgttcagggtcacagaatctggagtcctcgctgttcccagccacacccagcccagcctcctgctgggggccacattttaccccaatttttctgcatctcaggacttcacaaccatattaggagtggcagtgaagtccataacagactcgtaggctccttaaaaaaactctccctccacagcccccaggacttcctggtcactgccygctctgagatcagggaagccgtggggcctctccctgccagcttccatccatgccccaaggatgggctactcacccctaattcctgtccctcccctgcaaatggagaacactggaaaattactcatcgcagtcattatttgtgagcaagaatgagatacttcatttaaagcggtgaatgcagtacctcggcaatcaccaaaaaacaaaaaataaaaatggagtcacaatataaagaacctcaggaaaaagtgattttgcatcttcccagaataaatcagtcactctatcacctggaacatg

SEQ ID NO: 19414 - DNA, 601 bp, Human
agttgtgatacatgagagctattcaacaaaatatttaaaactttgtaacatgttttttaattttaaaaatcacatttaaaaagccatcaggaatgcagtagccacagcttttgctaaaacagtttttaaaaattatttttccatatctgggagatttgaccttttcgttttgcttaaacttttggttgacacatcacgagtgcacaggacagcagctgacaactgccccgcgtgctgggcacatgcttctgcctgctccaatatttcaaagctgacttattgtttgcttgaaatgtgaatragttactgaaaaaatattatgtgtctcacagtatttctattttacagcctttaatagttgttttgcagctttaaatctgtttggaaaatgatgcccaatgactgtgtgtgggtttatgtcacctgtgctcacagacatgtgaagcaaaaaccttggcctgctccccagcctctgtgcaggacaagccaaagagcaggcagcggcagggccaagaggatccaggctccccctggaccacacacggtcaccgtaagcacatggtgctccggggggtcctgcttggtgggtggctcaccctta

SEQ ID NO: 19415 - DNA, 601 bp, Human
aggccagtgccgtgactcacatctgcaatcccaacacagtatcaggccagtgccatgactcacatctgcaatcccaacactttgggaggccaaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtytaggtgacagagtgagaatccatctcaaaaaaaaaaaaaagagagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgt

SEQ ID NO: 19416 - DNA, 601 bp, Human
tcaggccagtgccatgactcacatctgcaatcccaacactttgggaggccaaggcgggaagatcacttgaggctaggagttcaagaccagcctgaccaacatggcaaaaccccatctctactaaaaatacaaaaaaaaattagctgggcgtggtggtgcccacctgtcatcccagctactcgggaggctgaggcacgagaatcagttgaacccaggaggtggaggttgcagagtcgagatcacaccactgcactccagtctaggtgacagagtgagaatccatctcaaaaaaaaaaaaaaragagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgccc

SEQ ID NO: 19417 - DNA, 601 bp, Human
agagagagagagaaaaaaagaaaagcatcagtcctggatagagtttaggttgtatcaacttgcctgcaaactgtaggaaggtgagaataagaagggaaagatcttggctggtgctcagactgggtgggtgcaggagagactcttgttccagagcaggatcccctagggtcaaagcacaaagagaaataaacttcagcacctgaaaattctgtaataagagtctttgaaaatggaaaaaaaatctatgcttgaccattgttgtctaagagaagtttgctatcaatccctcctctaacgcccygaacagaatgttcttcaccagaaccctgtgtattcatcaccacacaggctgagaggcattccagcatttgtgcaacatcaagatttatgtgcaattatctttatggcaaatgttccacaagttatagctgttaaaagaaaataagatgcaaatgaacaagaagaagcagaggcgctgcctgcagcctgggaaaatttgggaagctagcctaatgagtgaatttgttttaaaaggaaagttggcaaaccttattccagttcattaaatttcaacaaacagcaaggattaaagtaagaatca

SEQ ID NO: 19418 - DNA, 601 bp, Human
tccagagcaagtaattaagtcccgtgactccctagaactcagtgttcagttctgaaaaaaaacttcgggttcaaactccctaagtctatggtccttgcatcagacgcctcttccctgggattgctgggaactgaggaaggaagggcgctgcagagctaacgatagcaaggggctcagagctggccaccccagctccctggtggcaggagagctaatgtgagctgatggaaactgagaagcagcagataaaggaaaagccatctgccctgcctctattgcctaaaagtagaacataaatccrcaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaacgattgttcttttgctgaggggctgtgcagcagagttctaacgatccattcgagtttccatcttggggcgctcagggggctccc

SEQ ID NO: 19419 - DNA, 601 bp, Human
tgagctgatggaaactgagaagcagcagataaaggaaaagccatctgccctgcctctattgcctaaaagtagaacataaatccacaaaagtgaccatttccctctccaacagaaaggacagaaattcatcaccagggaccccaggccctcaacagcctggaaccagccccagaggcatttgtgtggcaaacctctgcagccccggcctcccttcctgtagttgccccagagaggcctcctcaaaacgtgtttcctgggaactcaaagtcctttgctttggtcttgcagcttcttggaaaaygattgttcttttgctgaggggctgtgcagcagagttctaacgatccattcgagtttccatcttggggcgctcagggggctccctcgtggaagcaggagtccaggctaataacccctgtgagttttcctcctgtgactctgccttttgtcagtctaatttcaatgccccagaaaattaatctaagatgcagggagagaaaaggtttcttcttcccctacagatggatgtcagtcatctctattcagccaagaagtagttaacctaaacaatgaaaacaccaccggttccagtagagacttg

SEQ ID NO: 19420 - DNA, 601 bp, Human
ttggtcttggtcgtgaatagcgcagaactttgcagagccctgaagagactctcagtgataggatgcatatacacaggtggtgtgagtgacagagctaattttttttctggtacctaaagatcagcaggatcaaaatttcataaaggaagagctgggagcttgagattgacaatttcatgagatgaaggataaattgtgcgttacctccacagctctgcaacatggagattggtcttgggcaggtggtggacgtcctggattctgaggaagacctgcacgcaattcagtgggcatcaggagmcttcagatgctttcatcaaaggcacaggcacaagcaggccttggtttagaaaggtcacttgggtgacagcaggagggacagaaggatggtggggagatcagtgcaggagccagtcaagagctccttctactaaggcagtagaaagtgagactgacaacggccaggcaggagcagaacgttctcccagagacattatggggaaattcacaccacatggtgagtgaaaggcaaggaaagccacggctgggcttcttgcttggggacttgagctggtagggtggttatttcaggctgttaaca

SEQ ID NO: 19421 - DNA, 601 bp, Human
aggaggatggcgtgactcaggagagaagttcaagtggaaaacgggcgtttgggagaggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacytgccaggccctcagcccagagccgtgcaaacttctctcttcagagcacacttgcgaggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcg

SEQ ID NO: 19422 - DNA, 601 bp, Human
aggaccaaaggagggtgagaggagagggcaaagatcagaggagccagaaatgcacccgaggtgacactcacaggagggagaccatggagagaagagagccacagtgaccgaggctgagagagagagtggccagagactgaaagcaaaaggcacgacggccgggagcactgaacgcttgccaggccctggaccaaaagccgtgcaaacctctctgtaaaaccatcctaagacgtaactctgtgcacttgccaggccctcagcccagagccgtgcaaacttctctcttcagagcacacttgcraggccctcggccaagagctgtgcaaacttctctctaaaaccatcctaagatgtaactctgcagctaggagagaaaaccgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcag

SEQ ID NO: 19423 - DNA, 601 bp, Human
cgcgccaggtgaagtgagctgccgcgtcactcggagattgatttgtctcactccagagcccatggccgtcacccctctgccacttaagaatgccggcaacatcccaaaagcaccagagtcctggggaggtggggggcggggctggttactgcatttggcaaataagcggtcgtgactgaccacagaatacaaaatgtgagttgagttgcctgggcagttgcagtgggtttagaaggaaataagaggaaaataaaggaaaattccaggtgtcttatatctcaagcttttgtgggaacaggargttccctgattcttgagagctgaaagaaatctccataaagcccggaatgctggtccttgaggtccacacctgccaccgatcctgcgacgcccaggccgcccctcccctctcggctcctactcactcttggtggcatcgtcccacattgcactgtccccagcacgcacacattggcgtaaagccaggtcccctcttcagattccacacccagagcctgcagctctgacggctgtgctgggggtccccggcgagctgtgagcccgtgctaggtgttcctccctccctcctgcccttgcccca

SEQ ID NO: 19424 - DNA, 601 bp, Human
gggactgaagccttgaagaccccgcaggcgcctctcctggacagacctcgtgcaggcgcctctcctggaccgacctcgtgcaggcgccgcgctggaccgacctcgtgcaggcgccgcgctgggccatggggagagcgagagcctggtgtgcccctcagggacttctatttgcttttaggagccaattcattcctttggtgaagtattgatgctacgcaggtgaatttagtaacaggactgacgtgtgaacatggccggaaacacttgccgtcttcctgttaccgcgtccggaacttcacgktgatacccagaaatgggatcttaacctcttacacattccaggtgctaaaacaaataacacaggagtgctttcattggaaactactggtatagtggaattattttatcttttattaaatacacaagataggcaaatcttatcaactttaccactggctcaggtaaccagtgatgaatgttcagaacaaaagttattcggaatcatttgaagtggtttgggcaagtgcgaaattaaggtgagtagctctgatcccatcctccaggcagctccgtgcagtgggggtggacgcccctctgtagc

SEQ ID NO: 19425 - DNA, 601 bp, Human
tgttccgtaggaaagcctgaggagtctcgtgtctctagcgtcttggaggaaagcaagcgcctggtggacaccgccatgtacgccacgatgcagaggtgagccttgcggaggggccgccgccccaaatgccaccgacaggcgcatcctccctgacatccacacacgtgtggcctgattttcgcaattgcagatgaaaacctgaagcttgccattgttaatttacttccccagtgtcatgtgcaagcagcagacagaactggtatttaatctccaatcctttcttaagcaagacacaaaggargagcaccctgatgcaattagcaattacgtataccctggttaaaagacagtagaggctgacgtcctgatagcaaaaccagcctctcttctccaggattaggacagattaaggaggaaaagagagacctagatcccagatctttggtgttgtgatataactgtaacattacctgtggcatagaataaagaattaaatggggctctcccccatttttgaaataattagcatttgtaattatataacagacaccactattaagaatattgtggtctcatattacctgtctagaaaaagaaaaga

SEQ ID NO: 19426 - DNA, 601 bp, Human
tctaagacagatctcagtcaatttagaacgtttattttaacaaggataaggatgcacctgtgacgcagtgtcaggaggtcctgaggacatgtgcccaagatggctggggcacagcttgcttttacacatcttagagagacataagacatcaatcaatacgtgtcagatttacatggtggggagcttccaggtcataagtagatgtaacagttttctgactgacaatcagctgaaggaattattatcagtaggacggaatgtctgggttatgttaaggggttgtggacaccaaggttttatgagcttcacagagaagagatggtgaatgtttcttatcagacttaaggtctgtgttgatgttgatgctggaggggtagaaggaggtgtgtctgacccaccaccttccatcgtgacctgacccagcttttcaggctaactttggaatgctcttggccgagaggtgggatccactcaggtggttaggcgaggacattagaattttatttttggtttacaaattgcatgttaacagaacccttttgaaatcaatgccttgatcctaaggatgcattagagtgagggaagaccaggagaggcatca

SEQ ID NO: 19427 - DNA, 601 bp, Human
ctaagacagatctcagtcaatttagaacgtttattttaacaaggataaggatgcacctgtgacgcagtgtcaggaggtcctgaggacatgtgcccaagatggctggggcacagcttgcttttacacatcttagagagacataagacatcaatcaatacgtgtcagatttacatggtggggagcttccaggtcataagtagatgtaacagttttctgactgacaatcagctgaaggaattattatcagtaggacggaatgtctgggttatgttaaggggttgtggacaccaaggttttatgwgcttcacagagaagagatggtgaatgtttcttatcagacttaaggtctgtgttgatgttgatgctggaggggtagaaggaggtgtgtctgacccaccaccttccatcgtgacctgacccagcttttcaggctaactttggaatgctcttggccgagaggtgggatccactcaggtggttaggcgaggacattagaattttatttttggtttacaaattgcatgttaacagaacccttttgaaatcaatgccttgatcctaaggatgcattagagtgagggaagaccaggagaggcatcaa

SEQ ID NO: 19428 - DNA, 601 bp, Human
tgttctagatgccaggatacagagatgagttcgatcatttcatattctcagaagtctatgctcctcctgtaaactcattgttctagatgccgggatacagagatgagttagatcatttcatattctcagaagtccatgcccgttctgtgcagtcatttttctagatgtcgggatacagagatgcgttagatcatttcatattctcagaagtccgtgccccttctgtaaagtcattgttctagataccgggatacagagatgcgttagatcatttcatatcctcagaagtccgtactccttmtgtaaagtcatcgttctagatgccgggatacagagatgagtttgatcatttcatatcctcaaaagtctgagctccttctatgcagtcattgttctagatgccaggatacagagatgcattagatcatttcatatcctcagaagtctatgctccttctgtaaagtcattgttctagatgctgggatacagagatgagttatatcattttctatcctcagaagtctgtactccttctgtaaagtcattgttctagatgccgggatacagagatgcgttagatcatttcatatcctcagaagt

SEQ ID NO: 19429 - DNA, 601 bp, Human
atgcgttagatcatttcatatcctcagaagtctatgctccttctgtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgcygggatacagagatgagtttgatcatttcatatcctcagaagtctatgctccttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacaga

SEQ ID NO: 19430 - DNA, 601 bp, Human
gtaaagtcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtcyatgctccttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatca

SEQ ID NO: 19431 - DNA, 601 bp, Human
tcattgttctagatgccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctycttctgtaaagtcgttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcagga

SEQ ID NO: 19432 - DNA, 601 bp, Human
gccaggatacagagatgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctccttctgtaaagtcrttgttctagatgccgggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcaggaaacatgatggtttg

SEQ ID NO: 19433 - DNA, 601 bp, Human
tgagttcgatcatttcatatcctcagaagtctgtgctccttccgtaaagtcattgttctagatgccgggatacagaggtgagtttgatcatttcatatactcagaagtccatgctccttctgtaaagtcattgttctagatgccaggatacagagatgagttcgatcatttcatattctcagaagtccgtgctccttccataaagtcatttttctagatgctgggatacagagatgagtttgatcatttcatatcctcagaagtctatgctccttctgtaaagtcgttgttctagatgccrggatacagagatgagttcgatcatttcatatcctcaaaagtccatgctccttctgtaaagtcattgttctagatgccgggatacagagataagttagatcatttcatattctcagaagtccatgctccttctgtaaagtcattgttttagatgccaggatacagaaatgcattagattatttcatattctgaaaagtccatgctccttctgtaaagacagacacctgaagaaggcacttcatttagggatgaatttattagatcatcaggaaacatgatggtttgttggttggagaactg

SEQ ID NO: 19434 - DNA, 601 bp, Human
gtcctggggaacctgcacaggtgcttacactctggctctgctgctgctgtgactgacaatgtcacttgtgtctgggccgagagtctcctgtctttggctggcatccatgaactatggctggctaatgtgttagttgtaagtagctataatctcagtgtcctcaaagttcatgactatatagtaccttttacaaacatgtcagccgatataaaacacgtgttttatattttaagttaaatgtcatacgcatttgtatgtacatgaagttatttctaatatatatggtgagtgatttgccccrtcccgttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacag

SEQ ID NO: 19435 - DNA, 601 bp, Human
ctcagtgtcctcaaagttcatgactatatagtaccttttacaaacatgtcagccgatataaaacacgtgttttatattttaagttaaatgtcatacgcatttgtatgtacatgaagttatttctaatatatatggtgagtgatttgccccatcccgttggtgataagggagtttttgctcagttacttcacgtgagatctggttgtttaaaagtctgtggcatctcccccactctactctcctgctcctgctcttactccgggacctgaccactccccattcaacttctgccatggttgtyggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacagaaaactggtactgaggagtagggtgtttctataaagatacctgaaattgtggcagtggctttggaactgtgtaatggcaggggttggaagagtttggagggctgagaagaagagagaaagacaagggaaagtttagaacttcctagagac

SEQ ID NO: 19436 - DNA, 601 bp, Human
atgtcagccgatataaaacacgtgttttatattttaagttaaatgtcatacgcatttgtatgtacatgaagttatttctaatatatatggtgagtgatttgccccatcccgttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccmtgcttatatagccagaagaaccgtgagccaattaaacttcttttctgggtaaattaccaagtctcaggtatttctttatagcaatgtgaaaatggcctaacacagaaaactggtactgaggagtagggtgtttctataaagatacctgaaattgtggcagtggctttggaactgtgtaatggcaggggttggaagagtttggagggctgagaagaagagagaaagacaagggaaagtttagaacttcctagagacttgccaaatgactgtgaccaaaacgctggtagaaataaggacagt

SEQ ID NO: 19437 - DNA, 601 bp, Human
gttggtgataagggagtttttgctcagttacttcacgtgagatctggttgtttaaaagtctgtggcatctcccccactctactctcctgctcctgctcttactccgggacctgaccactccccattcaacttctgccatggttgtcggcttcatgaggccctcaccagaagccaggcaggtgcaggagccatgcttatatagccagaagaaccgtgagccaattaaacttcttttctgggtaaattaccaagtctcaggtatttctttatagcaatgtgaaaatggcctaacacagaaaaytggtactgaggagtagggtgtttctataaagatacctgaaattgtggcagtggctttggaactgtgtaatggcaggggttggaagagtttggagggctgagaagaagagagaaagacaagggaaagtttagaacttcctagagacttgccaaatgactgtgaccaaaacgctggtagaaataaggacagtgaaggccaggctgacatggtctcagatggaaatgaggaacttactgggaactggaggtagaggccgcctgtgctatgcctcagcaaagagcttggctgcattgtgtccaa

SEQ ID NO: 19438 - DNA, 601 bp, Human
ggcctggtgagaggcgattggatcacaagggcaaatccctgatgaatggtttagccccatcctcttggtgatgagtcagttcttgcccaggaagtccatgtgagacctggttgttttacgttgtgtggcacctgcccgcttgacctcttgctccttctctcaccatgtgagacacctgctcctgctgcaccttccaccatgactgtggcttcctgaggtctccccagaagccaagcagatcctgggtccatgtttgcacagcccgcagaaccttgagccaattaaatcccttttccttatraattacccattctcaggtatttctttacagcaatgcaaaaaataggttaacaagtaagctttttaaaaatttatttttattgtatgtatttccgatgtgcaaaatgatgttttgatatacaaatacataatgaaatgatcactaccgtcaaacaaagttaacatacccatcaccttccgtagtgattggtgtgtacatgtggtgagagcacttaaaatctctcttagcacattagtttttagtattcaatattattaactacggaaggaatacaagtgcttagcacagcacctaaaactt

SEQ ID NO: 19439 - DNA, 601 bp, Human
atagcccccctcttagttaaaacttggcaagctcattcataaaacctctacagtgaaaggacttcatgtgtgaggcagcgcattgcagggagccccatcttcccactgagttgctggtgcctcagcagaactacccaggacatttgagagccaatttactcatctctaaaatgaggacagtggcactgctcactccaatggctatcagaagaccagtgcataaaccaggagcaaatgtcgtcatttcttcagctctaaagcactctatgggcataagatactgagatggtaatgcaggcaktcaaaagtcatattggtgcttcctatgatgcagagcaagtaagcgaaatgtctttttaattaatttatcaagaattttttctctgcagcgccatgagctacttggcctctgagttcttccttctaactagctatagatcaatttggtgctggttacttagcttttagaataagacaaacttggctaaatcagtattgaccagaattctcaaatcctaaacttaacagtgaagtttaattaatttcatagcaagctaagattcaccactttgaaatgtcctttctttcaaaccatatggct

SEQ ID NO: 19440 - DNA, 601 bp, Human
cctcttagttaaaacttggcaagctcattcataaaacctctacagtgaaaggacttcatgtgtgaggcagcgcattgcagggagccccatcttcccactgagttgctggtgcctcagcagaactacccaggacatttgagagccaatttactcatctctaaaatgaggacagtggcactgctcactccaatggctatcagaagaccagtgcataaaccaggagcaaatgtcgtcatttcttcagctctaaagcactctatgggcataagatactgagatggtaatgcaggcattcaaaagkcatattggtgcttcctatgatgcagagcaagtaagcgaaatgtctttttaattaatttatcaagaattttttctctgcagcgccatgagctacttggcctctgagttcttccttctaactagctatagatcaatttggtgctggttacttagcttttagaataagacaaacttggctaaatcagtattgaccagaattctcaaatcctaaacttaacagtgaagtttaattaatttcatagcaagctaagattcaccactttgaaatgtcctttctttcaaaccatatggctgaacgatg

SEQ ID NO: 19441 - DNA, 601 bp, Human
caatcccttcagatcctcccagcctccctttgatgtagcaatcactgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacaytcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggta

SEQ ID NO: 19442 - DNA, 601 bp, Human
actgtttctgccctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatsggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgt

SEQ ID NO: 19443 - DNA, 601 bp, Human
ctatggcttaggagccaaggctcagggagattgaaatctcttagtgagtggaaccctgcagatttaaattaagttttctcaaccctaacgtttctgttcctgaaaatcacttcagtgttttcagataaattcctttatccatcatgtgggctaggtacatcccaagatgattatgagttcagcaatccacttgttgatgtaaagatgactgctttactcccagaggtgaatttatttgctggacactcatagcctagtagaatctactggtctatttggtcaaaaaatgggtcattttgcytgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagac

SEQ ID NO: 19444 - DNA, 601 bp, Human
atccacttgttgatgtaaagatgactgctttactcccagaggtgaatttatttgctggacactcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacraaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgcttgccttcttggcctcagttggacaatccctaaagtgggataacactgtcttacccaccttatgctcaacagtggaccagttcaacccccgaggctttttaaactctcag

SEQ ID NO: 19445 - DNA, 601 bp, Human
ctcatagcctagtagaatctactggtctatttggtcaaaaaatgggtcattttgcctgtaatttaactactcatttcaatgaataagccagcctgtttgctcttgtgccatgttcagtgatgaaattatctagaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtrttcccagaagccgtgagaagccctgggtagagctggaggctgtgtcactgaagacggctcggtgctcccagcagcagggacaaggcaattgggctcacgctctgctcccactggcttcctgcaagtcgcttgccttcttggcctcagttggacaatccctaaagtgggataacactgtcttacccaccttatgctcaacagtggaccagttcaacccccgaggctttttaaactctcagtattatgagattgtgattctgtaaacccatatttgctcagaattatttcactattgagaaa

SEQ ID NO: 19446 - DNA, 601 bp, Human
gaaatacatcagtggatgttctgtttagcccaaagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgcttkccttcttggcctcagttggacaatccctaaagtgggataacactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgcttcaaatttagtggctgaaaacaacataaatgtgatcttccaatttcacaatcagtgtctgatgtctc

SEQ ID NO: 19447 - DNA, 601 bp, Human
aagagcgcaggtggtgggactcaggtctgactcagaccagctgtggacagatacaccagcacagagttcccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgcttgccttcttggcctcagttggacaatccctaaartgggataacactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgcttcaaatttagtggctgaaaacaacataaatgtgatcttccaatttcacaatcagtgtctgatgtctcacttggctgaaatcaaggtgttgcagagctgg

SEQ ID NO: 19448 - DNA, 601 bp, Human
cccctacaaaagccaacaactttacctaggcaattttcctaggcgggcttttagtaagaggacctggtattcccagaagccgtgagaagccctgggtagagctggaggctgtgtcactgaagacggctcggtgctcccagcagcagggacaaggcaattgggctcacgctctgctcccactggcttcctgcaagtcgcttgccttcttggcctcagttggacaatccctaaagtgggataacactgtcttacccaccttatgctcaacagtggaccagttcaacccccgaggctttttaarctctcagtattatgagattgtgattctgtaaacccatatttgctcagaattatttcactattgagaaaaatcagagttcaagtgtctttaaatgaaattgtgttggttttctacccagctgtgacaaattgcttcaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatccc

SEQ ID NO: 19449 - DNA, 601 bp, Human
tcccagcagcagggacaaggcaattgggctcacgctctgctcccactggcttcctgcaagtcgcttgccttcttggcctcagttggacaatccctaaagtgggataacactgtcttacccaccttatgctcaacagtggaccagttcaacccccgaggctttttaaactctcagtattatgagattgtgattctgtaaacccatatttgctcagaattatttcactattgagaaaaatcagagttcaagtgtctttaaatgaaattgtgttggttttctacccagctgtgacaaattgctycaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccggcaatgttgtctgtctctgtgcctttgtttggagtcacatctccacctcccgtcaggagagggcctccaactttaaggacccatgtgactggattggacactcgtg

SEQ ID NO: 19450 - DNA, 601 bp, Human
tgagattgtgattctgtaaacccatatttgctcagaattatttcactattgagaaaaatcagagttcaagtgtctttaaatgaaattgtgttggttttctacccagctgtgacaaattgcttcaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcmcctccttccaagccggcaatgttgtctgtctctgtgcctttgtttggagtcacatctccacctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttc

SEQ ID NO: 19451 - DNA, 601 bp, Human
gtaaacccatatttgctcagaattatttcactattgagaaaaatcagagttcaagtgtctttaaatgaaattgtgttggttttctacccagctgtgacaaattgcttcaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccrgcaatgttgtctgtctctgtgcctttgtttggagtcacatctccacctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcc

SEQ ID NO: 19452 - DNA, 601 bp, Human
gcttcaaatttagtggctgaaaacaacataaatgtgatcttccaatttcacaatcagtgtctgatgtctcacttggctgaaatcaaggtgttgcagagctggttctttctggaagctccaggggagatccctttcctggcaattccagcttctggaggtgcctgcatcccctggctcatggcacctccttccaagccggcaatgttgtctgtctctgtgcctttgtttggagtcacatctccacctcccgtcaggagagggcctccaactttaaggacccatgtgactggattggacactygtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcccatgacggcaccaactctaggcccaaaatccaatccaaatctcaccacataaatcatccacatcaggtagggcaggctcagggtaagatccatccaggacaaa

SEQ ID NO: 19453 - DNA, 601 bp, Human
acctcccgtcaggagagggcctccaactttaaggacccatgtgactggattggacactcgtggagacccaggacaaccttcccatctcaaggcccttaatgtaatcgcatcagcaggctccaaggattagcgaatggatgttgtgcgagaggcatttttctgcctccacagatgacccactgaccctcaaagattcatatccagtccacatgcctaacatgctcaccccattccaaggttcccccaaaccccatcccatgacggcaccaactctaggcccaaaatccaatccaaatctcaycacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgttgaaatccagccaagcaactcccttaggcttcaaggccaaggagtactcgcttgtggctggaggctctgccctctgagtcatgaactcaactgt

SEQ ID NO: 19454 - DNA, 601 bp, Human
acatgcctaacatgctcaccccattccaaggttcccccaaaccccatcccatgacggcaccaactctaggcccaaaatccaatccaaatctcaccacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgtkgaaatccagccaagcaactcccttaggcttcaaggccaaggagtactcgcttgtggctggaggctctgccctctgagtcatgaactcaactgtcctaaagcctggctgttttgtcaatgactcttcacttaatccccacaacaacactgaaagctcaacctttccatattaacttacagatgaggaagtgagggctgagggaagttaatgccaggccctccagccaccacaaatcaaggcagggattcaagtccaggggcatctgtcttcaaagcttatgctcctcctgccctaactcca

SEQ ID NO: 19455 - DNA, 601 bp, Human
ccatgacggcaccaactctaggcccaaaatccaatccaaatctcaccacataaatcatccacatcaggtagggcaggctcagggtaagatccatccaggacaaaattcctctccatctggacctagcctgtgagacagggaagcttgtcgtctgctctccagatgccctggcggaacggtgttaaacataacagcaacagatgtctgcgtggagaatggaaaggaaggggagtcactcctcccaacccacgttgaaatccagccaagcaactcccttaggcttcaaggccaaggagtactygcttgtggctggaggctctgccctctgagtcatgaactcaactgtcctaaagcctggctgttttgtcaatgactcttcacttaatccccacaacaacactgaaagctcaacctttccatattaacttacagatgaggaagtgagggctgagggaagttaatgccaggccctccagccaccacaaatcaaggcagggattcaagtccaggggcatctgtcttcaaagcttatgctcctcctgccctaactccagggcacagatctcctaggggcacctggagctctgtgaacaagaaccac

SEQ ID NO: 19456 - DNA, 601 bp, Human
cagctcccggaggaggcccggccggccgcgggcaccgcctgtctgcccttctaccgctcttcggccgcctgcggcaccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctkcggcctgtgcgcccgagcccggcatccccggagagacccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtgg

SEQ ID NO: 19457 - DNA, 601 bp, Human
ccggggaccaaggcgcgctctttgggaacctgtccacggccaacccgcggcagcagatgaacgggttgacctcgttcctggacgcgtccaccgtgtatggcagctccccggccctagagaggcagctgcggaactggaccagtgccgaagggctgctccgcgtccacgcgcgcctccgggactccggccgcgcctacctgcccttcgtgccgccacgcgcgcctgcggcctgtgcgcccgagcccggcatccccggagagacccgcgggccctgcttcctggccggagacggccgcgccascgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggcgcccacatgggtgagctccaggtcgtggggccctgtgtg

SEQ ID NO: 19458 - DNA, 601 bp, Human
cccgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggygcccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccacaacagtggcagccagaccacccaggtttcccggtgcgcacagccaagctacgtgctttacagatttcaactcatttaataattc

SEQ ID NO: 19459 - DNA, 601 bp, Human
cgcgggccctgcttcctggccggagacggccgcgccagcgaggtcccctccctgacggcactgcacacgctgtggctgcgcgagcacaaccgcctggccgcggcgctcaaggccctcaatgcgcactggagcgcggacgccgtgtaccaggaggcgcgcaaggtcgtgggcgctctgcaccaggtgcgcggggtggtcctgggcgccctgggtggctgcgggcaaagcggggggcgcctcgtgtgggtgcgcagcatcgtggcttctctctcccaggtacttgcacagccatcatgggcgyccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccacaacagtggcagccagaccacccaggtttcccggtgcgcacagccaagctacgtgctttacagatttcaactcatttaataattccc

SEQ ID NO: 19460 - DNA, 601 bp, Human
ggctgcgggcaaagcggggggcgcctcgtgtgggtgcgcagcatcgtggcttctctctcccaggtacttgcacagccatcatgggcgcccacatgggtgagctccaggtcgtggggccctgtgtgggtgcgcagtcctgctgggcgccctgcatgggcgtgtggagggtcatcgtgagctcctgtgcaggggccgaagggtaactccggagctggcggccctccggggcccctctgtcccacctgcttaccctccagccggctggtgattatcccaccaagacccaacaaccacagccccmcaacagtggcagccagaccacccaggtttcccggtgcgcacagccaagctacgtgctttacagatttcaactcatttaataattcccagaacaacccttggaggtgggtggaccaggggtgctggtgtttttgtatttcagagacagtgcagtgaatgaagaaccgactctgtgtgaggattctgaactaacaagttagagtctatttgaaacctttcttcattttatgactttcttaagtatcacatgagagggtcttgaatggagagtcaagttggccttttattaattgtgtgatgg

SEQ ID NO: 19461 - DNA, 601 bp, Human
ctgggaagcctccatgcgctgggtgttaacccttagttcctgggtggcgaggggacctggagcttcctggaacaggggctggcagcagcaggccctcacacttctccggcaagcacggcagacgggctcactgtcctaacacgcatccacacagcaaacacagcagacgagctcactgtcctaacgcacatccacacagcaaacacggcagacgagttcactgtcctaacgcacacatccacacaggaaacacggcagacgggctcactgtcctaacacgcatccacacagcaaacacagmagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctc

SEQ ID NO: 19462 - DNA, 601 bp, Human
ctcactgtcctaacgcacatccacacagcaaacacggcagacgagttcactgtcctaacgcacacatccacacaggaaacacggcagacgggctcactgtcctaacacgcatccacacagcaaacacagaagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcacyatgtgaagtaaaaatcatcaggcacccacgtcgctttcaagcagcgactcagacactttcctgcttccccgtgcaaacgggaatataaacccaggagctgctgagcggtggaatccaggtcctcgtctccatgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtt

SEQ ID NO: 19463 - DNA, 601 bp, Human
gaaacacggcagacgggctcactgtcctaacacgcatccacacagcaaacacagaagacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcraacgggaatataaacccaggagctgctgagcggtggaatccaggtcctcgtctccatgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaat

SEQ ID NO: 19464 - DNA, 601 bp, Human
gacgagctcactgtcctaacgcacatccacacagcaaacacggcagacgagttcactgtcctaacacacacatccacacagtagcgcttggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctccrtgagtctggacttccggccacacgcgtggggaggcaggtcccagacggctgccttctcccctctgctcaacccctgaggccttcggcgctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaataattctggaagtcctgccccttctgtctcctcaggagcaggatttggtttgaacct

SEQ ID NO: 19465 - DNA, 601 bp, Human
tggtggggagcatcagccggacggaggaggcttatgtgggtgagaagatcgagttagaaatgaaaacaggaaccttgtcactatgtgaagtaaaaatcatcaggcacccacgtcgctttcaagcagcgactcagacactttcctgcttccccgtgcaaacgggaatataaacccaggagctgctgagcggtggaatccaggtcctcgtctccatgagtctggacttccggccacacgcgtggggaggcaggtcccagacggctgccttctcccctctgctcaacccctgaggccttcggcsctcctgtctgcttccttgcttctgtgccccttccctgactgcgacctccacgggcagatgttcatccatttaattcttgtttctcaggacccacaatttgccaggttgcttcataaatatatgtagagtttgtgaatgaagtagaatctcaaaaataattctggaagtcctgccccttctgtctcctcaggagcaggatttggtttgaaccttctttgagtgagaacctcatccagcccagggagctgtgagaagagcagctgcctctgatccctggagcccgttcacagagcgggaaac

SEQ ID NO: 19466 - DNA, 601 bp, Human
caagtgttttctttttctctttttgagaaagcatctcctctatcacctaggcggaagtgcggtggtacaatcatagctcactgcagcctcaacctcctgggctcaagcaatcctccacctcagccacccaagtagctgggactacaggtgtacaccaccacacctggctaatttttaattttttaaatttttttgtagaaacagagtctgactgtgttgcccaggctggtcttgatcttgggctcaagcaatcctcccactttggcctcccaaagtgctgggattacaggcgcaagccacygcgcctgactcaagattcaagttttaaggccccattggtcagaacaatgggtgcttctgcccaacctcgacggctcccaggggaggctgcagtatctgagccaatcacttaccagggatgtttcagatcagatgaggaggcagtggggaagaggagagacacactgttcagagctctggcaagatcagacactgaggaagtacagtgtctgtgaggctctgatgaagggcgcaggtttcctctctgttaacagctagccgggcacaggtggagctgctgaacctgaggctcaggcctcag

SEQ ID NO: 19467 - DNA, 601 bp, Human
atcatcaccctgagggattacatccccaggatcctgggacccgaggccttccagcagtacgtgggtccctatgaaggctatgactccaccgccaaccccactgtgtccaacgtgttctccacagccgccttccgcttcggccatgccacgatccacccgctggtgaggaggctggacgccagcttccaggagcaccccgacctgcccgggctgtggctgcaccaggctttcttcagcccatggacattactccgtggaggtgagtgagtgcggtccctgcagctggtccccatgaactctyccttctttttttaatttttttaaattatattttaagttctagggtacatgtgcacaacgtgcaggtttgttacgtagggtatacatgtgccatgttggtttgctgtacccattaactcgtaatttacattaggtatttctcctaatgctatccctccccctgacccccaccccacgacagacgggatatgatgatccccgccctgtgtccatgtgttctcattgttcaattcccacctatgagtgagaacatgcggtgtttggttttctgtccttgcgatagtttgctcagaatgatggt

SEQ ID NO: 19468 - DNA, 601 bp, Human
tccaagtctttgctattttaaatagtgctgcaataaacatacgtgtgcatgtgtctttatagcagcatgatttatagtcccttgggtatatgccaagtaattggatcgctgggtcaaatggtatttctagttctagatgcttgaggaatcgccacactgtcttccacaatggttgaactactttacagtcccaccaacagtgtaaaagcattccttttctccacatcctctccagcatctattgttttcctgactttttaatgatcgccattctaactggtgtgagatggtatctcattgyggttttgatttgcatttctctgatggccagtgatgatgaacattttttcatgtgtctgttggctgcataaatgtcttctttgggaagtgtctgttcatatccttcgcccactttttgatggggttgtttgttttttccttgtaaattggtttgcattttttgtagattctggatattagccctttgtcagatgggtagattgcaaaaattttctcccattttgtaggttgcttgttcactctgatagtggtttctattgctgtgcagaaactctttaattagatctcatttgtcaatttt

SEQ ID NO: 19469 - DNA, 601 bp, Human
tcacttctttcttatgactcatcgcagccgtgcagaccttccgtatgggcacacttgctgatcctacacaaggtttttaatatctgtggggaaaataaatgtgtttaaagcattttaaaaggctaaactgggctcaggcacggtggcttacacctgtaatcccagcactttgggaggctgaggcaggcggatcacttgaggtcgggagtttgagaccagcctggccaacatggtgaaaccccatctctactaaaaatacaaaataaacaaacaaaaaacattagccgtgtgtggtggcagrtgcctgtagtcagctactcaggaggctgtggcaggagaatcgcttgaacctgggaggcagagggtgcaggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttcccca

SEQ ID NO: 19470 - DNA, 601 bp, Human
ttatgactcatcgcagccgtgcagaccttccgtatgggcacacttgctgatcctacacaaggtttttaatatctgtggggaaaataaatgtgtttaaagcattttaaaaggctaaactgggctcaggcacggtggcttacacctgtaatcccagcactttgggaggctgaggcaggcggatcacttgaggtcgggagtttgagaccagcctggccaacatggtgaaaccccatctctactaaaaatacaaaataaacaaacaaaaaacattagccgtgtgtggtggcagatgcctgtagtyagctactcaggaggctgtggcaggagaatcgcttgaacctgggaggcagagggtgcaggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttccccattttttcttta

SEQ ID NO: 19471 - DNA, 601 bp, Human
aggtgagccgagatctcaccattgcattccagactgggcaacagagtgaaactccatttgaaaataaaataaaataaaataaaaataaaaggctaaactgttctatagttatgatcagcaccatcatctttagaatgttaatgatgggttacctttggaagttaattatttggaagaaaatgatcctattcccccaattagttttttggaagggttatttttaagcttccccattttttctttatattcctttcccagtagtctgtaagtccttctgggagcttctaacctgtctcaaaagttgaccggctccaggcgtagtggggagtggggagggcaggggtgctgcagtgcgtccggcgatacctgcttagatgagagctgagtcatgcacagtgcaccagaggggcaagggccagcctggccctcagcaggtgcccggcatttgaagacacccaggtcatcccacacaggacgatgcatgtcgtgatttctaagtcttccttttgggcatcctaaggccaaaccgatcctttaaagactctggtggcatgcagtggtgggttcacacgccactgagatagaccgaccctgacaggcc

SEQ ID NO: 19472 - DNA, 601 bp, Human
gtaagaccagcgcacagcccgacttgtgttcagaagacctgggattggacctgaggagttcaattttggatgaatctcttaattaacctgtggggttcccagttcctcccctgagcgcccaggacagtagagtcaacctcacgtttgagcgttggggacgcaaacacgagagtgcttggtgtgagcacacaggaggagtcacgacagagcagtgtaagagccgccacgtgggtcccacacagggggagtcacgacacagcagtgtaagagccgccacgagggtcccacacagggggagtcrcgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagccgccacgagggtcccacacagggggagtcacgacacagcagtgtaagagctgccacacatgggtccctgcggcctgcagttcgaagcccactgcatgtgttagcactctataccccagccaccgtagaag

SEQ ID NO: 19473 - DNA, 601 bp, Human
gtgcttggtgtgagcacacaggaggagtcacgacagagcagtgtaagagccgccacgtgggtcccacacagggggagtcacgacacagcagtgtaagagccgccacgagggtcccacacagggggagtcgcgacacagcagtgtaagagccgccacgagggtcccacacagggggagtcacgacacagcagtgtaagagccgccacgtgggtcccacacagggggagtcacgacacagcagtgtaagagccgccacgagggtcccacacagggggagtcacgacacagcagtgtaagagcygccacgagggtcccacacagggggagtcacgacacagcagtgtaagagctgccacacatgggtccctgcggcctgcagttcgaagcccactgcatgtgttagcactctataccccagccaccgtagaaggccggactgcgatcactttctaaaagatggatcgagagactgaagcacagacagtttaggcaacttccccaggtctgaattccagcaactggaggcatcgatgcaccagaaaggccacaaacctggcagaggcttcattagatctgatcagttcgatctgaggataaatca

SEQ ID NO: 19474 - DNA, 601 bp, Human
aaatcagctgggcgtggtggcagacacctgtaatcccagctacttgagaggctgaggcaggagaattgcttgaacccaggaggcagaagttgcagtgagctgagatcatgcctctgcactccagcctgggtgacagagcgagactcagtcaaaaaaaaaaccaaaaaaacacttttttttgcattcccgtttctgcagtgtctcccacaggcagggacatctaaagtgatgttctttcttcccagctctgcggcctctgaagctgtgatgagcttcagcctccatgtctttacctcctgcmcaggccttgcatattttccctctagagttggaaaaagatgcaaatgtgtttcctcttagagcaataagaaaggaaattacccttctaacttcgttgttttttctttttgaaattaagatttccatctctcacaggtattagaaatgttttaattattttggactacttaaaacagtttgacaatggtctaaattgactatacagaaactttctctcctcatttgagaactttaatttgctcattattttggtttctcactagtctgaaaataactgcattcttttagtaaatatttaatg

SEQ ID NO: 19475 - DNA, 601 bp, Human
ctggagacagaaaacgagagtggtttctgcagatcacagggcggcagagcccactgtggacagcaggagtcaggctgaggcagcgcagcttctcacgggggctcgggggaacccttgccagatgtggaagcaccagggctacggggccagccaaggcaggtgactctaggagcacaagagtcagacacacacttgttcctcctgagggtgaaccagggagccacctgctaagaaatggactcaatggcacctgacagcagttttctaaaagctcaggattttttttgttttttgtttttttgagacgaagtctcactcttgtcacccaggctggagagcaatggggtgatctcggctcacggcaacctccgtctcccaggttcaagcaattctcctgccccagcctcccgagtagctgggataacaggcacccgccatcacgcccagctaatttttgtatttttagtagagatggagtttcaccatgttggccaggctggtcttaaactcctgacctcaggcaatccgcccgcctcggcctccaaaagtgctgggattacaggcatgagccaccgcacctggcctctagaagcgcagattt

SEQ ID NO: 19476 - DNA, 601 bp, Human
ttcagttctgtgagagaaaccctgcagcctctcccctgtgcaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggtacgttcctatccagagcrtcttccttcacgttctgcacagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccat

SEQ ID NO: 19477 - DNA, 601 bp, Human
ccctgcagcctctcccctgtgcaggttacaatgagtggagggagttctgcggcctgcctcgcctggagacccccgctgacctgagcacagccatcgccagcaggagcgtggccgacaagatcctggacttgtacaagcatcctgacaacatcgatgtctggctgggaggcttagctgaaaacttcctccccagggctcggacagggcccctgtttgcctgtctcattgggaagcagatgaaggctctgcgggacggtgactggtacgttcctatccagagcgtcttccttcacgttctgcrcagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatccctcacgtcccatgacaa

SEQ ID NO: 19478 - DNA, 601 bp, Human
tccttcacgttctgcacagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatcccycacgtcccatgacaatgcccgggaaagcgcagaggtggacagtgactcaggcgcagacacaggccatgcccggtgctcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcag

SEQ ID NO: 19479 - DNA, 601 bp, Human
cagaggcaggtggtctgcgttggttctgaagccagccagacctgcattcacattccggctccaccattcaactcttacgtaagcctggtcaggttgtttctcccacccacagcttctttaacctagaacagtgtttttataacaatgaagcaactacgaagcacgtagcacttagaatgggagctagcactgatttttcctagatccaaccacacgagcaagcaggcacctaactaaacaaattgtgacacaatcgtgacagcccggagactgcatcccatccctcacgtcccatgacaaygcccgggaaagcgcagaggtggacagtgactcaggcgcagacacaggccatgcccggtgctcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcaggtgcgcaggataccag

SEQ ID NO: 19480 - DNA, 601 bp, Human
tcatggatgcctctaggctggacaggacttcccggccccccagaccccacctacagatagcagatggttgccggtagcagaaagctgaggtcccgctttgcctgcctcatgcatgtctgctccctcctcaagttcaacctagaatttggaggtttgtactggagggagtcagaggcagatcctgttcccatctgactctgagtgcatgccccccgtagaagcaggtgcgcaggataccagtgttaggattttggaacaacacagacaaaagcaataggaaaatgttttcttttgcttttamatacatccctacctatccaattctctctctatttttggtagtcactgtgccgaggtcagatttttgttgtaaaggatctgtgttcttcccagagagtgcacctgccacacgctggggctcctgtcctttccccagtgtgacttttatctctaatttctgagatgcagcctttcaaagagctacgaacacctgggtagaaatcaccaggagaacttgtctcccttatagctgtgtcttcagcaaacgtgcggtttggaattctctgggacatgggaagccactcgctcagaagggggaaga

SEQ ID NO: 19481 - DNA, 601 bp, Human
ggctgaagcgccatctgaaatcagtgcagaggcagctggcaggttcctagggtggtgcccccaatttctcatcctatgtatttatgaccacatatctccccaatgcaaaaatgggatcaattaacttacgtatagtggggcctctttttcatgttctaagaggaattcatccctgtgatgggaagcagaagagttttacgtggcaggggagatgcacatgggagatgcatgctttacggcattcaggccaggagctattggggctttggcaactattttcatattttgagaggaaagtggracttcatttcttcacattgcaatttttctgattaatcatggcctggaggaagaagctgaaggtagagagactgtgcagggcacgttgacttcagaataggagcaccctctaaaatagctggatttgctgtcatcattcttgtttttaacacagcaatacaccccagataacagcaatgcagcaaaatagatgctcatagtcaacaagcaaagtggctctgagcccctcttctgaggccgctcgttcagacagccaggtgcacgctgtgctgcccctccacatctccttcgggtcctcagt

SEQ ID NO: 19482 - DNA, 601 bp, Human
agaggcagctggcaggttcctagggtggtgcccccaatttctcatcctatgtatttatgaccacatatctccccaatgcaaaaatgggatcaattaacttacgtatagtggggcctctttttcatgttctaagaggaattcatccctgtgatgggaagcagaagagttttacgtggcaggggagatgcacatgggagatgcatgctttacggcattcaggccaggagctattggggctttggcaactattttcatattttgagaggaaagtgggacttcatttcttcacattgcaattttyctgattaatcatggcctggaggaagaagctgaaggtagagagactgtgcagggcacgttgacttcagaataggagcaccctctaaaatagctggatttgctgtcatcattcttgtttttaacacagcaatacaccccagataacagcaatgcagcaaaatagatgctcatagtcaacaagcaaagtggctctgagcccctcttctgaggccgctcgttcagacagccaggtgcacgctgtgctgcccctccacatctccttcgggtcctcagtacctgcacctgagtggtcccgggtgct

SEQ ID NO: 19483 - DNA, 601 bp, Human
agacgacaagtgtggcttcccagagagcgtggagaatggggactttgtgcactgtgaggagtctgggaggcgcgtgctggtgtattcctgccggcacgggtatgagctccaaggccgggagcagctcacttgcacccaggaaggatgggatttccagcctcccctctgcaaaggtcagtcctttcttcaatgacaattacaaaacatctgaatgtttccgatataagttaacaatgcaatgtcattgaaaatttcttcgccaaaaggtgcttctgaaactgttatcttcccaggagcaatytggggatagaaagcaagggctctccccttggctggccatgttcccagctggcctttttctaggtagtgaggcctcaggacaggcacgtggaatcgtgaccaatggggtcaccggtgagggaagagagaggggagtccgtgagttccaggcaaagttgtggtgaactcgcaggggcgctttctcaaagggaacacagcagcaaacgtctccactccaggaacccatagagtaaggctcgcctccacctccacctcctacaggtggctgattcccaagcccatgcctggtcctcctccagcc

SEQ ID NO: 19484 - DNA, 601 bp, Human
ccatcaaaatcactcttctgttcttgaaattttttcatttatcttccttgatttttagtccaacaattaacagctgtctgaagttaagatccattgtaagaaggactatttctgaaccagtctgggtgctccccagggtgcaggggcctgtctcggcatggtgcgtgcacagcagccagtgctcctggtgggctccctggctgcagcaacatcaccaaggagcttatcacacctgcggcgtctggggccaccacaatccctgagtcagggctgcagcaacaacatcaccaaggagcttatyacacctgtggtgtctggggcaccacaatccctgcgtcagaatccacactcttcacaagaccccatgagactgtgtatatgaaggtctgagacacccatcggccaaccctaactcatcctgtcttctctctctagttcactaacttgggcccaacttcatgttctcctgccacagacatttccgtagccatttaatctgtctcccaaattgctgagcctctgtgtgcctccacggtttcaaatgtgaaatgaggacaggaataaggcattgatttaaattagttataaatgcacagtacaa

SEQ ID NO: 19485 - DNA, 601 bp, Human
ttcaattctaagagaagttcatcagagacatccttcaggattgtgaggtactggaaagaagtcctatggggagtgggtggacacgtgccaaaactccattagtgtaagggactttaaatcacagaaattaacttgctggaaatctgttcccaattcttccttcagctccaaggttaaattaaatgtaattaatgatggtgacctgctaattcatgcttttgataactgatatctagtatgtatatatatataaacaaaatgacgaggacagggaatttaattatttgggtatcacacatgyaggtgttatatatgccaaattttaaaggtaaattactacttttattatttgtgtgaaatgtcattttacatatgggttccattttgaaagtggtttgggaagggggcataccattttaagtaccaagaaaaacttgcataatctcattttactttctctttttcagctggattttcctctacgtgcttcagtcttctctacacaaagagctgcaaaccaggtctttgttttgcactcttatttcaagcagaatgagtgctcctaaactcctctctctgggctgtatcttcttccccttgc

SEQ ID NO: 19486 - DNA, 601 bp, Human
aggattgtgaggtactggaaagaagtcctatggggagtgggtggacacgtgccaaaactccattagtgtaagggactttaaatcacagaaattaacttgctggaaatctgttcccaattcttccttcagctccaaggttaaattaaatgtaattaatgatggtgacctgctaattcatgcttttgataactgatatctagtatgtatatatatataaacaaaatgacgaggacagggaatttaattatttgggtatcacacatgcaggtgttatatatgccaaattttaaaggtaaattamtacttttattatttgtgtgaaatgtcattttacatatgggttccattttgaaagtggtttgggaagggggcataccattttaagtaccaagaaaaacttgcataatctcattttactttctctttttcagctggattttcctctacgtgcttcagtcttctctacacaaagagctgcaaaccaggtctttgttttgcactcttatttcaagcagaatgagtgctcctaaactcctctctctgggctgtatcttcttccccttgctactttttcagcaggcccgggctcaattcccaagac

SEQ ID NO: 19487 - DNA, 601 bp, Human
ttccacctttagataaaaccttctttctttaaatattccatacccatgtcttcacatgcttgttgcatagtatttctccaatattcaaaattaatgcgccaaacttggtggattgaaaatagttaatattttattgcagctaacgttcttccagccaccaaaataccatctttgaatcaacatagaaaaacactgttctttattcacagtacttctcaaatatattttcttcttcagacatgggcaactttccatttatttttatgtggaaattccacaggactttggtccataggatgttaggtgcaatggcagagtttgtccatatgcaaacaaatttaagaatcactggaataaaaaacaaactggtttattttttatataaactagtttctttactgtcagcattttctacaatggaactctgtgagggcaaattagaatgtaatgttttgaaactcaagtaattaatatttgtttcttgggatttattgatagcttcctgagcagtaatccccaaaacatcagcttgaattgatagtctagctagtgatggtgaaagttttgggtgataatgtacactcaataaatagtttccaat

SEQ ID NO: 19488 - DNA, 601 bp, Human
aaaaggaactttcttaaaaagaagagtcaaccatgaagctcttttcattataggtgaagcccttggaaatcatgctctaatttcttaaacacccaaaaactttttaaattcaaatttctggtagctagctggccaatatgtaactatatcaaggtctctagcattggcaaacaatattcaagactttgacagtgtattaaattagtttagttttttttttaaatagagtaataaaaaaaattccaaacaattagttgacactgagtaaagccttgcttgcgcatatgttttatttaggtcmgtattaacctgtaacttttttcaaaggtctgtacaaattcaaattagcatctactgatgcttaacttggttttccttatttcacacaaagtattttaaagctgaggaaagtgaggtataaacaggtaaaattactatcacaagatattcagctagttactaacagagcgtaggttcaaattcaagttttcaaaatccagtgtctttgtataataaattttgatacctccaaatgatgcttgatatatatatatatttaaagtcttcaaaagaatataattacttttatcttataaacttg

SEQ ID NO: 19489 - DNA, 601 bp, Human
gtaggttcaaattcaagttttcaaaatccagtgtctttgtataataaattttgatacctccaaatgatgcttgatatatatatatatttaaagtcttcaaaagaatataattacttttatcttataaacttgttattgttaaatttttaccttcaatatagcattgtccatgtctaatgcatcccatctccccaaaaaatgcaaatacatttctctgccctatgatcagagatacttggtatacaaatctaataattatttttaattctctcaccttttagtctcaaaattatatgccatwttaacctatttttgatcattttaataactacctgaatgcactgatttgaatatgattcaataaaaaaaatcactatattttggctaatctgtaaactaaggccatcagcactgatgttttaaaagatgtacagattgtgtcttcttaatgcccaatcagaagacaattatacttatttcctgacaaaatgtataaaaagacgagtgtcaagccacgttccatatatatcacagacaatctttaaatgtttttgagtcaaataacaatggaatagatgcttgaaaaaatgcataggtggct

SEQ ID NO: 19490 - DNA, 601 bp, Human
aaacttgttattgttaaatttttaccttcaatatagcattgtccatgtctaatgcatcccatctccccaaaaaatgcaaatacatttctctgccctatgatcagagatacttggtatacaaatctaataattatttttaattctctcaccttttagtctcaaaattatatgccattttaacctatttttgatcattttaataactacctgaatgcactgatttgaatatgattcaataaaaaaaatcactatattttggctaatctgtaaactaaggccatcagcactgatgttttaaaaratgtacagattgtgtcttcttaatgcccaatcagaagacaattatacttatttcctgacaaaatgtataaaaagacgagtgtcaagccacgttccatatatatcacagacaatctttaaatgtttttgagtcaaataacaatggaatagatgcttgaaaaaatgcataggtggctaaataagtggctacaactatacaattcatcttagatgaagagagaactggttaacatattttaaattctgatttcattttataatgcacaacaattccctgatctcaaccctctggtccttcaac

SEQ ID NO: 19491 - DNA, 601 bp, Human
tataaaaagacgagtgtcaagccacgttccatatatatcacagacaatctttaaatgtttttgagtcaaataacaatggaatagatgcttgaaaaaatgcataggtggctaaataagtggctacaactatacaattcatcttagatgaagagagaactggttaacatattttaaattctgatttcattttataatgcacaacaattccctgatctcaaccctctggtccttcaacccaattagacagcctacattatagaccctccatttttatttatgacctgtcttataccaatccttsttttctcccttatatatggaatatatatatatatgtgtgtgtgtgtgtgtgtgtgtgtgtgtgtgtgtatatatgtgtgtgtatatgtatatatggaattgagatatttatcaaaagctgtataaatgttttgacagtaggttttcccgatgtttaaaactagcacaaagatggaaagaaagccctgaggaattgtagcttccccacaaaaaatagttttccaaaaataaacgtgctaacagtcattcaaaaataaggtaggaggctgaagtaacatctggcaacttaagttccaagaca

SEQ ID NO: 19492 - DNA, 601 bp, Human
gagccttgaaaaaattgtttcccaatataatcattgctattacctggaaaagtgaaatatttgcaatagttttactattctcctccttaccatgtgtctaggttacagtgaccccacgggaaagtatgaccctgctgttcgaagtcttcacaatttggctcatctattcctgaatggaacagggggacaaacccatttgtctccaaatgatcctatttttgtcctcctgcacaccttcacagatgcagtctttgatgaatggctgaggagatacaatgctggtaagacattttcatatgcyttttgcatgctcagctgggcggattgtttagatggcatagttatcagttcaagctgagcactcagcgcataaaaacactttcaaaataaggatagcatagctgtaatatcaagtcacttccagacattcaattctactttgaaaatgcaggcaagaagtctctccaaatagttattataggatgatatttttaaccatttgctgggactaaccaaatcatctctcctaatttttgctacgaaaaaatggctactatgtttcacaaattgttcttaccctcatcttccaacataaattctc

SEQ ID NO: 19493 - DNA, 601 bp, Human
taaaaacactttcaaaataaggatagcatagctgtaatatcaagtcacttccagacattcaattctactttgaaaatgcaggcaagaagtctctccaaatagttattataggatgatatttttaaccatttgctgggactaaccaaatcatctctcctaatttttgctacgaaaaaatggctactatgtttcacaaattgttcttaccctcatcttccaacataaattctcattacttttaaatataaatgaggaaaaccttatagagctcttctttgatatcccaaaagactaaaaattktatacccataatccacagttcttatttttattacttaatggcccctcacaaatagaaattgtgttccacttgaaaagttaatgttggcttttatatcacactataggaaatctcttttaagttcatttcaatgcattctttaaaatactatttaaaaggcctctttctctgccttcctatgcagctgagaggctagcattatttttcaaacaataaaagtgcttccactggttaaaacatcgcaaattttcataggttgaaagcattctaaattttggcttttgtgcctttagctcataa

SEQ ID NO: 19494 - DNA, 601 bp, Human
ctgtcagcttttttaaaagtgaaacaataaatgagtgacttttgaaatacaatatgagggcaaatattttagccatacacctttaacaaatctttccaaaatgttcaatttacatactataaaaacaacatccttctctttgttttacagtcatgatgaccactttatgtttgtttaactagattacttttattacagtaatgagtaaactcaaattaataggtttaggaattaacaaaaccagcttttgttaaacatgcacttctgggaactacatggcaatgttcaagttgtatttatycagttattcacaatgccgtgggtgttagtaaactttttagaggaaatggagactattcagtaacctggcaagtctcttaagtggagttttctttcacctatgaaagaaaggaaagatattccttcaccttgtgtatcttggctgaaaatataattatttcacattgatagcaagttgttaaaggttctccagattttaacttaaaggtcattgatgaaccagaaaaataccttttgaacatttttttctgacattttctttgtttgcaatatgtgtagcataaggtttctcagtaacttg

SEQ ID NO: 19495 - DNA, 601 bp, Human
atattccttcaccttgtgtatcttggctgaaaatataattatttcacattgatagcaagttgttaaaggttctccagattttaacttaaaggtcattgatgaaccagaaaaataccttttgaacatttttttctgacattttctttgtttgcaatatgtgtagcataaggtttctcagtaacttgaattgtagtgggaagagaaataccgtaaataaaaaataggaaactaccctgcagcacatttctgataaaatgtggccataaaattataggataggtcaatgtaaacacttgcaaaytgcatgaaagctaagctgaaacaattagcctccttcttaaatattccttgtacctgcaaatacgttttagaaatcagtgtcataaaacaactgtgaagaagagaaagaaaaattagaaagattaaaaaaatttataaaactgtctgtaaagcaagagtcttgtttaaaataagtctaggagtggagggatggaattctttttcaaaatgattgaaaggtttttacaaatatagaaagctctttacaaattgcagaataatagaattattaggcttggaaaggaacaaaaattacacttta

SEQ ID NO: 19496 - DNA, 601 bp, Human
aataaaattttttcaggttctccttgaatattggatgcctttagaactcaataatgataggaatattaattttattatgtttattaatacgttgtctttggaataatttagatatatccacatttccattggaaaatgcccctattggacataatagacaatacaacatggtgccattctggcccccagtcaccaacacagaaatgtttgttactgctccagacaacctgggatacacttatgaaattcaatggccaagtgagtgttgaaagtgtatttttactgtgataatttccaaaarcaaatgtgttatctttcaagtagagtaatcacggtattctgaagctatgttttccatttggacttggaaactttcatttgtacttttatttgaggataagggaaggaatttgatatttgttgagagtccacactaagctgatattgatcttattgtacagcaccctatctcatttaatcctcacaatgctttggggtgagtatgaaaatcttcatttcacaaataaggaagctgaggcttaaataggttaactgttacagattcacatttctaatgagggaagagaatgagtttgagctt

SEQ ID NO: 19497 - DNA, 601 bp, Human
tgccatagcagtagttggcgctttgttactggttgcactcatttttgggactgcttcttatctgattcgtgccagacgcagtatggatgaagctaaccagcctctcctcactgatcagtatcaatgctatgctgaagaatatgaaaaactccagaatcctaatcagtctgtggtctaacaaatgccctactctcttatgcattagtatcacaaaaccacctggttgaatataatagattgagttattaactgtattttctttcactttattaccttctttctaatacaagcatatgttagmattaaagttctaggcatacttttcaaagctgggaagaccctttcagaatcttttcaatgggttttaattttcagttctatttaaaatggtgaatgacactaaactccatgatatttaaggatagtgtgaagatctttggcatgatttaaaggttgagtatgtgaagatataagtgaactaccatgctttgtttacgtgtaaaggaaaataatgtttgatagtaaatgtccacttaaaatacatgaatgggcatttctaaaatgttaaaacataaactcatttccattcatggatatttgt

SEQ ID NO: 19498 - DNA, 601 bp, Human
tatttagtcaacatatactatttagtctcaggttcaaggctacaacaaaaatcaccatctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattmtcttatcatttatcagccttttatgtattttccaagtaaaatattaacatattacttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataataacagtaataatcatgcactatagaaaatggctaaactgagattctaaattctacaaacagaaacaagtt

SEQ ID NO: 19499 - DNA, 601 bp, Human
catctttgtcaaactttggagagggaaaatcttcactttcttaagcaacaatggatattgcctgtgtttgccactgtgtttccctgcctctcaattcgctgaaaaaggaactacctatccttacatttcacctactaatgtctcttctaacatcttagaggtccatggagaaggcatatggagaacatgttttatactgctctataaatagtattccaatcactgtgcttaatttaaatagcattctcttatcatttatcagccttttatgtattttccaagtaaaatattaacatattayttcattggtcttcttttttatctggttctatatgaatgctattttttcccttctcttctaacatgaaatatattttctctttttgatcttgtgctatgaaacaatcttccaaagaactgtataaggtggtcataagtgaatattttaattaaaattggtaaaaataaataataataacagtaataatcatgcactatagaaaatggctaaactgagattctaaattctacaaacagaaacaagtttaagttatgtatccctgattggttactgggttttcctatattcaaaaatattaag

SEQ ID NO: 19500 - DNA, 601 bp, Human
agacggggaactgaggccccttgaggcaggacacatccagggtgacgctgctcgtaagcgtcagagcattcttttttttttttttttttttctgagacggagtctcgctctgtcgcccaggctggagtgcagtggcgcgatctcgactcactgcagcctccgcctcccgggttcaagcgattctcctgcctcagcctcctgagtagctgggattacaggcgtgcgccaccgcgcccggctgatttttatatttttagtagagacggggtttcaccatgttggtcaggctggtctcgaactrctgacctcgtgatccgcccgcctcggcctcccaaagtgctgggcttatgggcatgagcctccgcgcccggcccagagcattctttataaggccgaatagtttgcatttgaaggtggctccccccagtcccccaccccacgtgtattttcccctcaaagaaaagctgcatccttaacaccccatctgttcagtcctcatgactccagtgggccagttctgcgtagtccctgccctcgtggagaacacattcctcctggggagactgacagatgcaaagacaggaacaagccagggtcatgt

SEQ ID NO: 19501 - DNA, 601 bp, Human
gactgacagatgcaaagacaggaacaagccagggtcatgttggcgccggaagagccgaccgtgtgtggcgtgggaaattgacttacctgcctgctgggagatggaggggttgcggttgtgtggtttcagttaaggagcacttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagaatgcagtggcgcgattgcggctcattgcaacatctgccacctggggtcaagtggttctcttgcctcagcctcccgaggagcggggattacaggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagcccttt

SEQ ID NO: 19502 - DNA, 601 bp, Human
aagagccgaccgtgtgtggcgtgggaaattgacttacctgcctgctgggagatggaggggttgcggttgtgtggtttcagttaaggagcacttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagratgcagtggcgcgattgcggctcattgcaacatctgccacctggggtcaagtggttctcttgcctcagcctcccgaggagcggggattacaggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtctgga

SEQ ID NO: 19503 - DNA, 601 bp, Human
ttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagaatgcagtggcgcgattgcggctcattgcaacatctgccacctggggtcaagtggttctcttgcctcagcctcccgaggagcggggattacwggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtctggatctgtcgccagactggagtgctgttgcacaatcttggctcactgcaatctccgactccctggttcaagcgattctcctgcctcagcctccc

SEQ ID NO: 19504 - DNA, 601 bp, Human
gcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtctggatctgtcgccagactggagtgctgttgcacaatcttggctcactgcaatctccgactccctggttcaagcgattctcctgcctcagcctcccaagtarctgggattacaggcacgcactaccattcccagctaattttttgtattcttagtagagacagggtttcaccatgttggccaggatggtctccgtctcctgcgctcgtgatctgcctgcttcggcctcccaaagtgctgggattacaggcgtgctgggatttcggccacaacgtccgaccgaaagtttttaagcagggacatgacattgtcagatttatatactgaaaagctcacccaggttgccaagtggtttggaggggaaagactgctgtcgaggaagcagttaggtagttgtgaaaac

SEQ ID NO: 19505 - DNA, 601 bp, Human
ccacccgccttggcctcccaaagtgctgagattacaggtgtaagccactgcgcccagccctttgaaagtttttcagtatttatgtatatatatttttgagttggagtctggatctgtcgccagactggagtgctgttgcacaatcttggctcactgcaatctccgactccctggttcaagcgattctcctgcctcagcctcccaagtaactgggattacaggcacgcactaccattcccagctaattttttgtattcttagtagagacagggtttcaccatgttggccaggatggtctccrtctcctgcgctcgtgatctgcctgcttcggcctcccaaagtgctgggattacaggcgtgctgggatttcggccacaacgtccgaccgaaagtttttaagcagggacatgacattgtcagatttatatactgaaaagctcacccaggttgccaagtggtttggaggggaaagactgctgtcgaggaagcagttaggtagttgtgaaaacccaggtgaggaataactaggccttacctaaggtgcaggcagtaatcttgccatggcctttaagcagagaagtagtcctagtgtcacttaatc

SEQ ID NO: 19506 - DNA, 601 bp, Human
aggcaggaggatttcttgagcccaggagctggagaccagcctgtgcaacatagtgagaccctgtctgtatttaaaaaaaaaaaaaaattcttgaaaaattagcagggcacattcctgcctttagtcccagctacttgggaagctgaggcaggaagatcacccgaacccaggagttggaggctacagtgaactatgatggtgcctctgaatagttgctgtactctagtctggtaacacagcaagaccctgtctctctatcttgtctttttttttttttttttttgagacaggatgtcctgcwgttgcctgggctggagtgtggaggctggagtttggtggcatgatcacggctcattgcacccttaacctgggctcaagcagtcctcccagagcttcagcttcccaaagtagctgggactataggcatgctccactatgtctggctaatttctttttttatttttatttttagtagagatgaggtcttgctatgttgcccaggctgagacctcatctcttttttatttttttaaaattttttattatactttaagttctagggtacatgtgcacaacgtgcaggtttgttacatatgtatac

SEQ ID NO: 19507 - DNA, 601 bp, Human
taacacagcaagaccctgtctctctatcttgtctttttttttttttttttttgagacaggatgtcctgctgttgcctgggctggagtgtggaggctggagtttggtggcatgatcacggctcattgcacccttaacctgggctcaagcagtcctcccagagcttcagcttcccaaagtagctgggactataggcatgctccactatgtctggctaatttctttttttatttttatttttagtagagatgaggtcttgctatgttgcccaggctgagacctcatctcttttttatttttttwaaattttttattatactttaagttctagggtacatgtgcacaacgtgcaggtttgttacatatgtatacatgtgccatgttggtgtgctgcacccatagagacctcgtcttaaaaaaagaaaataacattacttttgaaggtacttaatgcactgaattgtacatttaaaaatggttaaaatggtaaatgtttgaggcaggtagatccacctgaggtcaggagttcaagaccagcctgaccaatatggtggaaccctgtctctgctaaaaatacaaaagttagctgcatgtggtggcatg

SEQ ID NO: 19508 - DNA, 601 bp, Human
gctgttgcctgggctggagtgtggaggctggagtttggtggcatgatcacggctcattgcacccttaacctgggctcaagcagtcctcccagagcttcagcttcccaaagtagctgggactataggcatgctccactatgtctggctaatttctttttttatttttatttttagtagagatgaggtcttgctatgttgcccaggctgagacctcatctcttttttatttttttaaaattttttattatactttaagttctagggtacatgtgcacaacgtgcaggtttgttacatatgtawacatgtgccatgttggtgtgctgcacccatagagacctcgtcttaaaaaaagaaaataacattacttttgaaggtacttaatgcactgaattgtacatttaaaaatggttaaaatggtaaatgtttgaggcaggtagatccacctgaggtcaggagttcaagaccagcctgaccaatatggtggaaccctgtctctgctaaaaatacaaaagttagctgcatgtggtggcatgcgcctgtttagtcccagctactcgggaggctgaggcaggagaattgcttgaacctgggaggcggagg

SEQ ID NO: 19509 - DNA, 601 bp, Human
tttttatttttttaaaattttttattatactttaagttctagggtacatgtgcacaacgtgcaggtttgttacatatgtatacatgtgccatgttggtgtgctgcacccatagagacctcgtcttaaaaaaagaaaataacattacttttgaaggtacttaatgcactgaattgtacatttaaaaatggttaaaatggtaaatgtttgaggcaggtagatccacctgaggtcaggagttcaagaccagcctgaccaatatggtggaaccctgtctctgctaaaaatacaaaagttagctgcatgtggtggcatgcgcctgtttagtcccagctactcgggaggctgaggcaggagaattgcttgaacctgggaggcggaggtggcagtgagccaagatcacaccactacactccagcctgggcaacagagcaagactccatctctaaataataaataaaatggtaacttttatgtatattttaccaaaatttaaaaaattacaagtttacatttcttaaaatttcccatcaaatctgtaagtaaatttatgccccgaggaacaagtgctatatttattctaagacaacctcctccttcctt

SEQ ID NO: 19510 - DNA, 601 bp, Human
aaaaatacaaaagttagctgcatgtggtggcatgcgcctgtttagtcccagctactcgggaggctgaggcaggagaattgcttgaacctgggaggcggaggtggcagtgagccaagatcacaccactacactccagcctgggcaacagagcaagactccatctctaaataataaataaaatggtaacttttatgtatattttaccaaaatttaaaaaattacaagtttacatttcttaaaatttcccatcaaatctgtaagtaaatttatgccccgaggaacaagtgctatatttattctragacaacctcctccttccttaaacagaatcttagggctggaggattgcttcctgccctcttttgtttgtgatgtatgcattttgaaaattctgggccgggcgcagtggctcactcctgtaatcccagcactttgggaggccgaggcgggcggatcacaagatcaggagattgagaccatcctggctaatacggtgaaaccctgtctctactgaaaataacaaaaaattagccgggcgtggtggcgggcacctgtggtcccagctatttgggaggctgtggcaggagaatggcataaacct

SEQ ID NO: 19511 - DNA, 601 bp, Human
ctgtaaatggatctgttgtgaggactgactgagataatgttactagaagggctttgtataatatttaagcagagtgagaggtaagctttttgtgtaggtcaggggaaatggagaaaataggtgccctgactcagaccagtctggctctttttttttttttttttggagacggagtcttgctctgtcacccaggctggagtgcagtggcgcgatctcggctcacggcaagctccacctcctgggttcacaccattctcctgcctcagcctcccgagtagctgggactacaggcgctcgccacacacctggctaatttttttgtatttttagtagagacgaggtttcaccacgttagccaggacggtcttgatctcctgacctcatgatccgcctgcctcggcctcccaaagtgctgggattacaggtgtgggccaccgtgcccagccaccggtgtggctctttaacaacctttgcttgtcccgataggtcacctttggctcttcagagatgcagggacacacgatgggcttctggttaaccaaactgaattatttgtgccatctctcaatgttgacggacagcctatttttgccaatatcac

SEQ ID NO: 19512 - DNA, 601 bp, Human
agattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttrtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggaga

SEQ ID NO: 19513 - DNA, 601 bp, Human
gtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgrgttcacgtaatcctcctgagtagctgggattacaggcgcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaa

SEQ ID NO: 19514 - DNA, 601 bp, Human
atagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggygcctgccaccacgctggccaatttttgtacttttagtagagacagtgtttcgccatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaa

SEQ ID NO: 19515 - DNA, 601 bp, Human
tttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgagttcacgtaatcctcctgagtagctgggattacaggcgcctgccaccacgctggccaatttttgtacttttagtagagacagtgtttcgycatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttt

SEQ ID NO: 19516 - DNA, 601 bp, Human
ggtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttgtttttttttttttttaaagctgttttttaatacattaaatggtgctgagtaaaggaaataggcagggtgtgttgtgtggtgttttaactaggcgcttctctctcagagagttttgaaacctgtttacataaaggcccaggatgggaaggagatccaaacataagccaccagcctcattccaagtctcttctatttccaaccctggattttttttttttatttaacattgtttcttttagctttatttttcttataaaagaaatgtatcactataaaaaattacacactacagaaaaatat

SEQ ID NO: 19517 - DNA, 601 bp, Human
gtgtggcggtgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagttttttttgttttttttttttttaaagctgttttttaatacattaaatggtgctgagtaaaggaaataggcagggtgtgttgtgtggtgttttaactaggcgcttctctctcagagagttttgaaacctgtttacataaaggcccaggatgggaaggagatccaaacataagccaccagcctcattccaagtctcttctatttccaaccctggattttttttttttatttaacattgtttcttttagctttatttttcttataaaagaaatgtatcactataaaaaattacacactacagaaaaatatt

SEQ ID NO: 19518 - DNA, 601 bp, Human
tgggcgcctgtgaggcaggcgaatctcttgaacccgggaggcggaggttgcagtgagccaagatcacaccattgcactccagcctgggcaacaagagtgaaattccatctcaaaaagaaaccaaaaaaacaaaaaaaaaacatgccgtttgagtactgtgtttttggtgttgtccaaggaaaattaaaaacctgtagcatgaataatgtttgtttttcatttcgaatcttgtgaatgtattaaatatatcgctcttaagagacggtgaagttcctatttcaagtttttttttttttttttktttttaaagctgttttttaatacattaaatggtgctgagtaaaggaaataggcagggtgtgttgtgtggtgttttaactaggcgcttctctctcagagagttttgaaacctgtttacataaaggcccaggatgggaaggagatccaaacataagccaccagcctcattccaagtctcttctatttccaaccctggattttttttttttatttaacattgtttcttttagctttatttttcttataaaagaaatgtatcactataaaaaattacacactacagaaaaatattaagaagaaa

SEQ ID NO: 19519 - DNA, 601 bp, Human
attaaaaacctgtagcatgaataatgtttgtttttcatttcgaatcttgtgaatgtattaaatatatcgctcttaagagacggtgaagttcctatttcaagtttttttttttttttttttttttaaagctgttttttaatacattaaatggtgctgagtaaaggaaataggcagggtgtgttgtgtggtgttttaactaggcgcttctctctcagagagttttgaaacctgtttacataaaggcccaggatgggaaggagatccaaacataagccaccagcctcattccaagtctcttctmtttccaaccctggattttttttttttatttaacattgtttcttttagctttatttttcttataaaagaaatgtatcactataaaaaattacacactacagaaaaatattaagaagaaaaacattcacatcggaaacaaagttttttcccatgaaaacagaacccaaaagggtaagtggttagtatttcaccagcaattatgttgagaataaggccaggcgaggtggctcacgcctgtaatctcagcactttgggaggccagggcaggcagatcatctgaggtcaggagtttgagaccagc

SEQ ID NO: 19520 - DNA, 601 bp, Human
aaagtgaggagtttggggagtctcatcctctggccagccgctgaatgacaccaaagagaacagcggcagcagcgaaggtgcctctggtttggcaggaaaaaccatgaaaggagtggactttcaaaagcagcggcagcagcagtagcagcagaaggaaaggctttctcctcagtctgagactcttgaagtctgccgggtgtgtgtttgtatccagtcccatagtggaaatgctctcgtatccagacgtgcaccgtctccagtcagcagctgaaaataactcgttcttgaaaggagaaagccraccgccccctttctcctgcacaactgactgagggcttgaaggaggcttgtataaggctgagggatttttccaagaaggaagaatggcgtaatgctgcctgtgtgctccagtttttttttccccctagttttgaatcctttccagtgaaaatacttcacacacacacacacacacacacacacacacactcacaggcctgcaggtgctcagaaaaatcttttacaaacctgaactcaggaattggaaacggaattccaacccaaaccaatttaattactctctgatgtcatgctgtctaaa

SEQ ID NO: 19521 - DNA, 601 bp, Human
atatgtctgtatatgcatgattgatcttgtgtgtgtatgtaagaaggtgtgtgtgcacatgcatatgtgtgtgattcggcatgtgtgtacgtgtgtgattcagcacgtgtgtgtgtgagtcagcatgcatgtacatgtgtgattcagcatgtgtgtataaacataaggctatgtatgtgtatgtgagaagctcagtagtatctccgaatcagcatgccctccttcctaaattgcaatttgccattggggagctttcatatattgctctagaaggtgactaattaggcctttaaactccccrtctccccctctccaagctcccttagtgctggggggcacacggacttattttatgagcccccaaggggtcacagctttccctggctgggcaggcagccagaccacctcccccacctcagccagacctgctgcctctgtgcctcccccgccccctggcagccccctccaggccagctctaatgaggagcctctcccaccctctgacccctcccccaccctgccagcctaggaccagagcaaatgagctgcaggcaacttgagcgaccaacagcccacctccctcttcacactaggaagaaac

SEQ ID NO: 19522 - DNA, 601 bp, Human
agtcaaagttgtccatctagattttcagaggcactccttaggccctaaaacattaccactgggtctcagcccagttagtcctctgcagtttcttcactcccaaccccagtatcttcaaacagctcacaccctgctgtgctcagatcaatactcagttgtctaagttgcctcgagactaaaggcaacagtgctgaaacatctcctggactcaccttgaagttctcaggatccacatgcagcttgtcacagtgcagttcactcagctgggcaaaggtgcccttgagatcatccaggtgctttrtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgcc

SEQ ID NO: 19523 - DNA, 601 bp, Human
gcctccagatagatgttttaaaacaacaaaaatgagggaaagatgaaagttctttctactggaatctaataaagaaaagtcattttcctcatttccacctctcttttctcaaagtcaaagttgtccatctagattttcagaggcactccttaggccctaaaacattaccactgggtctcagcccagttagtcctctgcagtttcttcactcccaaccccagtatcttcaaacagctcacaccctgctgtgctcagatcaatactcagttgtctaagttgcctcgagactaaaggcaacagkgctgaaacatctcctggactcaccttgaagttctcaggatccacatgcagcttgtcacagtgcagttcactcagctgggcaaaggtgcccttgagatcatccaggtgctttatggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgaga

SEQ ID NO: 19524 - DNA, 601 bp, Human
gaagtaaatgataaaactgttgaatatctcagtggagagataattgaatattttatatgagcaagcactctcccctagaatttgtcatgtattctgattttatagctgctaaaaatagaattgtttttcaaatttaatcattcaaaaaatttttgattattagtttttggccataaataaatagacagctttttcatgtctcattgtcatatttaaaaagaggtgcttttgaacaaaatcagttgtcctataggcagcacaaggtactcagtaggggtctaaatattaaaaagaatgacattttttttttttttgtgagtcagataaattttacataaggttgaatagtactagagcttcaggatttgataccatgttttctacaattctgctcactctctgtggccccttaatacttcttgtccctgcttaaaacaacaacaacaacaacaacaacaacaaatctcttcaggccatttctttaatccaaagatacactgttatgtagatgtcaactgggtcatatttcactataaaagaatagagcgacttcattagcttaaacatatatatcgacaatatgttcgactcattcttctca

SEQ ID NO: 19525 - DNA, 601 bp, Human
atgcctggtggaacccaaggtatgtgcaaagctggaagagaaggaaacaaataggaagggattgcttttcgacaagaaaccagagcagatctttgaatagcagaatttctagcatagtcagcaaaagaaataaacaacattacctttttcactatgaggatttaaagatgagtgaacatgacaggaaacttcaatctaaaacaatctgtagcctaagagaaactttgtatcaccaatccagaatcaacttgtggtactttgaagagtgttttttttgtttgtttgttgatttgttttgttcccccccccaccccgcaaagggagcggatcacaaaagaattgaaaaacacagtgatagacctggggaaaataaagacagtatttctatgtccttgaaacaattgggcaatgagaaggaatctagagctggaaatgtgataacccagtgtgaacacacacaaaagtctcggcatcctgttctacatgtcaaagaggagagtcggtgatctctttctgggaactgtagatgagaagtcttgagtttttcttctgcacattttgaaaggcatatttcataagaacttaactttcaagggcaaat

SEQ ID NO: 19526 - DNA, 601 bp, Human
tatttacctcttattatgagtcacagacaaaaatatttgcaagcaaacttacttaaatagggctttacagaaagaaaaggtttcttccccctgcatgagccattctctgactttgctttcaaaattaaagcttttgtttaattacaaaatcaatatctgtttattgaagaaattttggaaaacacagataagcaaaaagaagaaaataaattttttaaaataattgtaccactaagaatggaattaacatatgatatattcgttatgttttttctgggcgtatatttatgcaatttttaattttttttaccacaattaggacggtattgtacacacaactacaaaaccttcttttattcatttactaagttatcaggatttatccattgaccttaacggacttccacacctctacatccatgtttaccacatgaggacttttagagctctgtctatattgcattgtccattacggtagccactggcaacttgtggctattgaaattttatttaattaatcaattaatttttgagacagagtctcactctgttgcccaggctggagggcagtgttgtgcgatctcagcttattgcaacctct

SEQ ID NO: 19527 - DNA, 601 bp, Human
gcacctgtagtcccagcactttgggaggctgaggcgggcagattgtttgagctcaggagtttgaaacaagactgggcaacatggcaaaaccccaactctacaaaaaatacaaaaattagccaggtgtggcggcatgtgcctatagttccagctactcgggaggttgaggtgggaggatcacttgagctggggaggtcgaggctgcaatgaaccaagatcataccactacactccagcctgggcaacagagtgagaccctgtctcaaaaaacaaaaccttcagattttattttatttattattattattattattattattattattatttggaaacagagtcattctgtcacccaggctagagtgcagtggcatgatctcagctcactgcaacctcaccctcccgggttcaagcagttctcctgcctcagcctcccgagtaactgggattacaggcacgtgccaccacactcagctaatttttgtatatttagtagagacggggtttcaccatgttggccaggctggtctcgaacacttaacctcaagtgatctacccgcctcggcctcccaaagtgctgggattacaggcgtgagcgacc

SEQ ID NO: 19528 - DNA, 601 bp, Human
tgctcctgggcgtacctgtctacagacgatcctcttgttccgaccagtactcaacagaagatggcgaggaccgtgtctgtcgtgtctatgctcgtggctgcaaccccagcatctagcatagcgtcaggcacaggaccaatgctcaatgtgcctggccctgtgtggaatagaagcaaattagtgcacagccctaatgtgcaatgtgcggtgaaacctaacagaggaatgagttaggtcaggagagcagcaggctggggagtgtgtaacaagcctggcccacttttggtattttgcctaaaartttcccatgcagtgtttcaaataatataaacaaatgaggtgatttaacttctaaaactttattttgctttgaaatgcaaacttctaacaaatagctacataaattcctttttcgataaccatgaaagaggacatattcacttaaaatagaaatcatgccaggtaataaaatgttcagtatggtaattcattaaagcaagtactaagtacattattcacatggctataaaagcaccatcacttttcatgtgtttattaattttaggctcaagggtattaaaatattctcgctctgtctctc

SEQ ID NO: 19529 - DNA, 601 bp, Human
ggaccacttatcatgcatgcaatttttttttactactactgtacttttgattaaatttctgaaatagtcctaaaatagaactcatgagttcaggttgtggctgtaaacataaaactctctgtcagtccaagtggaaatggtgttgccaccttgagtatttggaaaaatagaagaaagagtttgctacaaatatcccagtagcaaaatatttcctgccaattgcacatggtgcaatttgtcatctcacatccatgctcctgggcgtacctgtctacagacgatcctcttgttccgaccagtrctcaacagaagatggcgaggaccgtgtctgtcgtgtctatgctcgtggctgcaaccccagcatctagcatagcgtcaggcacaggaccaatgctcaatgtgcctggccctgtgtggaatagaagcaaattagtgcacagccctaatgtgcaatgtgcggtgaaacctaacagaggaatgagttaggtcaggagagcagcaggctggggagtgtgtaacaagcctggcccacttttggtattttgcctaaaagtttcccatgcagtgtttcaaataatataaacaaatgaggtgatttaac

SEQ ID NO: 19530 - DNA, 601 bp, Human
tgttaaaataagatgcaaactaagcagaatgaagcaactataggttgtttatctatcaccaggaagacatgctcaatctttaagagaaatcatgatctcatgatctacttgctcatataacatttcattgagtcaatctaaaattcctcaagtgctctctaaaaatctagtttctgataggtgttacattttttgaaattttggagaaaacaaccacagtctccttccctataggtgtttctaggaagtttggtaaaattttgacaattagcagtggatttccccagcgttcttgagaacyggtcaaattctactgaagttcagacttacaaatattttcccctcttttttttcccaacttatttttctgcctggggcgttcgttttataaccaaagttatactggcacccctgtttttaaaacctttttgagtcaactgtggtaacacctaattccagactcaaccttagtggcagaaattgtaaagcaactgagaggattcatgctctggtaggcttttaaatatgaagagtttactttctcttttatcctgtacagtataatcagcaataaaagttatctcttgggggatgaagaata

SEQ ID NO: 19531 - DNA, 601 bp, Human
aaactgttgaatatctcagtggagagataattgaatattttatatgagcaagcactctcccctagaatttgtcatgtattctgattttatagctgctaaaaatagaattgtttttcaaatttaatcattcaaaaaatttttgattattagtttttggccataaataaatagacagctttttcatgtctcattgtcatatttaaaaagaggtgcttttgaacaaaatcagttgtcctataggcagcacaaggtactcagtaggggtctaaatattaaaaagaatgacattttttttttttttgtgagtcagataaattttacataaggttgaatagtactagagcttcaggatttgataccatgttttctacaattctgctcactctctgtggccccttaatacttcttgtccctgcttaaaacaacaacaacaacaacaacaacaacaaatctcttcaggccatttctttaatccaaagatacactgttatgtagatgtcaactgggtcatatttcactataaaagaatagagcgacttcattagcttaaacatatatatcgacaatatgttcgactcattcttctcatggctaccaatta

SEQ ID NO: 19532 - DNA, 601 bp, Human
agtactgttaatcagaagtatgccagttttgattttaaaatcctgtttatttttctctgaggatttcacaccatgtagaaattaaaaaaaaaatgaaacgatgacgatgacaacaaaagcaggtactctataatttttttaaaattttcaacaagtgagaattttaatgaattaagggaaaacactagtaatctactaagcctgagaagcaaagataaaaattccttaagaacagcaacaaagatagcttcctctttaagttatgaaggtgatttcttaaaatgtcagcatttcctgaaayaatattaaatatgctctgattttgcactaattttcaataataggaattctaggtcagaaaaaactgcaaaattaatatttctttgtgactttcactgactggcaaagtaaaactatgttataaatgtacttgtaaaagcaataaacatgtatttatcctttgcaattaaattgttgaagtaaatgataaaactgttgaatatctcagtggagagataattgaatattttatatgagcaagcactctcccctagaatttgtcatgtattctgattttatagctgctaaaaatagaattgtt

SEQ ID NO: 19533 - DNA, 601 bp, Human
aaataaagacagtatttctatgtccttgaaacaattgggcaatgagaaggaatctagagctggaaatgtgataacccagtgtgaacacacacaaaagtctcggcatcctgttctacatgtcaaagaggagagtcggtgatctctttctgggaactgtagatgagaagtcttgagtttttcttctgcacattttgaaaggcatatttcataagaacttaactttcaagggcaaataacacgcatggcttccccctgtgttgtcctcacttttacaaaggagttcttcctactctcttaccaygtgctccccccagagatttggtaccagacacatgtggctgttatacatgatggaaatcccttccatggacgttattcctacccatgaaggaaaggagtctgaaagctgaaataatctgccaaagatcaaacagctgttaagtaatggagcctagacccaatctctgatcttccaatggcaaaacctatgctctgtcaactttatggtactaattacaatgatttataatttcatttaaaacatttatttaagtggcttggtattttccaaatataattccagtagaaccacaggagagac

SEQ ID NO: 19534 - DNA, 601 bp, Human
tggaacccaaggtatgtgcaaagctggaagagaaggaaacaaataggaagggattgcttttcgacaagaaaccagagcagatctttgaatagcagaatttctagcatagtcagcaaaagaaataaacaacattacctttttcactatgaggatttaaagatgagtgaacatgacaggaaacttcaatctaaaacaatctgtagcctaagagaaactttgtatcaccaatccagaatcaacttgtggtactttgaagagtgttttttttgtttgtttgttgatttgttttgttcccccccccaccccgcaaagggagcggatcacaaaagaattgaaaaacacagtgatagacctggggaaaataaagacagtatttctatgtccttgaaacaattgggcaatgagaaggaatctagagctggaaatgtgataacccagtgtgaacacacacaaaagtctcggcatcctgttctacatgtcaaagaggagagtcggtgatctctttctgggaactgtagatgagaagtcttgagtttttcttctgcacattttgaaaggcatatttcataagaacttaactttcaagggcaaataacacgca

SEQ ID NO: 19535 - DNA, 601 bp, Human
tttatttaattaatcaattaatttttgagacagagtctcactctgttgcccaggctggagggcagtgttgtgcgatctcagcttattgcaacctctgcctctcagctcaagctattctcctgcttcaacttcccaagtagctgagattacaggcatgtgccaccacacctggctatttttgaatttttagtagagttggggtttcaccatgttagccaggtgggtctcaaacttctgacttcaagtgatccacctgccccggcctcccaaagtgctgggattacaggtgtgagccactgcmtacggcctaaattaatttaaattcattaccttagttgcactatccatatttcaagggcgcaatagtcacatatggctagtggctactgcattggacattagagagatacaacattgtcattaccatagatagttctgttgacaatgctagactgggaccatgtgatgattttccttaaactctgtcatcacatcaaatacataacatcagcagatttcaggacaaaatgcagtggaagtttcttaacgtttggtcatggggccttctaactactcccttgtgtgagaagacattccaaat

SEQ ID NO: 19536 - DNA, 601 bp, Human
ctcttattatgagtcacagacaaaaatatttgcaagcaaacttacttaaatagggctttacagaaagaaaaggtttcttccccctgcatgagccattctctgactttgctttcaaaattaaagcttttgtttaattacaaaatcaatatctgtttattgaagaaattttggaaaacacagataagcaaaaagaagaaaataaattttttaaaataattgtaccactaagaatggaattaacatatgatatattcgttatgttttttctgggcgtatatttatgcaatttttaattttttttaccacaattaggacggtattgtacacacaactacaaaaccttcttttattcatttactaagttatcaggatttatccattgaccttaacggacttccacacctctacatccatgtttaccacatgaggacttttagagctctgtctatattgcattgtccattacggtagccactggcaacttgtggctattgaaattttatttaattaatcaattaatttttgagacagagtctcactctgttgcccaggctggagggcagtgttgtgcgatctcagcttattgcaacctctgcctctc

SEQ ID NO: 19537 - DNA, 601 bp, Human
tttagtaatgtggaagaaaaatagaatagaaaatatcagtgtgcatcaaacataataagagctgtttcatgaatctcgtttccactacataaaggtagttatatatttgtatgtgtgctggtacataatgtaaaaatgtatttacctcttattatgagtcacagacaaaaatatttgcaagcaaacttacttaaatagggctttacagaaagaaaaggtttcttccccctgcatgagccattctctgactttgctttcaaaattaaagcttttgtttaattacaaaatcaatatctgtttwttgaagaaattttggaaaacacagataagcaaaaagaagaaaataaattttttaaaataattgtaccactaagaatggaattaacatatgatatattcgttatgttttttctgggcgtatatttatgcaatttttaattttttttaccacaattaggacggtattgtacacacaactacaaaaccttcttttattcatttactaagttatcaggatttatccattgaccttaacggacttccacacctctacatccatgtttaccacatgaggacttttagagctctgtctatattgcat

SEQ ID NO: 19538 - DNA, 601 bp, Human
agacactattctactggtaacataacaaagagcctgtcagtaattttatttttttaatccaaaattttatttgataaagaaaatgcagtcaaaatgcatatttattctcaataaggatatccattagaataaacacttacgtcatcttcttttggagcgtttattttcacttgatattctagattaacattcctttgctcttgatcaggatttggtttccattgtaaaagaacttgagccaaaccagtaactttaatggtgaaattgacaggtgggagaagtgaaactgttgattcaaagrataaagaaacaacacaatgttcaactggacataggcagcacttttaaaacttttcgaatatttattgccctgcagatgctgtcctggacctgccagcaccacagacacagttgctcctgcgtgcctgtaacaccggggcaaagagaaagtggctatttctacccgagtagctgggactacaggcgcatgccaccatgctgggctaatgtgggttttttggtatttttaatagagacagggtttcaccatgttggctaggctggtcttgaactcctaacttcaaatgatctgtccgcctca

SEQ ID NO: 19539 - DNA, 601 bp, Human
cttcttgttttactaggctactgtctcctgttctgttggtaattttatgggaaacagaaaaccagtacccaatccatggtgcctaaaaagttactaaacattcttccttaagggaaagaatcatccaaaagttaaaatattctgtgatgctgtttaacgctgaacaatacacccggcgctagctcacaggcattcttagagagacactattctactggtaacataacaaagagcctgtcagtaattttatttttttaatccaaaattttatttgataaagaaaatgcagtcaaaatgcatrtttattctcaataaggatatccattagaataaacacttacgtcatcttcttttggagcgtttattttcacttgatattctagattaacattcctttgctcttgatcaggatttggtttccattgtaaaagaacttgagccaaaccagtaactttaatggtgaaattgacaggtgggagaagtgaaactgttgattcaaaggataaagaaacaacacaatgttcaactggacataggcagcacttttaaaacttttcgaatatttattgccctgcagatgctgtcctggacctgccagcac

SEQ ID NO: 19540 - DNA, 601 bp, Human
ctgaccaagacaatggttattgggtgcacccacatgtcccaggacttggtagcctgcttctcctcttttctctcccctgttgtgtgtgcacttaagtgtttgatcagaagtattactgactctaagtatcagaaacaccaactttccactggaggccaatgcagagactgtggatatttctgcaagaatgtgccagatggaattcagttggttatgataagaagtggcagcagccttggttaggatgttgttgatatgggagagtacttgacaagaacgggtgactgactaaagaaaagtrggttagtgttaatttttctacttttccatatttgcaaagtccaaaacatacaaactggacttttggaggcctgctttacctggtggggcatgaagttcagcagaagcccagctgctggccagtagtgagtggtcgttctgcaggatggtccgcacacttgctgaaaagcctttgtggaggatggttacacatttgctttcagtgattctggtttcatactaaaaataaaacccacaagtcatgatacataaaagagaactagacttaagagagctattttaatcaaatatgcattttctt

SEQ ID NO: 19541 - DNA, 601 bp, Human
ctcaaaaaaaaaaaaagtaaatgagaagatctttatgcttctgttttaagtcactgacacaattcaggaggtatggtctcttcagctggtgatatgacaaaatagtcgtttgaaaattacccgtgagctcaactgaccaagacaatggttattgggtgcacccacatgtcccaggacttggtagcctgcttctcctcttttctctcccctgttgtgtgtgcacttaagtgtttgatcagaagtattactgactctaagtatcagaaacaccaactttccactggaggccaatgcagagacygtggatatttctgcaagaatgtgccagatggaattcagttggttatgataagaagtggcagcagccttggttaggatgttgttgatatgggagagtacttgacaagaacgggtgactgactaaagaaaagtgggttagtgttaatttttctacttttccatatttgcaaagtccaaaacatacaaactggacttttggaggcctgctttacctggtggggcatgaagttcagcagaagcccagctgctggccagtagtgagtggtcgttctgcaggatggtccgcacacttgctgaaaag

SEQ ID NO: 19542 - DNA, 601 bp, Human
acaataacccatctctgtgttcctgtatctaccttggattagtctctgtacttgggatcaagcccatgcaaattggctggtatgtggtctagacaagttataacaagtaaatggggccggacacggtggctcatgtctgtaaccccagcactttgggaggccgaggcgggtggatggctggaggccaggagatcgagaccagcctggccaacatggcaaaaccccatctcaataataataataataataataataataataataataataatacaaaaattagtccagcatggaggcgcawgcctataatcccagctactcgggaggctgtgacatgagaaccgcttgaacccaggaggcagaggttgcagtgagtcaagaacacaccactgcacttcagcctgggcaacagaaggagattctatctcaaaaaaaaaaaaagtaaatgagaagatctttatgcttctgttttaagtcactgacacaattcaggaggtatggtctcttcagctggtgatatgacaaaatagtcgtttgaaaattacccgtgagctcaactgaccaagacaatggttattgggtgcacccacatgtcccagga

SEQ ID NO: 19543 - DNA, 601 bp, Human
ttattattattattattattatttggaaacagagtcattctgtcacccaggctagagtgcagtggcatgatctcagctcactgcaacctcaccctcccgggttcaagcagttctcctgcctcagcctcccgagtaactgggattacaggcacgtgccaccacactcagctaatttttgtatatttagtagagacggggtttcaccatgttggccaggctggtctcgaacacttaacctcaagtgatctacccgcctcggcctcccaaagtgctgggattacaggcgtgagcgaccgcaccmggccaagattttaaatgcaacctttttatgtttgcttcattaaggatttctcaaattatgtgactagaaaggcttgttttcatttcaacctctcgttgctgtattaactgttggtctttaaaatacactgtgggaaacactggccttgttggtggttgctcagagaaggaaacaagctcttgcacctgggccaggaaggaccgcattcaagtgggagccttgagagatagaagggggtcttttgatcgtagcttaagtgagctgtagatcatttttatcactgtcagccagtgtctttca

SEQ ID NO: 19544 - DNA, 601 bp, Human
gggaggctgaggcgggcagattgtttgagctcaggagtttgaaacaagactgggcaacatggcaaaaccccaactctacaaaaaatacaaaaattagccaggtgtggcggcatgtgcctatagttccagctactcgggaggttgaggtgggaggatcacttgagctggggaggtcgaggctgcaatgaaccaagatcataccactacactccagcctgggcaacagagtgagaccctgtctcaaaaaacaaaaccttcagattttattttatttattattattattattattattattataattatttggaaacagagtcattctgtcacccaggctagagtgcagtggcatgatctcagctcactgcaacctcaccctcccgggttcaagcagttctcctgcctcagcctcccgagtaactgggattacaggcacgtgccaccacactcagctaatttttgtatatttagtagagacggggtttcaccatgttggccaggctggtctcgaacacttaacctcaagtgatctacccgcctcggcctcccaaagtgctgggattacaggcgtgagcgaccgcacccggccaagattttaaat

SEQ ID NO: 19545 - DNA, 601 bp, Human
gccaccatgcccggccatgatcacatatttctagaaacctactaactacaaaaggccaacttactggagatatggaattagaattataaagtccccatttctgatattcgagagcttcccagctattttgtttggggcctgggggtggtgtttgtgcaatacatgtgtggaagttcaagagaagtacaatatattgtcattttgaggttgatgtccggcaactttggtgctctaatgccacatttgttaataactagctgtgagacattgacccccactcttctgggctctgtgttttcarctgtaaaggagcgggttggtacaggaaggtcttgcgtatccctttccatcctagaattgtgtgattcattaggttgtatccaaattcttcatgaattacataggttgctgctcagaagaaatgagttttgacaacactgcaagattgcagactttgcagacttgatgcacattagcatgttaaagtcctctttaatatactaggacttgaagaaaaccttgaattggccaggcacggtgctcatgcctgtaatcccagtgctctgggaggccaaggcgggtggatatctcttgagcccag

SEQ ID NO: 19546 - DNA, 601 bp, Human
tggaactatagtgatgtgaacgtcgtattcatcaccaaaaaataatcatcttcacatttttttttcccttgagacagagcctcactctgtcacccaggctgcagtgcagtgttgcgatcttggctcactgcaacctctgcctcctggcttggagcgattctcgtgcctcagcctcccaagtagctgagatgacaggtgtgtaccaccacacctggctaatttttgtattttcagtagagctggcgtttcaccatgatggccaggctggtcttgaactcctgacctcaagtgatccacccayagcctcctaaagtgctggaattacaggcatgagccaccatgcccggccatgatcacatatttctagaaacctactaactacaaaaggccaacttactggagatatggaattagaattataaagtccccatttctgatattcgagagcttcccagctattttgtttggggcctgggggtggtgtttgtgcaatacatgtgtggaagttcaagagaagtacaatatattgtcattttgaggttgatgtccggcaactttggtgctctaatgccacatttgttaataactagctgtgagacat

SEQ ID NO: 19547 - DNA, 601 bp, Human
gtggcactagtccatcacaggacccaggggcagaaatttcacaaaacctgtcagaactcatgaaggattaaatggtctcttttaagcagctaaattcactttttctggtgcagtgattctcaactgggggaaattttaccccttgaggggcatttggcaaagtctgagacttttttaaaagtcacagctcaaggacagaggggcatactactggcatctagtgtgtagaggccagagatgccgctaaatatcctacagtgcccagcacagccctccataacacagagttgtccagcaaaamtcactggtggtgttggaatggagaaccttgccccagtggttttcaaacatgggtctgatgcttacttggcatcagagaagcagtaaaactaggtgatctttataacccttccttccagtgctgagattccgagattcagttatttcagctttgggttaagtcggtcttaccaatggcgtgaagggcaaacagctgatcaaagggcctgatagcagagtgcttgctggagccgttaacaagcaccgcaagccagtcacgccctttgctgaggataaaagtcctgggaaaccagcatgcgat

SEQ ID NO: 19548 - DNA, 601 bp, Human
cattgaaatctggaatctccataactaagaatgccatgtgagagcgcctgatgagtttcactaatagaactatctgggatgagggagagtgtcttctctattgagaactgagcagacaaaaccacgaatagaatttttagagctgagaattgcacactgagagatattcgagctgcagaacatccaggagatgggccagaacagtgagaaattcagagagagagagatgttagcctgggagaagaagggcttctggatgggaaacgtgctgcctgtgaacagctaagagaggctattctayagggaagggactcaaatcacctggggtggcactagtccatcacaggacccaggggcagaaatttcacaaaacctgtcagaactcatgaaggattaaatggtctcttttaagcagctaaattcactttttctggtgcagtgattctcaactgggggaaattttaccccttgaggggcatttggcaaagtctgagacttttttaaaagtcacagctcaaggacagaggggcatactactggcatctagtgtgtagaggccagagatgccgctaaatatcctacagtgcccagcacagccctc

SEQ ID NO: 19549 - DNA, 601 bp, Human
ttaggtaatatgacttagatctcacaattaatagggaaaagctaggagtgggatccactggcttcagagcctcctataccctatgaagaaaattcttaaccaagaaagtacttatttattttagtaatcctaggaatcagcctcaataaaatgaaaatcataaaagaaaaatgaattcctgtggtctgtactagatcatatccattttcatattaatatcattgtttcctaggtcttcctcggcatcttttattgcctattttcatgaaagtgacatttttagttcacctaagaaatataytactggagagaattgcataacctctttagtaagggctatgattctttacacaaagttatattccattggatatagatatgtcacagccaaatcataccttctaaataatattgtagtgtatttattaaacctttatgccaggcactgttctaagtgctttatcattagtaacacaattctcacgaagactgcacaggaagtattgattcctctccattgtttcagataagaagattaggcacaaaggaatgatcagcttgtccaaggtcactcagccagtggtggagccaggatccaaat

SEQ ID NO: 19550 - DNA, 601 bp, Human
gacagagcaagaaatctgtctcaaaaaaaaaaaaagaagaagaagaagaagaagaagagtggattgggctaaatttgtctttacttaggactctaatgtcctttcccttgagatctcacttgattgtcttatggtccggtgaggtgaggggaaatgaattcttaatgagtgtccttgtcttaggtaatatgacttagatctcacaattaatagggaaaagctaggagtgggatccactggcttcagagcctcctataccctatgaagaaaattcttaaccaagaaagtacttatttatttyagtaatcctaggaatcagcctcaataaaatgaaaatcataaaagaaaaatgaattcctgtggtctgtactagatcatatccattttcatattaatatcattgtttcctaggtcttcctcggcatcttttattgcctattttcatgaaagtgacatttttagttcacctaagaaatatactactggagagaattgcataacctctttagtaagggctatgattctttacacaaagttatattccattggatatagatatgtcacagccaaatcataccttctaaataatattgtagtgtat

SEQ ID NO: 19551 - DNA, 601 bp, Human
ccctctctactaaaaatacaaaaaattagctgagcgtggtggtgggcgcctgtagtcccagctactcaggaggctgaggcaggagaatggcgtgaacccagcaggcggagcttgcagtgagccgagatcgcgccactgcactccaacctgggtgacagagcaagaaatctgtctcaaaaaaaaaaaaagaagaagaagaagaagaagaagagtggattgggctaaatttgtctttacttaggactctaatgtcctttcccttgagatctcacttgattgtcttatggtccggtgaggtgasgggaaatgaattcttaatgagtgtccttgtcttaggtaatatgacttagatctcacaattaatagggaaaagctaggagtgggatccactggcttcagagcctcctataccctatgaagaaaattcttaaccaagaaagtacttatttattttagtaatcctaggaatcagcctcaataaaatgaaaatcataaaagaaaaatgaattcctgtggtctgtactagatcatatccattttcatattaatatcattgtttcctaggtcttcctcggcatcttttattgcctattttcatgaa

SEQ ID NO: 19552 - DNA, 601 bp, Human
cagaataaacctgaccactgagagaacatttccctggaccttccaccaagccttgcctcttcccagtaggtatgtggccctgaacaaatcacttcccctttctgagattcagtttttaattttaatttcattttgtttactgcgtcttttggtttttgtttgtttgggggctggagcaggaagcttcagttttcttttgcatcaaaaagaatggattggggcagggcgtgggggctcacgcctgtaatcccagcactttgggaggccgaggcgggtggatcacgaggtcaggagatcgaawccatcctggctaacgtggtgaaaccccctctctactaaaaatacaaaaaattagctgagcgtggtggtgggcgcctgtagtcccagctactcaggaggctgaggcaggagaatggcgtgaacccagcaggcggagcttgcagtgagccgagatcgcgccactgcactccaacctgggtgacagagcaagaaatctgtctcaaaaaaaaaaaaagaagaagaagaagaagaagaagagtggattgggctaaatttgtctttacttaggactctaatgtcctttcccttgagatctcacttg

SEQ ID NO: 19553 - DNA, 601 bp, Human
ccatccccctttactactcaagttgtaccaggcccagaataaacctgaccactgagagaacatttccctggaccttccaccaagccttgcctcttcccagtaggtatgtggccctgaacaaatcacttcccctttctgagattcagtttttaattttaatttcattttgtttactgcgtcttttggtttttgtttgtttgggggctggagcaggaagcttcagttttcttttgcatcaaaaagaatggattggggcagggcgtgggggctcacgcctgtaatcccagcactttgggaggcygaggcgggtggatcacgaggtcaggagatcgaaaccatcctggctaacgtggtgaaaccccctctctactaaaaatacaaaaaattagctgagcgtggtggtgggcgcctgtagtcccagctactcaggaggctgaggcaggagaatggcgtgaacccagcaggcggagcttgcagtgagccgagatcgcgccactgcactccaacctgggtgacagagcaagaaatctgtctcaaaaaaaaaaaaagaagaagaagaagaagaagaagagtggattgggctaaatttgtctttacttag

SEQ ID NO: 19554 - DNA, 601 bp, Human
tttgtttttttgtttttgtttttttagatgaaatgttgctctgtcacccaggctggagtgcagtggcgccatctcagcttactgcaacctccgcctccctggttgaagtgattctcctgcctcagcccctgcccccgagtagctgggattatagtcacgcgccatcacgttggctgatttttgtatttttagtagagatggggtttcaccatgttggccaggctggtcttgaactcctggtctcaggtgatccacccacattggcctcccaaagtgctaggattacaggcgtgagtcaccscacccgtctatcattttagattttaaccagcactagtaccaatgagtctgtatctaatcctttgtattagtttcaaccaaaagtatgttctttcaaaacaaaaggccagtaagatttggtttatatctatttggttatatctataatacctgggtagattaagttaactttgaccttgttagtaccaagctgtaacttggttgcagtcactgaagataattttttaaatgtttctaaaacaaatgtctgttatcaaatattggaataatctgagtaattacctgcaaatatccattcctt

SEQ ID NO: 19555 - DNA, 601 bp, Human
ggctgaggcgggcagattgtttgagctcaggagtttgaaacaagactgggcaacatggcaaaaccccaactctacaaaaaatacaaaaattagccaggtgtggcggcatgtgcctatagttccagctactcgggaggttgaggtgggaggatcacttgagctggggaggtcgaggctgcaatgaaccaagatcataccactacactccagcctgggcaacagagtgagaccctgtctcaaaaaacaaaaccttcagattttattttatttattattattattattattattattattattttttggaaacagagtcattctgtcacccaggctagagtgcagtggcatgatctcagctcactgcaacctcaccctcccgggttcaagcagttctcctgcctcagcctcccgagtaactgggattacaggcacgtgccaccacactcagctaatttttgtatatttagtagagacggggtttcaccatgttggccaggctggtctcgaacacttaacctcaagtgatctacccgcctcggcctcccaaagtgctgggattacaggcgtgagcgaccgcacccggccaagattttaaatgcaa

SEQ ID NO: 19556 - DNA, 601 bp, Human
ttgttgaatctaattgaattggctttgtctactctctgtaagacataagttggaatcctattttttttcctagctttgtgactgtgggagagttacttcatctcttttgcctcactttcctataaaatgggaatggtaattacatcatagaattatgtgaggatggaataaacacataataaagcttgacacataattgatgctcaagaaatgttgattggctttcttctcagttcctttccccttgaaatttttgtctattagtgctaatgagtttttttaattgtaaaatacatataaygaaatttaccatcttaatcctttttaagtgtacagctttgtgatattaaatagtttcacattgttgtgtcaccaatgttcaacactcttttaatcttgcaaaactggaactctgtacccattaaacaatacctctccttccaccctcctaccaattcctggtaaccaccatcctaccctgtttctatgagtttgactatttaacctcataaaagtagaatcagacagtatttgtcctttcgtgactgacttattttgcttagcataatgtcctcaaggctcctccatgtggtagcatgtg

SEQ ID NO: 19557 - DNA, 601 bp, Human
ctgcaatttggaagttttgatagcaatttgacattgccatgatatccaaacacatgatcagtgaactgacactttacatgtctttggctatatttaattttttctagcagatcatttttattgtatttgacaaaagcaccaatctatggtagattagacattataaaaacacacgcacacacacgtgcacacacagtccttcagtgtaagtattttgggaagctctggctaagaaagtccttctcatgttttctcaccagactagtttctcttcatccttacagattccgttcaattcctstctgcagagcaggctctgtgcccacacccccatctctagctgtactggcttttcctgtgggagggcaaccccaaggctgggcaagtatgtcacaagattgggtcactccatggcagaaacagtcttatttctcacaaagaagccaatttgtaaatatttgttgaatctaattgaattggctttgtctactctctgtaagacataagttggaatcctattttttttcctagctttgtgactgtgggagagttacttcatctcttttgcctcactttcctataaaatgggaatggtaattac

SEQ ID NO: 19558 - DNA, 601 bp, Human
aatgtcagatacagagtcatgatttcagcattggtcttatgtccaggcatccaggcagactgaattacttgccacttgactgaaagaaccatactctctcaagcataaagttactccttttcctaggctggtgcaagtcaggaactatttattactggcttgtgatgggctaaatacagataaaattatgactgcaatttggaagttttgatagcaatttgacattgccatgatatccaaacacatgatcagtgaactgacactttacatgtctttggctatatttaattttttctagcaratcatttttattgtatttgacaaaagcaccaatctatggtagattagacattataaaaacacacgcacacacacgtgcacacacagtccttcagtgtaagtattttgggaagctctggctaagaaagtccttctcatgttttctcaccagactagtttctcttcatccttacagattccgttcaattcctctctgcagagcaggctctgtgcccacacccccatctctagctgtactggcttttcctgtgggagggcaaccccaaggctgggcaagtatgtcacaagattgggtcactcc

SEQ ID NO: 19559 - DNA, 601 bp, Human
atggtttttaaaaaagaagccacttctttattttttagcaaaatcttatagagccactctgggagaaatcacaatgtcagatacagagtcatgatttcagcattggtcttatgtccaggcatccaggcagactgaattacttgccacttgactgaaagaaccatactctctcaagcataaagttactccttttcctaggctggtgcaagtcaggaactatttattactggcttgtgatgggctaaatacagataaaattatgactgcaatttggaagttttgatagcaatttgacattgcsatgatatccaaacacatgatcagtgaactgacactttacatgtctttggctatatttaattttttctagcagatcatttttattgtatttgacaaaagcaccaatctatggtagattagacattataaaaacacacgcacacacacgtgcacacacagtccttcagtgtaagtattttgggaagctctggctaagaaagtccttctcatgttttctcaccagactagtttctcttcatccttacagattccgttcaattcctctctgcagagcaggctctgtgcccacacccccatctct

SEQ ID NO: 19560 - DNA, 601 bp, Human
taaccaaaacaaatttttaaaaaatcacttttggaggccttccacaaatggtctcgtggtttacgataaagctacagtaatcaagacagtattgtattggcataaagatagacaaatagatcgataaaaccaatcagatagtccagaaatagaaccaactacatacagcaactaatttcctacagaaatgccaaggcaattcactggggaaaggatgatttactccaacaaatgatgctggaacaattggagagccataactaagtgaccactgggctgaacctaagcgctctgaatggtraacaggcctaagaaaatgcatattgggtaaaataatttgccttttctatggtcttttttatactaaagagctaaagttccctctgaaaattctctattaactaagatattcatgtggaaacatggagtcttaaaacattagagctaagcagaacattgtacaatctcatctgtgtcccttattataccagaaagaaattcagaactcagagggttgaagagattgtccaaagtcagttaaggcatggctgatatgaaattaaaatttaagtctaactgtcaagaacacttataactcagt

SEQ ID NO: 19561 - DNA, 601 bp, Human
tacctggccctttacagaaaaagtttcttgagccctgatctaaataaccgttcaccttaaggataaatttgacaaagtgcaataatcatacactgaaaaatcacaaaccattgctgagagaaggtaaagaaaacctaaataaatggagtgatatgctatgtttatagataagacttaggatgtcacttttccccaaattaactgacaactcaacacaatctcaccccaaatcccagctacctttttttgtagaaaattgtcagccgaatctaagatgtatatgaaaatgcagaggacctamaataaccaaaacaaatttttaaaaaatcacttttggaggccttccacaaatggtctcgtggtttacgataaagctacagtaatcaagacagtattgtattggcataaagatagacaaatagatcgataaaaccaatcagatagtccagaaatagaaccaactacatacagcaactaatttcctacagaaatgccaaggcaattcactggggaaaggatgatttactccaacaaatgatgctggaacaattggagagccataactaagtgaccactgggctgaacctaagcgctctgaatg

SEQ ID NO: 19562 - DNA, 601 bp, Human
ctcaaagtgctgggattacaggtatgagccactgtgaccggcccttcactgacgtccaaatttctaactgaggtctgaacaagcaaaaacttgcttctagggtggcagagctcctctaagtcctgggactttgggcacccaccccaagctcagaggtgcacattaccatgaaaagcagagggtttcctttcccactagccaaacatttcccagtggccactgcccatagcaccaatgtgccctcttgtcacccttgtagcacagcctctgagaatgggttggatggcttttgtccttggasgtggaggctgtgcacggcctcatggggcccagctgtaggcagctctgcactggctctcatcccctctcaggtggagaatttaggccatagagcccacagcaccaggcagtacttcatttctcccattctgtgtgctctttctttcttctctcagtctctaactgctttgtttttatgtgaaactctgcaatgtgagaagagaataagttgtcctgagaagccaggcgctgtggagtgccgtcattcatcctctgcttattctgaaaccagcttgtctgccccaagttgttattttacaca

SEQ ID NO: 19563 - DNA, 601 bp, Human
gccaccatgcctggcctctagtaccctttctactacgcctaagcatctaggggcgcctctctgaccagaagtaaaacataaatttaccatccatgttgtgaatgtctttgaccgttcagcccgatatctgagctcaaaccgtagtctgtagaaagatgagttccaggagtgggggtcttgccaggtgacactgagccagcgggggtttctggccacggcagtgactgtgatgttggcaggcggatcaggctgcactgtgggaaaagtgagcatgactcctttgcagcaccaaatatagtgkagagaagcccatgtaggctgagatcccagcaagcagggccccacccagccccgttcactccccatgcacagctccacaagggcctgctttatcattgccacacctcccggcaagcaacgcccaaaaggcaccaactcaccaaacccctcaaccaccccttccctgccactctgagaagtcgataaggagtattaaatcaaaagagaaggaaactgctggagagggggttagagcttacgtacagattccacaaccctgaaaggtttgagttttgctgaacttgctcccgacactactggc

SEQ ID NO: 19564 - DNA, 601 bp, Human
tagtaccctttctatttttttttttttttgacatggagtctaactctgtcgcccaggctggagtgcagtggtgtgatctctgctcaccgcaacctccacctcccaggttcaagggattctcctgtctcagcccccgaatagctgggatacaggcgtgcgccaccacacccagctaattttttgtaattttagtagagacggtatttcaccatgttggccaggatggtctcgaactcctgacctcaagtgattcgcccaccttggcctcccaaagggccgggattacaggcgtgagccaccrtgcctggcctctagtaccctttctactacgcctaagcatctaggggcgcctctctgaccagaagtaaaacataaatttaccatccatgttgtgaatgtctttgaccgttcagcccgatatctgagctcaaaccgtagtctgtagaaagatgagttccaggagtgggggtcttgccaggtgacactgagccagcgggggtttctggccacggcagtgactgtgatgttggcaggcggatcaggctgcactgtgggaaaagtgagcatgactcctttgcagcaccaaatatagtgtagagaa

SEQ ID NO: 19565 - DNA, 601 bp, Human
ctgatgcaatgacagttgaaacatcccttcctttctcagtgcccaccgcagtacctgtccaaggcgtgcccatggcctccgggctccactcgctccactcgccttgcccgaactcctcctgggcacgaagctgcaccacgtgcctcaggccgctccaggcgtcgtggatgacacagtgatgctggaggtccttgacctgagggcgggggcacggtgactctggggaggtatccaggatggtgctgggcaggtagcaccccagtgggttggtgccttggccagccctgtgcttcagctggcrgaggcctctagaggctcccacaaccccagaggctctgctagagagggggttgccctcagggcccacggaagctgaagcagaaagtccctgccccacccatgcactatagaatcctgcaagccacaacccttgacatgtctacagcccaaatctcttcccacattgctctcctcacagacaagcccgggaagaggagactggcctggcattatccttttcatttaataaatgatataccaccaaggctcagaaagcttaaaacatttatccaaagcaacgaaggtagccaattgtgaagca

SEQ ID NO: 19566 - DNA, 601 bp, Human
cttgacgagactccgtctcaaaaaaaagaaaaaaaatcatcagtgagggtggacgaagaggactggaggttcccctcctccatagcagcttttgtttttgttgttgttgttttgtttttttgacatggaatctcactctgtggcccaggctagagtgcagtggctcgatctcagctcactgcaacctctgcctcccaggttcaagtgattctcttgcctcagcctcccaagtagctgggattataggcacctgccatcacgcctggctaatttttgtatttttagtagagatggggtttcmccatgttggccaggctagtcttgaactcctgacctcaggtgattctcctacctcggcctcccaaagtgctgggattacaggcgtaagccaccgcgcccggcccatagcaacctttgaacacccaacctcttgcatcccacccataccattcaaagcccatttcaaatggcacttcctccatgagctttctgtgactgctcagcttgatatactctttcaaatctctaaattccactttgctttatctgtgcctcccttttggcccatctcacatgctggtctttgtcacagttaccaatt

SEQ ID NO: 19567 - DNA, 601 bp, Human
agaaaccccgtttctactaaaaatacaaaattagccaggcgtggtggtgcatgcctgtaatctcagctactcgggaggctgaggcaggagaatcgcttgacgagactccgtctcaaaaaaaagaaaaaaaatcatcagtgagggtggacgaagaggactggaggttcccctcctccatagcagcttttgtttttgttgttgttgttttgtttttttgacatggaatctcactctgtggcccaggctagagtgcagtggctcgatctcagctcactgcaacctctgcctcccaggttcaagygattctcttgcctcagcctcccaagtagctgggattataggcacctgccatcacgcctggctaatttttgtatttttagtagagatggggtttcaccatgttggccaggctagtcttgaactcctgacctcaggtgattctcctacctcggcctcccaaagtgctgggattacaggcgtaagccaccgcgcccggcccatagcaacctttgaacacccaacctcttgcatcccacccataccattcaaagcccatttcaaatggcacttcctccatgagctttctgtgactgctcagctt

SEQ ID NO: 19568 - DNA, 601 bp, Human
taaagataggggaccacatggctttgctgggactcctcgtagaaactggggactttgtcaagactttgacttttactctgggggagatggtactgagccagagagagcttggatttgtgttttaagggatactctaagtgctggttggaaaagagttggttgggggttaagactagaagttggtagaccagttggcagcccaggaagccctgctggatgagaggcggcaggggctggactgggtgttggcactggagatggtgaggagtggtcaattcctagatacgtctcaaagcacaargacaacgcttgctgagggactggacacaggatgaggagtagggaggaagcctgcccgatcccccgcacctgagcaaatgcggtaccagttactgagatagggaagatggagaagaacagatctgggttgaataggtggggaggcgtcaggtgttctcttttagacatgttaaatttgagaatgctggccaggcgcggtggctcacacctgtaatcccagcactttgggagaccgaggcaggcagatcacctgaggtggggagttcgagtccagcctgactaacatggagaaaccccgttt

SEQ ID NO: 19569 - DNA, 601 bp, Human
gtgctgggattacaggcatgagccacggcgcctggccatatatttgttccttctttcatccaacaaatattctttgagtgcctatcatgtatctaaatggatcttacatccaatcaagggagacagacaaatgaattttttttttttttgagacggagtcttgctcagtggcgctgtctcggctcactgcaacctccgcctcccgggttcaccctattctcctgcctcagcctcccgaggagctgggactacaggcacccgccaccacacccggctaattttttgtatttttagtagagayggggtttcaccgtgttagccaggatggtcctgatctcctgacctcgtgatccacctgcctcggctcccaaagtgctgggattacaggcgtgagccaccgcgcccggccaaacaaatgttttttaaaaaaattatcaggaaaagcctcccggagaagggtgcatctgagcagagacttgagtaataggaaggagctggcaaagtgaatgtcagaggaagcgtgtccaggcagagcacacagcaagtgcaaaggccctgaggtagagcatgtgtggaggagcaaggagggcagtgtggctgg

SEQ ID NO: 19570 - DNA, 601 bp, Human
acacctaagtaagttacttctatgctgacacagcgaatattggatattccaccctctcaagagaaaacagtcagcagttttttaaaaaccaagtttaaacgcattcttgccaggctcatttttcttttcacattgtcttccttaatattatcttccctagttacccaggttcagctgacaacaaacaaagctgcagtaaaaccgttttgatctcagaaatggcagaagccctccctgctgctagctctcctttgtgggaggtggagaagagagaacattggttttcagaggctgtgatccyccactcagctcccactctacaggggatggtagagaccctgtgcccctctcctctccttcctctgcttctcacctgaggtcctgcaacccaaagccaatgcagttgcctctgtattcagcaaatgcctaggatcatcattcacatttagcaaaatgctaatgaggaactaattataattctgttgaaaacgaccaggccctgagatactgtattattcacccactcaccctcagctgtttttcaactgtagggaagaaagggaggagagagcttcttcccccagccttggcggtttaagta

SEQ ID NO: 19571 - DNA, 601 bp, Human
ctcaattatgtcttctaaacaggtttatttttccttccctgtgtacaagacttgactgttcataagaaactgcaaacagcctgcctctcaaagctgcctgaaacacctggcaagtttcacagtgatatgcgcagaacagtccagaaggcagattctaggcctggcaggtgggcaccctgggtgctccctgttggatcttgaggcctaacctctagcccagcagagtcagctaaaatctgagctctccctctccctccaagccacactttgcaaagggattccttgtattgtgggcttggartcttttctccccatttgcctctgcaggaagcccttgcaacaacacatctggatagcctccaggtcccaaggctggagggacttgtaatgggaaagtagtctttaaatcagatttacttggcaccctgtttgccactgaaagaggcaatttaggggaaaaatctggtctccaagcacagataacactctactcttgaaagaggagacctgctcatgttactggtctcagcgtctccactgacctgtaataagccatcatttcactggcgagctcaggtacttctgccatggctgcttcaga

SEQ ID NO: 19572 - DNA, 601 bp, Human
aggcatgataatggttcaaaggcttgaaagacagttaaagagacctgtaagtgcacaaaagaaagttgagcaggagagaatttcctgcctggagcagagccaagctgctggaagaggcaatgggggcaaaggccaggcagacaagccaatgggctcctcccacagctgcagccaacaagttatgccagtcttaaaacttctaaagaaatatgtttttaacaagattgaggactggattatgaggctaggggaggctatcacaaactggaataaaataaagccagagaaaagtggctgcctyccaacctgcacaactgacctagctaggctgatggctgggccacctaggaaggctactgagcatcatataaaacagaagggacagcaggaatataacatggctctttgtaaggatgagtctgaaaaatgaccatttgctgcccaaatgcccttagctacaactgaaaatatttcagaactggaggttgcaggatgctggaatctcagagatcatccagctcagccctttatttttcagatgaggtccaaagcgggtaaaatgacttgtcaaggtcaaacagcaagtgaatggttttctttc

SEQ ID NO: 19573 - DNA, 601 bp, Human
ctttgtttaaaacatggagaattagcaagctgccaggaggccaggcagggaaaccaggatgtttccatttaccttgttgctccatatcctgtccctggaggtggagagctttcagttcatatggaccagacatcaccaagcttttttgctgtgagtcccggagcgtgcagttcagtgatcgtacaggtgcatcgtgcacataagcctcgttatcccatgtgtcgaagaagataggttctgaaatgtggagcacatgttgtttaggtataaaatcagaagggcaggcctcgtgaggcgaggyggcaaaatttgatttcttggaggacacctgagcatatacggtcaaagtctgatgacaacaccagtagggatgaagctgggagtggggtggctaagaacactggacctgacactattagacatgggttccagcttcaggtctattactgctcactgtggccgagcaacagagctacttaggtaaaatggtgatggtcataacactagcccacagggaggttacgaacctctggtgacaatgtaagtgaaaggcccctgagaaagagtgagggagttgcaaatgtcagtagccatcaagatc

SEQ ID NO: 19574 - DNA, 601 bp, Human
aagacgggcatgttttctgcttgagaggtgctgatgtaccagttggggaactgggcagactcaaattccagcttgttattgatttctatcttgttgaagacaaatcgcttttccatcttcttctttgggtaatttttgggatctacactctgcagcgaaagagaaagaagaatttttgtggggcaagggacaaagatgctatgggaaagatgttctttgggttggccagaaaggaaactgacgagcaggtcacatgatcaggagccagactcctgagttgtaactgggcccccaactttcygtgtgattattaaaagagcccttcttcttttctaaaacttagtgccaaatgctgaggagcataatgtaggtgagaattttttttttttgggggggtgaaaattaagctagagcttcttgaagtacctagtttccaggggctttttattgtatttttccttatggtcctagaatgacatcaacttggaaatgaagcttttgctgagaaagctggaggtgatagtggtggtgattttgggagtggagtggacgtgataatgggaccctttaagtcatctatttcccaaggtgtctatcaaat

SEQ ID NO: 19575 - DNA, 601 bp, Human
atatccttctgttgaacaacagaaataaaggggatgggtgaggaggatagtcttcggtggccaaggatatttctaggtactttgcagcactcagcaatgaggagtgggctttagtcccccaagaactctcacagccctgtttgtctttactgttcagtgtcaaatccaagacaagtcaatgatcaggaaagaccctttttttttcttcagtgaagtttatttcagaaccattgaacagtatgatatttgctcatttataaatattcccatttaaataatctgagcttatatattttcagtsttaattaaaggacttgatttaaagagagcacaccagtccaaattgaattgattccatagctattaaaaactaggctcttttacagacactgctacttcttgccccctttgaataaattagaccaatgaataaaacaaacaaacaaataaataaataaatagggaagcggttgctcatcagaatgtgggagcgaatgacagagggtttcttagaaccaaatgtggccgtggtttctgtcaggcgggctttaagtgagtaggagaggtgagagaggcctggctcaacaaaagggctggggat

SEQ ID NO: 19576 - DNA, 601 bp, Human
gcgcacctgatgcccaaactggttgcacgggaagccgagcaccaccaggccccggggtccgaggcgccgctgcagctcgttcatctgggtgtagtcccggaccgtggtgcctcagagggacgccacattctcgataagtagtaccttgccccgcagggagcccaggctcacaggctccccgccggccagcgggcgcgccgagaaggcatacaccgactgggccgccgccgccgccgctagccgagcagcacacatggcgcaattgtccaagaagccagcggagcgccccgaacaagcactrtaaggggaggccagcaggcgcctccttttaactggccggcggcgggtcacgtggcacaggcagttttccgggcctgagggtcccgcctcatccggcccccgccctacccggagggctcggcccctcctcagccaggaaaaggctggagagtgcgcccgagcgggacgcgtgctcctcctaagccggaaggagcagcaggcatgtctggtctggcccaggcaaccaggcggcagcggtccaggttacccttccaagggctggggccctcgagggctccgttttttctcagaggttcctgag

SEQ ID NO: 19577 - DNA, 601 bp, Human
ccgtctcaaaaaaaaaaaaaaaaaaagaaaagaaaaagaattcccaaatgacaatgacacaggacatacacacagttctgctgacacccggcactttattagtggggaaactcgccttggtctggcagagactgggatcaacaggaccagcacccatctcgaggtggtattttctgtaagatcaggtgttcctccctcgtaggtttagaggaaacaccctcatagatgaaaacccccccgagacagcagcactgcaactgccaagcagccggggtaggaggggcgccctaggcacagctgrgcccttgagacagcagggcttcgatgtcaggctcgatgtcaatggtctggaagcggcggctgtacctgcgtaggggcacaccgtcagggcccaccaggaacttctcaaagttccaggcaacatcgttgcgacacaccggagaccaggtgatgagcttggggtcggtcataagcgcggtggcgtcgtcgctgggagctggcagggcctcccgcaggaaggcgaagagagggtgcgcccccgcaccgttcacctcgcacttctcgaagagcatgaagttgggctcgaacccaccaccaggcc

SEQ ID NO: 19578 - DNA, 601 bp, Human
tcttacttaaataacaaatttcagagatagtttgatttcacctaagtagcacctacttgataattaagctaaaagtcacatttaaagtacatgttggaaaaatggataaagcaaatttttttcatttttttctgtgagttttttcttctctaaaaaatattcccatactagcttattaatataattaagttactgttgatctgtttgtaggtttagagagctagatatataaggtagtaatggtataatttctggaactctaaattttaaagttgaataaatacagacttgcaaaatttcyctttcccttgcctaatagtgaaagatggataataggtggcaatataaatattaacttgaaagactataatactaaaaagaaaaggcatctctaagaagtagaaaagattctatagaaaatatattttatttgtgatcattttgtaatgtggtagtataaaaaggtatcactgttgtaacctatgaagatgtcagctattccttatgaaatattttgcaggaaaactcactaccatgagaattgcagtgatttgcttttgcctcctaggcatcacctgtgccataccagtgagtacagttg

SEQ ID NO: 19579 - DNA, 601 bp, Human
ttgtatgaccataatattcacaatattgtctgagatattagctgagaagcccattgtgaaaagaaagtctatgtgtgctgtttgtatctattgtgattgtcagctgatgttagatcacattttctaaccaaacataagaccaaccaaactctttattataattatttgaccagcactaaagatgtacctacccctccacaacagatgaaactgtgccagccaaacaacaaatgggcattgtccccagaagcttggacaaaaaggcacacagagttcaattccagttgaacagaataaaggycaaaatagagctgccttgggggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggcaaagatgcattttagaaggcacgtggagctataacaatttaagaaatacgtgaagagctcaaggc

SEQ ID NO: 19580 - DNA, 601 bp, Human
ggtcactgcaattagactgcttaatgaagacattaaaagaagtattctgtgttcgtttgtgtgtggaggggtgtgtgtgtctgtttttcaactgatttgaaaatacaggtgttgaatcctaataataaaccagaaaaattaacatctccagagaagatagaggtcatactatttgaggcaagaattagcgtctttttaataaacgaaaatatggcaaagatgcattttagaaggcacgtggagctataacaatttaagaaatacgtgaagagctcaaggctcagccttctagaatcccagtaacttaaagctagtaaaaaattggggaagtctctaaggatatatgcctgaaaatacacactggttatctgtgagtgttaggattactgggtggtttttagtctattcattttgcttacctttattttcttcatattagtttttaaaaattataaatgtaacttatacatccattctctctgagcctgtattacatgtgtcatgagaatagatagatagatatgaaaaagtgaagagaaaaactctgaactcatctggtctcactgtttttccgccttctttttttttttttttttttttt

SEQ ID NO: 19581 - DNA, 601 bp, Human
tcactgcaagctccgcctcccaggttcaccccattctcctgagtagctgggactacaggcgcccgccaccacgcccggataattttttgtatttttagtagagacggggtttcaccgtgttagccaggatggtctccatctcctgacctcgtgatccaccctccttggcctcccaaagtgctgggattacaggcgtgagccactgcgcccggctgttttttcatcttcttaaagcaaggaaccccttctttcagcaaaacctttcggagaagcccaatactaagctcctctggttagagcyagccatgagagaaactccaagtacttctgactggttctctctctactcatccaccccttaggtggctgcagaaggaactctgtgcaacccccagagttctcattctcagtgacagggaaatgtaatgattggccctggatgattcagcagatcagatgatacttactcagagcaatttccactcctttgcagtagcatattatcagtattttccagataaataacttggctaaagaaaaatccatttcatttacatctttggcaccttacagcaatagaacttttgtgcaatgattttaa

SEQ ID NO: 19582 - DNA, 601 bp, Human
attcagcagatcagatgatacttactcagagcaatttccactcctttgcagtagcatattatcagtattttccagataaataacttggctaaagaaaaatccatttcatttacatctttggcaccttacagcaatagaacttttgtgcaatgattttaatattatatttctacattggctgataagatacatatggctattgagcactcaaaatgtgggctagtgcaactgaggaactgaatttttatcttctttttttttttttttttttttgagatggagtcttgctctgtcacccagrctggagtgcagtggcgcaatcttggctcactgcaagctctgcctcctgggttcacgccattctcttgcctcagcctccccagtagctgggggtacaggtgcctgccaccacgcccggctatttttttttatttttattttttttagtagaaacggggtttcactgtgttagccaggatgttctcgatctcctgacctcgtgatccgcctgcctcggcctcccaaagtgctgggattacaggggtgagccaccgtgcctagccatttcattttaattaacttaaatttaaatagctccatg

SEQ ID NO: 19583 - DNA, 601 bp, Human
gaggtaagttctcattttcaatcagaggcccatcatgccttgaagagatgaaagaaggcattgcctggattctcttctgatgaaatttcattagcaagttttccagctaattggcagtctaaaacttgctcataaataaaacatgtatttactaaatatcagaaatactaggtttcctcggataagtttagcattacagaagatgtttattaatgcctgttatttgaaacattaatctgcttgcaatttatttaaggtattttgtagatatctaatatctaataagcatctaattaatgcrtatcaaagctaagattttgcctttaggaaagttttctttcctaataaaatagtttatttgacaactattctttttattaggatcattcatatatttgctaagcaaagagtaaatttattttccttaagattcaatttgaatatactaagaatattaaagcaagttagataaattacccaatatatttgtcaatttgaaatttgatagacattagttgtttaattcaatgggcagttttgagctgcagtttatacacacatgcataacagagtcacctttcaattatccatgttaatagga

SEQ ID NO: 19584 - DNA, 601 bp, Human
aattcaatgggcagttttgagctgcagtttatacacacatgcataacagagtcacctttcaattatccatgttaataggaaagtggttatagattttagtacacacattaaaatatggatactcttctcttttgataaatctcatttcaaataaaaaaaccagtctcataattatgtatctgtatctattacatcattgaatttagtaaataatgtttaatatgtataaggaaaaacaatgttattgacatgaagattatactcacatatttggcttgaaaatatctataaaaataatttytgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgatgaccatgtggaca

SEQ ID NO: 19585 - DNA, 601 bp, Human
ataaaaataatttctgttgcaaagtaagaaatgttcttcagaatgttattaatccctgtgttaaaagagaaattggaagatgctcactttagctcctaaaagccatggtatgtactgtgaatgcaaagattctgaaactaaataaaaagaaagatagtaaaagactaatgtgctataaaggctaagggaaaataaaaacccatatattaattttcccggccatcttaattttcagacccttccaagtaagtccaacgaaagccatgaccacatggatgatatggatgatgaagatgatgaygaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccaggtaaatcctttaacagacacacctgatggttctgactagcgc

SEQ ID NO: 19586 - DNA, 601 bp, Human
gatgacctaaaagctagagagtggaaaaggattaccatattcccatccctagccgttcatataattattcttcatttgtgccgtgattcagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagcyaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggtt

SEQ ID NO: 19587 - DNA, 601 bp, Human
caattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagamgcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaaggtttattttggtttcaattgatacataataagtgtacatatttatggggtacggtgtgatgtt

SEQ ID NO: 19588 - DNA, 601 bp, Human
ccaatctggtgttgtccttcttaagcctccccaaatgtacttgctctgtacctcattgccttggtttcccagattcctagaatgtacaattgcattttaatgaccttagaaagctatgctttacgtattatctttgaactcattcataaacttactggtgacaaattcttagactgtggtaatcagaggtcatctggaatctctggatgtccttaatttgcttgactcctgtgcctaccttgggcctggggctctgtcctcttactcttggcaaggattaaggattaacctccatgctgartcaaagttacctcacactcagttttgttcaagatcaaatcaccaacagagtgagtggctgctgcacacttacagagatgtgaagtcctcctttcccagatgggagaattccttgcagactttattcttttcataatcccggcctaggaggcagaaatagaaaaatttgtatgtgtccccttttgatgaatattatgttacatgtacatgtataaagtgatcttccacgtggcctacaatgaaagtcgtattttctcaatgtctatatgcaatttcatattttgggggcctttctagctct

SEQ ID NO: 19589 - DNA, 601 bp, Human
ggggagaaacctagaattcagttatgtgcatacagggcaacttttgaatcctccttccaaatttgaaaccaacactaaattattctggagcacttggtaccagtcctggcatgatgataaaagaggataaagctatgatcaggtttttaagctatacacaatattttagaattctttcaagaggttcatgagctgatatatatatatatattaaattatataatatataaaatgtatatatacatatatatttaatttcaatagttttgggggaacaaaactattttgtttttggttacayggctaagttctttaggggtgatttctgagattttggtgtacctatcaccggagccgtgtacagtgtacctaatgtatagttttttatccctcacccccttcacccttctctccaagttcccaaagtccattatatccttcttatgcctttaaatcctcatagcttagctcccacttataagtgagaacatacgatatttgggttttcattcctgagttacttcacttagaataatgatccatgggctgatatttgagaagatcaaatgtatggtgataaaaacttaggttttagagtcat

SEQ ID NO: 19590 - DNA, 601 bp, Human
acctcaacttgcttttaaatgagcatagcatgaaatcagttatgtttcttactttcattgcaaagacagccaagttacaataacaccaggaaaagcctgtcacataatggcatctcaataacaggaaagaaatgagtagattggagtgcatacgttcttaaaagattctgccatgttaagtggagggttacattttcctacctctgaatcacagtaaagaggaggtgagtttatggaacagcagttggaggcaaagtctgagcgcttgttaaccagctttgccagttccgtgggtgtggcmtcaggcaattttgcttttagtcgctctgccagtctgaaaaaccatttaaatgtaaggtcttactacatgtatttattttatacaaatttctaatgcaaaataatagccatttcagatcttttacaataaaaatgaaaatagaaatacttgcctgtctcaagaaaattctatacctgtggtatagaatagtcaatttgagatcagaaagtgaaacatgcctcttcgagatcataaaaataaacatacaaatcgctgctgaattggaagtccagtcttctttcatttgctcattatttcaaa

SEQ ID NO: 19591 - DNA, 601 bp, Human
ctggccgggcgcagtggctcacacctgtaatctcagcactttgggaggctgaggcgggtggatcacttgaggtcaggagttccagatcagcctggccaacatggtgaaaccctgtctctaccaaaaatacaaaaattagctgggcgtggtggtgggcacctataataccagctactcgggaggctgaggcaggagaatcacttgatcccaggaggtgaagttttcagtgagccaagatctcaccactgcactccagcctgggtgacagaacgggacttcatctccaaaaaacaaacaaacaaaaaaaacgggtttaagggcttctaattctaattggcatgaaatcatttaacctaagtatcatttggtatggcatagaattgttcctaaccctgcctctatatttcagaaatagagtgggcaagacaacacaattcttggagttattactaatgtctccaaataagcagtaaagtgaaatgaagtgctgtttttatcttttgactcttctaaaaaaatgaaatgcttgctggagagtaacaggtaaaatggaggatgtgaacgtatgggctgacattttctgaaaaaggccagcaaaata

SEQ ID NO: 19592 - DNA, 601 bp, Human
aaataggccatttccatttctactcttaggagtagataaattgactatagaaatttaaatggaggctgaatgcacctctagaaggaattaactgagtgagaaattacactagatgatctttatagttttctttgaacatttatactttcgtgacttgcttttttaaaaattaagttcttgggtatttttaaatgcagtctaatagaaactgggctttattgctttcgtggctgataaatgaacaaaacttcaggtaaattcttaaattatttcacttatagaaaggggcttctggccgggygcagtggctcacacctgtaatctcagcactttgggaggctgaggcgggtggatcacttgaggtcaggagttccagatcagcctggccaacatggtgaaaccctgtctctaccaaaaatacaaaaattagctgggcgtggtggtgggcacctataataccagctactcgggaggctgaggcaggagaatcacttgatcccaggaggtgaagttttcagtgagccaagatctcaccactgcactccagcctgggtgacagaacgggacttcatctccaaaaaacaaacaaacaaaaaaaacg

SEQ ID NO: 19593 - DNA, 601 bp, Human
tttaaagaaaaggcttttattctaccgtactctcttcatctggaattctgactttataaattgttacaaacaagattagcaaataggtttgggaccagagtgtaaatatggaaattagaaaagaaaccagaatccctaaggttataaggaagaaattagaaaaagatgtagctccatttgtcaaactaagacttttttcttaggcactgtacaataaaataaaacaaaacaaaacataacaaaacaaataaaactttactaaaatatggatattaagaaatttggaatgcatagcccaagrctttaaaaaaatactttacacagcttaatttttaaaaagtcacttcaagtataaaagagctgctattgcgaacagagaatagacattttctagttgatagagaaagccagggtgattgcaggagaaattacaaagggaatatcacagcttaatttatagaagaatgttctcataatgcagctacctggcaatgaaataggccatttccatttctactcttaggagtagataaattgactatagaaatttaaatggaggctgaatgcacctctagaaggaattaactgagtgagaaattac

SEQ ID NO: 19594 - DNA, 601 bp, Human
aagaaatgaaaaaccaggggcttttaggaagcatgaatttgcgcttaaagctcagtttgtcttgtatggtgtcaggcaggacagtgcatatctgtatagacagataacaaagggacagggaaaggtttcaaaagtgatatttcttatagaatctaaaagacatttagactgttttcttcttctttcgtaataacagactctcagagaaaatttttctggtagcaaacaacttctatgtaaggtgattttatttttctaggttaaggccacctaaattggaactaaatttagattactaaargcaacttggtatgaaaagaaagaactgttcaatttaattaattattttatgctaaaaatgttttaatgaccaaaatattctgacaatccagcttcttctgtttttatgttgagaatcttaagtagtttgaattttaatgaaagattaagatggcatatttgtcaggagaatttaaagaaaaggcttttattctaccgtactctcttcatctggaattctgactttataaattgttacaaacaagattagcaaataggtttgggaccagagtgtaaatatggaaattagaaaagaaaccag

SEQ ID NO: 19595 - DNA, 601 bp, Human
gggggaattaaaatattaattaacatctagaattgttttgggttattctataaatacatacatgccaggctattaatatttctgcttaacaaatagcaatggcttaatcaatgatagctatgacactgaagattataaaatcaagttatactgagagataaaacaaactacagtgactatactagtttttcctgacacaagaaagacaggtggtggggggtagacagtatatcactctacttgtcagtctcctctttgcccggcttccacttggctatttgtatttgtctctgtgtttttmagattttagtgatcaattccagcatattacaatgacttttggaatactttgggaaatcatatctgatgctcactagcagtctgttgaaacattttaaaggaagcatagtaatgagttctcagaagagcccaaagggatgccctgcctgaatgatggtagaaagagaaaagaagatttcaagtctaattttgtaactataggtttttctgtaggcaaatgggtcttttttggcataaacaaatgaaccacttctaagagtgccatggtaaagccaaaagaaaatgacattgattgttctat

SEQ ID NO: 19596 - DNA, 601 bp, Human
aggctataaaccaggtgaaagattgcctgaaactaaataccaagaatgtagaagaatgtgggtgggagattgagagatgttgcagaattagaattgatgggatttggaattttatttggtgcatatggaaaaagagaaggagaaataaaaagagtcactaaattttcatcgtggggcaatgggtaaatgatgataatattcataaactcaaaaaacataagagcagtttataggaaaaatattttgtccatgttgattttcaatttcttatgggacaagatattgggggagaagagagtcytagacagttggattaaaaatcctaatgctgagggagagatcttggttggaggtagagatttggagattaaaagcctaagcattgatgaaaacagttgagaaaatgtagtgccatggaaatgaagaacaaggaaaaaactctggaaacaaatttaagagacaggtaaaggaagaggacaatatgaaatagaacaagaagagaggaatcatagaaagacaaaaagtagaaaataatactacaggtgctaagtaaattgtttcaagaaggaaggtatacttatgggtatcaactgttttgtgg

SEQ ID NO: 19597 - DNA, 601 bp, Human
ggaatgtgaagcactgtgggcagactggaggtgggaggagaccaatggacaggctataaaccaggtgaaagattgcctgaaactaaataccaagaatgtagaagaatgtgggtgggagattgagagatgttgcagaattagaattgatgggatttggaattttatttggtgcatatggaaaaagagaaggagaaataaaaagagtcactaaattttcatcgtggggcaatgggtaaatgatgataatattcataaactcaaaaaacataagagcagtttataggaaaaatattttgtccaygttgattttcaatttcttatgggacaagatattgggggagaagagagtcctagacagttggattaaaaatcctaatgctgagggagagatcttggttggaggtagagatttggagattaaaagcctaagcattgatgaaaacagttgagaaaatgtagtgccatggaaatgaagaacaaggaaaaaactctggaaacaaatttaagagacaggtaaaggaagaggacaatatgaaatagaacaagaagagaggaatcatagaaagacaaaaagtagaaaataatactacaggtgctaagt

SEQ ID NO: 19598 - DNA, 601 bp, Human
aactgcaagtagttcaggagaacccaagcaggaggcacaacaagtcatgatagcaagtcactacttggagaagaaatcaaggtccaaaatacctctattttgtaaaaaaaaaaaaaaaaaaaaaaactactttaatttggaggcaatgagagctattagagaagagtattaaccatttttgtgttttaaaaaggttgatttgacctcagtatagagatgggattggaatgtgaagcactgtgggcagactggaggtgggaggagaccaatggacaggctataaaccaggtgaaagattgcstgaaactaaataccaagaatgtagaagaatgtgggtgggagattgagagatgttgcagaattagaattgatgggatttggaattttatttggtgcatatggaaaaagagaaggagaaataaaaagagtcactaaattttcatcgtggggcaatgggtaaatgatgataatattcataaactcaaaaaacataagagcagtttataggaaaaatattttgtccatgttgattttcaatttcttatgggacaagatattgggggagaagagagtcctagacagttggattaaaaatcctaat

SEQ ID NO: 19599 - DNA, 601 bp, Human
ttcatctggcattttttaataggtgaaaatatagtgactgaaaaaagcaagtaataatatttcaacagtattgttttcatttgaataagaatgtccctttcctcctaaggtccttgctgtgttatttttaagacttgatgagccctgtctttaaactcagagttcttcctattgaagtgcatcagaatcctttaaatgttctttatggtatcattatgttacatgtgagattatgatggatgaagcacaaggcaggggaccagtaaacctggattctagtcttacatatatcagaaattgsctgctcttgtataagtgtaagctctttaacttttctcggtgcttaatattctcatctgtaaaatgagtttgaacagataagaataaatttattaaagtctccttcccattctttgatatttaaaatacatcctacaatgctggatccgttggtcctgcatttataaaatatacttaccaaagttaataaacatgcttcaggactacaggatattcttcaattcagcatcaatctgataatgaaaaaagaatgttatataacttatgaagtatttcatttgtaggctactagatcatgcag

SEQ ID NO: 19600 - DNA, 601 bp, Human
cagcacttcaggaggccgaggcgggcggatcacgaggtcaggagatagaggccatcctggctaacacagtgaaaccccatctctactaaaaatacaaaaaaaaaaaaaaaaacccaaattagctgggcgtggtggcgggcgcctgtagccccagctcctcgggaggctgaggcaggagaatggcgtgaacccaggaggcggtgcttgcagcgagccgagatcgcgccactgcactccagcctgggagacagagcgagactccatctcaaaaaaaaaaaaaaaaaaaaaagatacttctgamatttgttctgaaaagaaatctcttgaaatccatcaaattattacttcctccttacttaccttaggatatcttctcctattttaattagttttcccaaagcctaaaaacatacaacactaaggaaatgcactctgagttctgaataataacacagtccagtgaaaaacatattcaaaatcaaagttatcatatagctttccaaataaccctgactcttaattaaagcttaagaaatcttgaaggatgagaggtgaggtcactgttgcatattgggattttaactctttggagattattata

SEQ ID NO: 19601 - DNA, 601 bp, Human
taacacaggagaaatgataagaaatttcatttcttcatcttatcagatgaagataatgaccatgaaccagaagaatcagtatattagaatcttcattagcttgtcactgacaaaccaagtttatctcttgattgagttagcatcaaaaatacttctgggccaggcacagtggctcatgcctgtaatcccagcacttcaggaggccgaggcgggcggatcacgaggtcaggagatagaggccatcctggctaacacagtgaaaccccatctctactaaaaatacaaaaaaaaaaaaaaaaamccaaattagctgggcgtggtggcgggcgcctgtagccccagctcctcgggaggctgaggcaggagaatggcgtgaacccaggaggcggtgcttgcagcgagccgagatcgcgccactgcactccagcctgggagacagagcgagactccatctcaaaaaaaaaaaaaaaaaaaaaagatacttctgacatttgttctgaaaagaaatctcttgaaatccatcaaattattacttcctccttacttaccttaggatatcttctcctattttaattagttttcccaaagcctaaaaacatac

SEQ ID NO: 19602 - DNA, 601 bp, Human
tagcttacctaaatgctactaaccttcctccataccattattgtaaagattaaaggtgatgcatctgttaagtaactaatagagtgcttattaaaaggtaggtgttcaataagtattaattccctttctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcggtaagaaraaaaatagatgaaaatatcctatggaatttcccttaaaggtcgtctgaatctcagagtctttgcaataagttacatggttattctccaaagatcttgagatatcacagatgtctgttcacatttggattgttcttattttgaaaataaataggtttttaaaaactctattgaccatcttgataggctcttcttgtcattataaatgtgttatttcacttatcccactcttttgtgttctctaaatgtctttgtactcactaaattgtgtagtcttagagggcagggtgtgggtatcattc

SEQ ID NO: 19603 - DNA, 601 bp, Human
acaattggaaatcacccattgtaacaagaaataggaaagttacaacttaaatgagaaaatatagtcaacagattacaaaattgaagtggatcagatgttggaattctctgacatagatttgaaagcagacattataaaaagtgcttgaaaaagcaattacaaatgcccttgaagcaaatgaaaaactaaatgccttaacaaagaaatagaagatatgaaaggaaccatatagaaattatataactgaaaatataactgaaatataaagcaaactgtaaaggctcattagcagaatgaatgrcagaggaatgatagttaatttgacaacagaatactagagagacagttgacttaagaaaaaaaaagcatcactgatcttgacgacagtaacaaaagattcagcattcctatggttagtatcacaggagagtatgagaatacaccaagtaaaagagagagattggttgaattcataacaaaacaccacccatctatactatctataagcagttcacttctagtacaatgacatacataggttgaaatttaaaaagacagaaaaagatatagcatactataatgggttgaatagtgtcccccc

SEQ ID NO: 19604 - DNA, 601 bp, Human
aatacagcatatcaagatatatgtgatgtggctaaagcaatactgacaggacattttttaaaatcaaatgaatacattagaaaaaaaggagaattatcaaatcaaaaatctaagttactgcttcaagaaactagaagaagtagagcaaaacaaattcaatacaagcagaacaaagaaaatatttaaatataagagccaaaattaatgaagttgaaatcaagaaaacaatagaaaaaattaatgaaacataaaactggttatttggaaaatcaatacaattgatctttaattgacagaaatgagagagaagacacaaatctcaggaatgaaatttggggctgtcactacagaatctgcagtcattagaaggataataagaaaaactatgaacaattttatgctcacaaatctgataacttagaggaaatggaccaattcttcagaaaccacaaactaccaaaacataatgaagatgaaatagacaatccaaacactcatataatcactaaatacattgaattcatcatacacaagctcccaaaaagggaccttcaagcctgctggttacactgaatcattctatcaaatatttacagaagca

SEQ ID NO: 19605 - DNA, 601 bp, Human
cttcagttggtaaaatctgtgatatatcatgtcagggaatactacagagcaataaaaaggaacaaactagtgatacccacaagttaggtggatctccagggtattatgatgagtgaaaaaagccagtcttcataaagaaactgtggtacatttataaaatagaatattatccagtgataaaaagaaataagctatcaagccatgaaaagaaatggagaaaccttcaaagtcatattgttgagtgaaagatggggacgccaatctgaaaaggcttcacactgtatgatcccaactatgacaytttgaaaaaggcaaagctatggagacaataaaaagatcagtggttgctaggggtttggagggaaggagaaatggctaggcagagcacaggctacttttaaagcagtgaaaatattaatatatgatgatgggtggcattatacatttgtcaaaacctgtaaaacatacaacacaaataatgagccctaatattctgtacacttaagatcataatagtgattcaccaactataacaaacacaccacactaatgcaagatattaacaatagggaaactggggtggagaacaaaggggtgtata

SEQ ID NO: 19606 - DNA, 601 bp, Human
aaaatattaatatatgatgatgggtggcattatacatttgtcaaaacctgtaaaacatacaacacaaataatgagccctaatattctgtacacttaagatcataatagtgattcaccaactataacaaacacaccacactaatgcaagatattaacaatagggaaactggggtggagaacaaaggggtgtataagtctctgtactttctgctagtttttctgtaaacctaaatggctcataaaaatgtctatcaattcttttaaaagctaatttcagaaggttacatatgatatgagtccrtttacataatattcttgaaatgacaaaattataggcatggagagcagagaagtggttgccagaatttagagagattgggtgatgatgaggtatgtatggggagaaaggtgactttggttatgaaagaatagcagcagaatccttgtggtgatgaaactattttgtgtcttaactgtggtggtggtgatgtgaatctatgcaaatgataaaattgcataaaacttcacacatatgcaagcacacacactgtggcacataaaacttgtgaaatctgaacaaggtgagtgcattgtattaatg

SEQ ID NO: 19607 - DNA, 601 bp, Human
taaaagagtcttttccatcaatgtcaaacaagatacattatacgtttttgtgatgcagttgcatcatggtgcaattagatgcaaaaatcagattaactgattcaatttaagagtagccaatatatcagttatttccaatgctgtaatgtatcaccatctgcaatcatattttccataaattgcttaaaatcattcatgttctgcattttacatgattctctacatttgtcagaaaaagattctaattattctctatgtgagaaaggaaacataacccatgaaacttattagaactgaaaartggtcttgaacttgtttcattaataccctgacatttcctaaggaatgtaggatttgtcatgttggtggtggttcttcccttcagtattgttactaaaaccaagaaatgaatccccaacttcacgtcagggaaaacaaactctatgtcctctctccattattcctcaattagaacttctcttacatagatgactttctaagcattggaaagaaaccatagtcagaaactagaaaaaagagatattcactaaccaattgggtcatgctgctgcacaaagaaattgtctccctcctctggctt

SEQ ID NO: 19608 - DNA, 601 bp, Human
gcaatcatattttccataaattgcttaaaatcattcatgttctgcattttacatgattctctacatttgtcagaaaaagattctaattattctctatgtgagaaaggaaacataacccatgaaacttattagaactgaaaaatggtcttgaacttgtttcattaataccctgacatttcctaaggaatgtaggatttgtcatgttggtggtggttcttcccttcagtattgttactaaaaccaagaaatgaatccccaacttcacgtcagggaaaacaaactctatgtcctctctccattmttcctcaattagaacttctcttacatagatgactttctaagcattggaaagaaaccatagtcagaaactagaaaaaagagatattcactaaccaattgggtcatgctgctgcacaaagaaattgtctccctcctctggcttcagcatggattctgtttttctttgcattttttgtaaaatggaaagtagtcaattagccaccaaattcagcatcctgaaattgcttttttgcaagaagataactttgcaacccatgggttagagaaacaaccttagattttagattttagattttagaag

SEQ ID NO: 19609 - DNA, 601 bp, Human
tttggaacttgaaagaacagtataattagcagctaccactatttaaaatgttaacaacacaatttgattctaaaaattcttacaaataaactgtctatattgatgttttcagactctaaggccagtattattaccctttccacaggggaaatgtgctcggtgagaaaaactggccactatttctgcattttctagtttcatgttcttctgtacaatattgccatccttcttgattgtgttttgttggtttgttttggtttttattttaaagccaaaagaaaaaaaattaagctgcctcctrtgtaaaatttcttaaggatattgtgtatctttataaaatatttggattgactttttgaaaatcaaaattacatcagtatgaaaattaataatcagaaaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgcttagagttgca

SEQ ID NO: 19610 - DNA, 601 bp, Human
ctgcctcctatgtaaaatttcttaaggatattgtgtatctttataaaatatttggattgactttttgaaaatcaaaattacatcagtatgaaaattaataatcagaaaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgctyagagttgcatcttatgttttgggcctgatttggagaagtcattcatggacaagcagatcctcctaaggggcaatcaggagaaggagtcctgttccagtggagtggtgtgcaaaagtggcaccatctccagcatgcacacaatgctaaactgttcaatgattgattcagtagacaaacatttacagaataatgccaggtagtgtgcttcagtgctagaattatagttgcaaaccagacagacaggtcactgacctcaaggtgtttattgtcaggtgcagtggatagacattaatctaatta

SEQ ID NO: 19611 - DNA, 601 bp, Human
aaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgcttagagttgcatcttatgttttgggcctgatttggagaagtcattcatggacaagcagatcctcctaaggggcaatcaggagaaggagtcctgttccagtggagtggygtgcaaaagtggcaccatctccagcatgcacacaatgctaaactgttcaatgattgattcagtagacaaacatttacagaataatgccaggtagtgtgcttcagtgctagaattatagttgcaaaccagacagacaggtcactgacctcaaggtgtttattgtcaggtgcagtggatagacattaatctaattacatactcaaatgtctaacatcaataatagtaactcacatttattgagttattactgtatgccagacactattctttgagctttaaattgataattcatttaatcct

SEQ ID NO: 19612 - DNA, 601 bp, Human
aggtttataatactcttatgatgttatctccatcttattggtggaaagagtgagccacgcaacaggtaactcatggcaaaataaatgatgagctctttaatgtgaatgttgatagtcatcctcatcatgacagagtgtgacatacgtgctggaatgcgtgggcaggactgcacagtcagaagacctggatgggaagaatttcagttgattatgtcagttgagatgagtcaatatctctgtcttcctatctgacatgattattttcaggatcaaataggacagcattatatgaaatatgacmgtgcttggcatagaggatgtgcttgataaatgtcgctgattctgaattccaaatagttaatggatataaaatctaatttttatttttgctggcacagccttcatggttcagatgatctctaaaaagtttattcttaattgctacatttggaacattctagttatccatgagactgtgtttgaagtacaacaatttgtggtattcacctaaatggctcagttcaaccaatgggtgattacagtgtgtcaggccctgtgctaaatgctagggaaacaaacatactggctctgaccttctggc

SEQ ID NO: 19613 - DNA, 601 bp, Human
aagcctccctaaaagagtacctgaataatcttaagtgcgagtagcagcagctaaaataggaatgaatgtaacagagagaaaagcaaaggcagagaggcatctaatagtatgctgtgcatggcaaggaaagccagatgctcactcagtgtttctagggcataacattgaggcaagggggatatgtgaaataaataggtaaggaacagctcatgaagagcctgtgtgctatgcagggaggcatggtctttatgctagaagcagatgataggaaaccattgaagggctcaaagcaggaactccrtggtctgatagacacagcttatttttctcaatgtccttaacccattattggaaaaataaacatatatcaaatctccctgttctctttcctcgtagttcttcctaatatgctatttatttgctaaagctttcatatctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaag

SEQ ID NO: 19614 - DNA, 601 bp, Human
aaataggaatgaatgtaacagagagaaaagcaaaggcagagaggcatctaatagtatgctgtgcatggcaaggaaagccagatgctcactcagtgtttctagggcataacattgaggcaagggggatatgtgaaataaataggtaaggaacagctcatgaagagcctgtgtgctatgcagggaggcatggtctttatgctagaagcagatgataggaaaccattgaagggctcaaagcaggaactccgtggtctgatagacacagcttatttttctcaatgtccttaacccattattggamaaataaacatatatcaaatctccctgttctctttcctcgtagttcttcctaatatgctatttatttgctaaagctttcatatctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaagaatttttgcagagttttgtacatattgtccaaatgttcatcaacacttcttga

SEQ ID NO: 19615 - DNA, 601 bp, Human
ctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttmaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggc

SEQ ID NO: 19616 - DNA, 601 bp, Human
gaatgcagctggtatttcagcagcagctaaaaacatggacggtactccaagggacaggggctgtgctgtctgcctggttcctgcccagaaggcactctatcctcttctcatctaatggatggaccgcgatgggtgcgatgtcttaccctagccagggcaagaagctcagattcttcagattctcccaggccttgcatgagaaagaataaagcactgcaccttggagaagtgcctcctcctcaccctaaccaggagtttgaattaggaatcagaactttcctgccacccatccttcctgccrtagtgggcagtggccctctggaagccctccttccactcacaacctcagatcctctacctgcccagagggcagcattcaaaccaacagtcactctaatcagctagacagacaacagggtggtggggaggaagggaggaggcagggagggggaggtatagcgcatagatcattcatgacagatgaaagataaggagttgtcattttatttacattgtttcacaactctagagttatcagtaaatgagttagaaagcaatatgatatgagctacagcaattattatatccttagttccagttt

SEQ ID NO: 19617 - DNA, 601 bp, Human
ttgcattatttttagacaggtcccttgccaatgtaggaagtgatctcccgtatttaaaggggatgccatttttccacagtgacatcccctggaggagacttcctgtatgttacatccaggaaacatgagggctctgggccctgaaatagtcggctctgaatgttcttttcaacgggtgcttcccggcttcaaggcttgtaagtctgaaagtgcagagtgaggaaaagccttttcacaccagctaatgggatgtgacaattgaatgcagctggtatttcagcagcagctaaaaacatggackgtactccaagggacaggggctgtgctgtctgcctggttcctgcccagaaggcactctatcctcttctcatctaatggatggaccgcgatgggtgcgatgtcttaccctagccagggcaagaagctcagattcttcagattctcccaggccttgcatgagaaagaataaagcactgcaccttggagaagtgcctcctcctcaccctaaccaggagtttgaattaggaatcagaactttcctgccacccatccttcctgccgtagtgggcagtggccctctggaagccctccttccactcac

SEQ ID NO: 19618 - DNA, 601 bp, Human
cagtctgctgtcagggactagggtatatgctgaagaaaagaatgtgtggatgggcattcaggatgagtagcaagcttccaccttgacctgggtgcattgccctttaaatacctccttaatgcaggccaggcatggtggctcacacctgtcatcccagcactttgggaggtcaaggcgggcaaatcacttgagttcaggagttggagagcaacctggccaacatggtgaaaccccatctctattaaaaatacaaaaattagccaggcatggtggcacgcacctgtaatgccagctactcggraggctgaggcaggataatcacttgaacccgggaggcagaggctgcagtgagctcagatggcaccactgcactccagcctgggcaacagagcaagactctgtctccaaaacaaaacaaaacctccttaaccaacaggaaaaaaaaatccctgttaacaacatccattcagttagtacattgaatctctaggataatttagtattatgtgagctacatccctgattctctagattgtagcttctaattacactcagaaaggattctttcattattccatagtagagagaagtaaatggcctc

SEQ ID NO: 19619 - DNA, 601 bp, Human
tctttgttctgagcagcaagaaatgaataattgccaagagaccagctcatgttgttttttccacatatgtatttatttcaaaataaagacatacaatgttaaacaaataatcacaactgatactgatttagagtagcttacttgatttttaaattgtagcaacttaaagagaaagctttttaaatttaataaataggataaataatatttcatcttcatatcttgcctctcatccctctcatcttttctttctggaaaatttccagaagactcttcagaaatgtcagcgcgttgcctgccrtggtttggttgcatggctgttcacaggaaaaatactgtggggatgaaagttgataaggacagagtgactcaaatgatgtagagccaagcagccccagaagcctacctgccaagagccagagtcggtggtgaggattgtggggatgggaagggaagtggcttgagacacagagcaaataggtgggcaggtccaggctagctcatgtggtgtaaagacagcataggtggttgacctcaaattggatttcaggggtctttacacacacacacacacacacacacacacacacacacacacaca

SEQ ID NO: 19620 - DNA, 601 bp, Human
tcacatgcctcaatctaccttctgcagagagaaatcatcggttgttccttcttctcttcataccatttaccataactgataattaagtatgattaccatttttagtttttttcatacaaaaatcaaatacacaagagagcagaattgtatttgttaggttcaccttgttatcttgagtacaacatacaacctggtttacagaaagtttatttttacttatatcttgaatataatattgatggataaatgaagtgtaccagttattctgtaatcaggttgcacaattaggcttggaatttcrttttaaagaataaacaagtacaaaagtttccatagcaaaagttcaatgaacaacacaaaataaatttaccaaatacaaagaacatattttattacattaaccactgtgcaaaggtgcacatgacataatatgaacaaaaataagttgttttataaatagttaaataaataatattttaaaaatatttaaatagataatggatcagtcagcatggtcctctgtaagggactagtgccttaagagctgaatacaatgttgattaatactcctaaaaacatttgaaaagatttaaatcgtgtc

SEQ ID NO: 19621 - DNA, 601 bp, Human
acagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcytgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcag

SEQ ID NO: 19622 - DNA, 601 bp, Human
ttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaaytgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaagcagccttcacagttacacctgatctaactccagaaaggcacctctggggccagcttccagcagctgcactgggaccctgcaggggaagtcagcactgcactgtaaccagatcacctgggaaagccacccccagggccggggcctgcagc

SEQ ID NO: 19623 - DNA, 601 bp, Human
gacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccraaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagac

SEQ ID NO: 19624 - DNA, 601 bp, Human
ccaggccagtaaaccagcatgatcagtgctgtaaagcaggtccaagctagctaaattgagcatctttaaaatactcttcacaagagataaagtatcatgttgtaggcaaagtactgaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatwtttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaat

SEQ ID NO: 19625 - DNA, 601 bp, Human
aaggcctgatttcatctctctggatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccrgtaaaccagcatgatcagtgctgtaaagcaggtccaagctagctaaattgagcatctttaaaatactcttcacaagagataaagtatcatgttgtaggcaaagtactgaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagca

SEQ ID NO: 19626 - DNA, 601 bp, Human
gtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctggatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagrtgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaagctagctaaattgagcatctttaaaatactcttcacaagagataaagtatcatgttgtaggcaaagtactgaaaaaacattcattttctagggccctaaaacatactgtaaataacaaacacattcaaggcagtaaa

SEQ ID NO: 19627 - DNA, 601 bp, Human
cacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggarggcctgatttcatctctctggatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccag

SEQ ID NO: 19628 - DNA, 601 bp, Human
gccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacrggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtct

SEQ ID NO: 19629 - DNA, 601 bp, Human
gggcagcaaagcactgctcccccacggaagtctgagcccctgcccagtctgcatgggggtctgtcctggaggaggatcgagcaaatttacaaagcgccgagagcaagtgaactgtggtccatctcgaggtggcagataactagtttttccttttctgggcagcctttctcttcttctgtcgcttcttttttcctatcttttcttttttccccactttttcttctctgcgcccccttagataaaattagtagaaccattaataatgtggaaataaacaaaagttcgtctcagtctgcataaratttaacactggcccgtgtactggttaaactgtgccttcagtctcaggcctggaggcccctggtcaaagcactgtttatcagtaattcattaaaataaattggacatttccttccattcaaacaaatgttcaatgggctcctagaacacctttgtgaatgggttacagcgactgccaatctgccaacctgaacctgattcccactggggacaaggaatccacatctcagggtacacccagggccaggctggccatcgtggtccttgtcaccccaccctgccctgctctcatgggactttt

SEQ ID NO: 19630 - DNA, 601 bp, Human
accccacacagtttgcagaaacccacccgggcttggggataaagccactcccacaacccaggaaggaggggctgaagaagccccttcccaggtggcagagtgctggagggaaaggcaatgggtatttggaaaaagccagggcccattcctaagggtcagtcagttttcacctttcctgagggccacagaggggtggcacacccccttcctggcgaggccacctctgctgggctagcaggttgccctgcacactggccaggtggccacagcctggtctccacaggaatgcagactgcaagtrtgtggagctggtgagctccccagtgagcgcaggccttctaagagaggaagtggagggcaggctggggggctcagcaacctgggcattcctggagctcccaggctattctggacagagtcctgagcacacaggctccgcgtcacagacccccgccccagtctctgcacaactactttcttcataacttagcagaccaacaagggccttaaaaagcacataaatacagaagccggtgtggctggcagggcagcaaagcactgctcccccacggaagtctgagcccctgcccagtctgcatgg

SEQ ID NO: 19631 - DNA, 601 bp, Human
cgggaggggacaggctgggatccccagggattcaggacccttgcaaagttccatagcacatctgtcctccacgtgggggacccgtttaaagactctaaagagaattgcccaaagaggagctccctgagaagtgtttccacatctgctctctgagaatgcagcattccctcgggctcaccccacacagtttgcagaaacccacccgggcttggggataaagccactcccacaacccaggaaggaggggctgaagaagccccttcccaggtggcagagtgctggagggaaaggcaatgggtatttggaaaaagccagggcccattcctaagggtcagtcagttttcacctttcctgagggccacagaggggtggcacacccccttcctggcgaggccacctctgctgggctagcaggttgccctgcacactggccaggtggccacagcctggtctccacaggaatgcagactgcaagtgtgtggagctggtgagctccccagtgagcgcaggccttctaagagaggaagtggagggcaggctggggggctcagcaacctgggcattcctggagctcccaggctattctggacagagtcctgag

SEQ ID NO: 19632 - DNA, 601 bp, Human
tcctcaggcgtctgaccctctcacatcttgaacctcctgttgacaagaacagagggaaacaccattaaggcaggttccccccacacccagccagctccagcaggacagcggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacacgtggcaagcactgggcgtggcagacgcacraaggcacagagaggcccatcagagtggtcatacgacggggacagggcacactgcttacccggcaccggcgtggggctgaggctcaggatgctgctgccctgcatcctggcctcggctgtcccaagaggcactttcgtggcttccagtaacccttcgccctcggggcctctcagccaggggccatgccaccgtaggtggccccaggtgggactgctggaggtggcacaggggtgggtgcacaggtggccaggacctcccaggaggaacgcatgctggacagagcagtgaccatagcgcacc

SEQ ID NO: 19633 - DNA, 601 bp, Human
gtttcagagctgggctcctactgtaagggttcctcaggcgtctgaccctctcacatcttgaacctcctgttgacaagaacagagggaaacaccattaaggcaggttccccccacacccagccagctccagcaggacagcggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacaygtggcaagcactgggcgtggcagacgcacgaaggcacagagaggcccatcagagtggtcatacgacggggacagggcacactgcttacccggcaccggcgtggggctgaggctcaggatgctgctgccctgcatcctggcctcggctgtcccaagaggcactttcgtggcttccagtaacccttcgccctcggggcctctcagccaggggccatgccaccgtaggtggccccaggtgggactgctggaggtggcacaggggtgggtgcacaggtggccaggacctcccaggaggaacgca

SEQ ID NO: 19634 - DNA, 601 bp, Human
cagtgacactgaataatcaaactaaatgaaaaataaatgtcatgtattttgctacataatcaaatggtgaaaatatggcaaagtgtgcaaaacaaagcccttggcaatgcctggggccctgccctggcaggggaggctgtggcaggcccttccctaacactggtttcagagctgggctcctactgtaagggttcctcaggcgtctgaccctctcacatcttgaacctcctgttgacaagaacagagggaaacaccattaaggcaggttccccccacacccagccagctccagcaggacagyggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacacgtggcaagcactgggcgtggcagacgcacgaaggcacagagaggcccatcagagtggtcatacgacggggacagggcacactgcttacccggcaccggcgtggggctgaggctcaggatgctgctgccctgcatcctg

SEQ ID NO: 19635 - DNA, 601 bp, Human
cgtgtcgccagtgacactgaataatcaaactaaatgaaaaataaatgtcatgtattttgctacataatcaaatggtgaaaatatggcaaagtgtgcaaaacaaagcccttggcaatgcctggggccctgccctggcaggggaggctgtggcaggcccttccctaacactggtttcagagctgggctcctactgtaagggttcctcaggcgtctgaccctctcacatcttgaacctcctgttgacaagaacagagggaaacaccattaaggcaggttccccccacacccagccagctccagmaggacagcggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacacgtggcaagcactgggcgtggcagacgcacgaaggcacagagaggcccatcagagtggtcatacgacggggacagggcacactgcttacccggcaccggcgtggggctgaggctcaggatgctgctgccct

SEQ ID NO: 19636 - DNA, 601 bp, Human
tggacaatggacaatattccaaacaagacacagatgtgcacagtgttttcaggtaacacaagacattttcatttcctgcttggtgcacagtttacatgaaagctttggtcctgagagtccttttgcggggccatggagacagtcgtggacacacatgatgatggatgagacagagaatgatgagcagaacgtggaggatgtggaggtgctcgggatgagggctgggtctcactctgccctggcctcacactgctgcctcagctcagggtagccctgctgccctcccagaagaggcagaccyggctcccatgtggatggagaagggggtgagcctcccatgtggccctccaccatcccatcccacagagagaagccttcactaggctttgcccaggttgactggtcctggcacccccaggcgtccctcttggtggctctccaccctagggctgaccatggggccaggctccctcagcccagtctccccacctgcacagctcagagaatacaaaacccaggagccctgagtcagaggagtggctccgtggaaagacactctaataaggcaagtacaataatggccttagtctaagctgctacg

SEQ ID NO: 19637 - DNA, 601 bp, Human
acaggtgacacgcagagcagagagggcccaggaggaaggcaggagatgatggcattgccaaatggtgaagaagatgaggttagatgtgaattgggaaagaatcttcatgtccaggattggttattttgtggactgggttttaaaaaccaaaaacaagttgtgaatgcttgttttcctcaagcagtgctgggcttggccctagtttgaaggtactgacatgtgagggagcactgatggggcagcaatcctctggggtcaaccctggtgcacaccgaattcccttgggctctgcccatggacscaccatgtttttgtgatcagtgggggaaccaaggtagttcaccccaaaggaccacggctctgatcaggactgcactcaaagggcccaaggagcatctcctcgctcagcggctgcacagggggaacagtgcatgcatcaagacattggtcacagaggaggacgctggctttgaacaaaaacataggattggacaatggacaatattccaaacaagacacagatgtgcacagtgttttcaggtaacacaagacattttcatttcctgcttggtgcacagtttacatgaaagctttggtcctg

SEQ ID NO: 19638 - DNA, 601 bp, Human
tctgcaacctgtatgacaactggagtttaaagtcagctaaagacacctttgtgaatcatagagcgggaacccagaggaagccattaggggtcctctcggctggaatcctcttgtctaacctgcttccacagagctctcctggctttgaagaagctgcagtatcattgtcagaaccacaagaaaacataaaccaaataacagtgtttgaaataaatatgtggctgttagagtcttggccctgcagacttggatcaaagcagacttttcaaactactctctcttactctctcttaaaaaaaattttttttggtttctcttctatgtttctctggtttgaaaaagtaaataaaaaggcatgaaagttattaagctatattatattaagatatattatttttgggagccctgagagggctcctaccagttattctagagctgcatagagccttcctcaaactatggctccaagcaagataatcacaacaagcaaggactttattttttgaatttccaatggccttgcggtaagcggtgcacaagaagagcaagccacggtggcaatcacagtgaattgttgtggttcgatttgttttcactagaa

SEQ ID NO: 19639 - DNA, 601 bp, Human
tggggaaaccagtttgtctgttcagatgagaaattagtcatgcgagctacaattgccacataggtaggagttctgtgtgcttggaaacttcagactcacagacatttccatgggtcgtgcagggtgatgcactccatgctgttgcccctggcaggaaagatgaaaagcatcaatgtgcattttagccagaattgcattttgaaaaacctgctggatttagcttcctcctctctgccctcctgctgcaccacagcttcccttgcacatggcattttctcagcccacatctcattttttgagrcattttatattcaaaaaaaattgtgtttttagcacaattaaaaaataagcaagtttttagccaccaggatgctgctagaagaggctgggctgtgtatgttgtatctgtatgtcgtatccagctgtaacacactcccagagataccttggtggggagagaggggctatgcatttctctggctgtgctacttctggaaagttcctgagctacatgagccgttgctatctgcttacttaattgctatgactcccattgtaatgatggttaatttattcccactggcaatagaattatgcctgc

SEQ ID NO: 19640 - DNA, 601 bp, Human
caaattttaactgaaactaattattcctttcatgatttttttttaaagctctttataggtctctaaataaaatcactttgtttctatcagtcttgttgatctctttccctctctatgctgttatttttggatttcaaataactcggttgttgaaacctccgatatccctaggggtgaactgaatgaagtgttgcacggcattaaatgtcattgaatgggatattatgaaattcccatcttagccatttaggtcaatatcctgttgtttttctcttacaggtatgggttcatagaagggcaygtggtgattccccggatccaccccaactccatctgtgcagcaaacaacacaggggtgtacatcctcacatccaacacctcccagtatgacacatattgcttcaatgcttcaggttggttctcaggggggtgtctgttggcgtgaaaggctgtgggagcctggtctttggagctcagcttaagtggggattcatgtagcctccatttacataacaaatgctcactgaatatctgtacagcagagccaacattcctgtctccatggagcttacatgctaaattggggaggcaaacaataaac

SEQ ID NO: 19641 - DNA, 601 bp, Human
ggggaggcaaacaataaacaaataaatattaaataccattcaggactgtccaatcttttggcttccctaggtcacattgggagaagaattgtcttgggccccacataaattacactaaaactaagagtagctgataagctaaaacacaaacaaaaatcacacaaaaaaaatctcataatgttttaagaaagtttacgggtttgtgttggaccacattcaaagtcatcctggaccacacaaggcctgtgagccgcaggttggacaagcttgccctatatgaagtctgaaagtgataaaagtkctataaaaaagaaagcaaaatacgaggctaatgagtgctagggatgcttttattttctgagaaggtggtcagggaaagtgcctcctggactgttctgagaatatcagtgctcagaagggagaatgccaaggaataaagtcagagagctaagcaagggccagctaacggggtgattcattctcagtgtgatgggaagtcattacaggttttgaataagggagtgacatgaatctaatgatagctttggggtgtaagtcaaatgtcttagctgagaggtatttattatatgagagggctgga

SEQ ID NO: 19642 - DNA, 601 bp, Human
tttcttctctttggagggttagttcagttgaaaagcttgagaagtacagggggtatgttccttactaaaatggatgaattaaataataaagctagaagtaatatttttccttttgtctattttccaaattgactcgatattgatggctacttttgtaagtttttatttaagtttaaagggaatatttattgatcacctctatgtgctcagtactgcactaggcagagatggagtaagaaagaactggaggctacatttcttgtcttaaaggagttaacaatcttgttgaagcaatgagacaaaaaaaaaaaaagaaagaaactggagaagaggataaatgtgtttaaggataaataaattctgaatgtcttggattagagtcagatgataggggtattaagtgagctaaagattttgataaactgccctatgcaaagatttcattgcaaggatccctgaatctaatttagcctgaaagctgctagcaggtggtcatgtcccagtgctgtgatcccccccataaaacggctacagggataaaagtcagcttgatcttagtagatagcttccataagcttaagttttagcagtatttttagaa

SEQ ID NO: 19643 - DNA, 601 bp, Human
agtttcatttgagcaagctaaatatgtggccaaaaagaacctttagtcccatcaatgcaatacagcagaaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctgrtttcctagccagaagtgggtgtttgcacaagtggacaaaacttgccccttaaaaaagaaaatcaaaatcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgagg

SEQ ID NO: 19644 - DNA, 601 bp, Human
aaaataatttcatctaaatgcacacctgcatagtgagtggcccagacttgagagcagcaaatacttctagggaggaataatgaatgaatgcattcaggctttttcttctccaattcattctagtcatttgttgaaaccacagatgttgatcttcatgtatatctgtgcttgttaatttccaggttgaatttcacagagaacggcaaatgctcttctgtatttagacctgctggtttcctagccagaagtgggtgtttgcacaagtggacaaaacttgccccttaaaaaagaaaatcaaaakcttcatcattttgcagatgtatcttccctgctgaggctattagtctgctacttcaaatccttttcggaggaatatatggaattaatagcaacacattttatatgtacttcagaagggagagtagggaaacaagtgggagaatgattatttattgagcatccactgtattttgaatactgtgctgagcactttacttacaatgtatcacataatccccattttacaaatgaggaaactgaagctcagagttgccttgtccagagctctatgaagctaggattcaaacacagggatgggact

SEQ ID NO: 19645 - DNA, 601 bp, Human
gagcctaatgatgactaccaacgaagtatgagtcagtgtctccagagaagtggttctcaaaccttcttagcatacatcacaattgcagggagggcttattaaaccacaatgctggaccccacccttaaggttcctgattcagtaggtctggggtggagcccaagcatttgcatttctaatcagttccctggtaatactgacactgctgggacagggattgcactttgagagctactgctctggaggaaagccttgcatctgaaagcctcaggaagaattcaagcagtgtcccaatttaacmttgcactacaccagagtgattaagagcttgagctttgtagcaaaaatggcctgagttcgattccagccctccgcatattaactgagcaagatgctttaaagggtctgagacaacatttctcaactaataaacttggaataataacaattgtcacaggacattgtttcaaagactaaatgatagaatacatgtaaagcatttagcataatcctggcacatgatatcatcactggtatttgttgggaatttactgtgtgccagcagcatctttctaaacactttacatgtattaggttgggc

SEQ ID NO: 19646 - DNA, 601 bp, Human
cttacgagtgtgaaaagggagacttggagaaggtagattgacccagcacacatggctagttagcaagggacagcggtgagacttaaatccagggttgtccagctctagacaccaaagtcctgaacactgtgcaacactgctgctgagaattctcatgttccttgacacaaaataacattactaagccttagccttaatcaaatgaggtgggggggaaatcttttgtgtaatgctttataaacatctgcagcttgaatccataaatggcttctcagtgattcagaatgtggagagctgcccwttatgcagctccacaaggaactcatggttacacatttcaaactttggttgagagatgttgtttttccccttaggacactcacatgggagtcaagaaggtggagcaaacacaacctctggtcctataaggacaccccaaattccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgaga

SEQ ID NO: 19647 - DNA, 601 bp, Human
ttccaggtgagtttcaaactttgaggcagaaaaacacactgaaagcagctttctcagaatgtcccagcaaggacgaagagactcatttgaaagcacattctccacaatgcccaacatatgaatccaattgctcctctttacaagttaaaggatgaatgagaatactacaccctcttggtaggaaaagatggaatagtcttttcttcctgggttctgcaaactagctgagctcatactcagatctgtccctggcctgtcccagagaagtgccatgttagttactaaagcttccttcctaaaygaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgaggaggctgggacacctggttctcctgagcatcaagacaaggcatt

SEQ ID NO: 19648 - DNA, 601 bp, Human
tcccagagaagtgccatgttagttactaaagcttccttcctaaatgaatgatcaccaagaggaccccatgtcatacctaggtcctttctatcccaatccaatttccacttatttctggggtccaaggtgaagcatgtaattttccttttacgattacagacagggaggagctacaagaggcatttatgttagatggagtgaaaactttcttttggttccccaactaatttttttttggtcgagggaccgcctgctgatgtggacagaataaacttttcagaaagtatgcatgtgcagtgargaggctgggacacctggttctcctgagcatcaagacaaggcatttgttgcaaattctttatttgacttggaattaaaattgatttgtcatagagaattactaaagggaagggttctcctaaggttgtaaattacccttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaag

SEQ ID NO: 19649 - DNA, 601 bp, Human
cttttaattctctcctcttcagaggtctccagactgagcctctcttggggaaagagaagaatgtggcatgcaccgttctcctttgccccagcttgcctaagcacacctgaagacagaccagacagagacaggggtgggctgtcccaagggagagcacaggggaagccttagctgtcatcaggcagcaagattcttcccagctccagtgacagtgcaggtgggatatctcagggctggaaaccagggccacagtgggcaggagtagaaaggaagaacagaaatcgggccctcctgtcagtcycccccacttctgactctacctccctctccaaactcatctaaaccaggaaaaggtgaggcaaaggtagtgctgagcaggaaatcagagataaaccaaaatttccaagaagaaaacagataatgagactttccatgcctcttctttctcaagccctggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaa

SEQ ID NO: 19650 - DNA, 601 bp, Human
tggttcattgcacacatatacaacccactttgcaactgaatttagtggagttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcrcgacctcggcccactgcaacctctgcttcctgagttcaagcgattctcctgcctcagcctcctgagtagctgagattacagcatgccaccatgcccagctaatttttgtagttttagagatgggatttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacatggtgtttagcaaaca

SEQ ID NO: 19651 - DNA, 601 bp, Human
agttgtcaagtcatattttagtcctaaaagagcctgatttcaaaatgtgtagaatattaatccacaagtgatatataattattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcgcgacctcggcccactgcaacctctgcttcctgagttcaagcgattctyctgcctcagcctcctgagtagctgagattacagcatgccaccatgcccagctaatttttgtagttttagagatgggatttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacatggtgtttagcaaacattgcctactggttaaccatggcttccatgtcattgaatatttcctcct

SEQ ID NO: 19652 - DNA, 601 bp, Human
attattgaaaacatttgaaaaaatacaactaaataaaataatggaaatataaatcaattattatcaatctcaccatccagaaataccatggttaccattttaatatacgtctttttttttttttttttttttgagatggagttttgctttgttgcccaggctggagtgcagtggcgcgacctcggcccactgcaacctctgcttcctgagttcaagcgattctcctgcctcagcctcctgagtagctgagattacagcatgccaccatgcccagctaatttttgtagttttagagatgggrtttcaccatgttggtcaggctggtctcaaactcctgacctcgtgattcacccacttcagcctcctaaagtgctgggattacaggcgtgagccaccgcacccggcctttcctgtcattttaaaatgtaaaatatataccaaaatgtgattacaccttacatggtgtttagcaaacattgcctactggttaaccatggcttccatgtcattgaatatttcctcctcatattgtagtgcgtaatgcaatagatgtaccctaatttatttaaccaatcctttattgcctccatttttgtttttt

SEQ ID NO: 19653 - DNA, 601 bp, Human
ttcctgtcattttaaaatgtaaaatatataccaaaatgtgattacaccttacatggtgtttagcaaacattgcctactggttaaccatggcttccatgtcattgaatatttcctcctcatattgtagtgcgtaatgcaatagatgtaccctaatttatttaaccaatcctttattgcctccatttttgttttttaatacaatgtaaggtggataggtggatgctcttatacaggaaaaaaatgttcctttcaaaagaagcctacatttccttttatatgtttaataatattataccaaagrcatctacaagattcaacaagtcatcctgtccttttttagaaacatagttctcctgaagggacttgaaaatcctgactgatgataaaagattaaagcaagaaggctgttggacaaataccttcagcaaattgctcttccagaattacctgcctattggctggacctattggccagacccccctgcagcgctgactgtggtgcttgtttcaactaggtcaattataaagtgcatttttgtttttacaaagtgtgtctctgaagctcacgcatgtcatttaatttactcataccagaatggct

SEQ ID NO: 19654 - DNA, 601 bp, Human
acactttaaagatacattatttttctccaggacgtaattcataggaatattaagccttttgtaaatgtccctttagatggtttctcataaggtaaaagaaacttatttccaagcaggaccacctttattgtgtccccagatcacctcacagggcagaaaaatgcccctcagtctgggagaagatctagagagaattatggactccttactggtttttggaaagcaaccaacagctaattccaacaccatgggcagcccatacagtctctaattatctgagaaaatcaaatgatgctgttayaataattacgctggtacaagttaataaaagtgccatgttacagtcaaacagctatgttgctatctataccattgagggcatagttttaaaaagtagttatgctacctgattgtataaggaacaaaactgagagaaaaaatctaaaaggccgcctatgattgaatggaaagattttttttagttgaatttaaataatgtgacttgggggagcctttacaaagagtctttatacctcccttcagcttcctcattttcccttggattacttttgctcaattaaatatgaatttcctattgtgt

SEQ ID NO: 19655 - DNA, 601 bp, Human
ggcagagcccaggctttggtcataaaggcctggatttgaatattggctctgtcattcttactttctgtgtgacctcgagcaagttattaaacctcttttggcctcagtttccattgctgtattatgggaacaatagctgctttgaaagagtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatrtgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacgagaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaa

SEQ ID NO: 19656 - DNA, 601 bp, Human
agtgttgtaagaattacagaaaattacatgtaaaatgtctggtattcaggaggtaatctgcttccctgaatccccatcttgcttgtagttgtgaagctatgcaactttccttcctctaagcatagtctgactcgtatatgtgtagtagtgatatgttacaggaaagaggaagcattgcattaggctgggtggggtgaagcaatggacagtaaccagggaaaagatcaaggtcgtactcttccatagcaactttcttttgcgtttgggtcttaagtaatgtttgagaaaccttaaattaacragaataatttgtcttatgttattaaacttcctatatcagggttgtatgagttagccaatgttaggaaaacatcactatggccttatacctctagaaaaatgttgttttattcttctcgatacattcagtaataatgctgacaaggccgacaaagtgttgactgggagaggaagttatgggactttctggaatatacaaatcagaatgatttacaatcatcatgttgatggtttatctaaatctgcagaaactgctaaaatgcttaaaagaggcaaacatttccattgtgaagtaagatag

SEQ ID NO: 19657 - DNA, 601 bp, Human
tgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgytttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctg

SEQ ID NO: 19658 - DNA, 601 bp, Human
gtgcctgtaatcccaggtgctcgtgatgctgaggcaggagaatccattgaaccggggaggcggaggttgcagtgagccgacacagtgccactgaacactaactagcctgggcaactagagcaaaactccgcctcaaaaaaaaaaccaaacaaacaaacaaaaaaaaaacattctgttttcaggatgggcgcggtagctcatgcttgtaatcccagcactttgggaggctgagacgggcggatcacttgaggtcaggcatttgcgaacagcctggccaacatggcgaaaccctgtctctacyaaaaatacaaaaattagccgggcattgtggcgtgtgcctttagtcacagctactcgggaggctgaagcaggagcatcacttgaacccatgaggcggaggttgcagtgagccgagattgtgccactgcactccaacctgggtgacagagactccacctcaaaaaaaaaaaaaaaatccattttcatttacagcctaagtcaccagatggtgacttttgaatggagttgttagaatagatgatgacagatgatgacaagaggaaaaatatgataaatttctgttaccaacataaacctaatt

SEQ ID NO: 19659 - DNA, 601 bp, Human
aatcgaccgtggacattatacctccatcagacttctcaaaaaatgtgcaagttacaaaatcctgccacagttcaggctaaactctgaagctgcagcaaaaccaccaagcaggaaccctttgtactctgactaaggcttgcagtaaagtgccgccggtcacggggtactggcaccctcgtgatagcagggctcatctcagactgatatcagcgtttccctgagttctgcattttgcagtcaatcttaaatattgggaagcagaaggtctgggagaaaagggataccctgccagaaatacacrgagcctagtttgcttcagccatcaaatggctattttgaatcacaaagctctaatctctgtgtttgcaataaatccttacaacctctaatttaaacaaataagagctttctttccatagggagctgactcatatcatcttaattaagcagctttgaattaatgaagaaatttatagaaaaggaacagaaattccaaagaagctcagatttaggaaggaatagtcaaagcactcaagaagctccaatcaaatacagagcgtaaggtactcgccctgtattttactgctccatacacatctga

SEQ ID NO: 19660 - DNA, 601 bp, Human
atcatattcccagaccagctcctggtaacctaaaatcctagcttttaaaagaaaagaactaggcctgtctagcgaaatgtcctccccacctcctatatttggtaggacttactcaaagaatcgaccgtggacattatacctccatcagacttctcaaaaaatgtgcaagttacaaaatcctgccacagttcaggctaaactctgaagctgcagcaaaaccaccaagcaggaaccctttgtactctgactaaggcttgcagtaaagtgccgccggtcacggggtactggcaccctcgtgatrgcagggctcatctcagactgatatcagcgtttccctgagttctgcattttgcagtcaatcttaaatattgggaagcagaaggtctgggagaaaagggataccctgccagaaatacacagagcctagtttgcttcagccatcaaatggctattttgaatcacaaagctctaatctctgtgtttgcaataaatccttacaacctctaatttaaacaaataagagctttctttccatagggagctgactcatatcatcttaattaagcagctttgaattaatgaagaaatttatagaaaagga

SEQ ID NO: 19661 - DNA, 601 bp, Human
catcaacaaacaagaggaaggatagcttgaggccaggagttcaagaccagcctgggcaacatagtgagaccctgtctctaaaaataaaaataaaaataatgagcctggcatggtggcatgccatctatagtcccagctactggggaggctgaagtgggagaatcacttgaccccaggaattcaaggctacagtgggctatggttgtgccactgcactggagcctagatgacagagcaagaccctgtctgtaaaaaagattagatagacagatagatagatagatagatagatagatagacrgacagacagacagacagacagagatagatagatatagatggggtgtgtgtgtgtgtgtgtgtgtgtgtatatatatatagatatatagatatagtcttcagagattgccagccaaaattaaacctgaggctgctgaacttgagccatccagcagatctttcactcacaggttttccccagacaatagtgttctcctccaaggacctgatactaacctcctcctcaggaatggagatcttctcattaaagtaagtggcgaagtactcctctgagtccccaggggactgtgaaagagaggga

SEQ ID NO: 19662 - DNA, 601 bp, Human
atcttggctcactgcagcctctgcctcctaggttcaagtgattctcctgcctcagtctcccgagtagctgggattacaggcacccaccactacgcccagctaacttttgtatctttagtaaagacagggtttcaccatgttaaccaagctggtcttgaactcctaacctcaggtgatctgcccatctcggcctcccaaagtgctgggattacaggtgtgagccaccacgcccggcctgttttgttttggttttcgtttttgagaggaggtctcattctgttacccagagtggagtaccatrgcatgatcttggctcactgcaacttctgcctcctaggctcaagtgatccttccacctcagcctcccgagtagctgggactacaggtgcataccaccatgcccagctaatttttgtattttttgtagagacagggtttcgccatattggccaggcgggtcttaaactcctgggctcaagtgatcctcctgccttagcctcccaaagtgctgggattacaggtgtgagcctgggctcagccagagtttgactctttttcatcaacaaacaagaggaaggatagcttgaggccaggagttcaa

SEQ ID NO: 19663 - DNA, 601 bp, Human
ctcttgtttgtttgtttggttttgagacagagtctcactctgtcactcaggccggagtgcagtggcgcgatcttggctcactgcagcctctgcctcctaggttcaagtgattctcctgcctcagtctcccgagtagctgggattacaggcacccaccactacgcccagctaacttttgtatctttagtaaagacagggtttcaccatgttaaccaagctggtcttgaactcctaacctcaggtgatctgcccatctcggcctcccaaagtgctgggattacaggtgtgagccaccacgccyggcctgttttgttttggttttcgtttttgagaggaggtctcattctgttacccagagtggagtaccatggcatgatcttggctcactgcaacttctgcctcctaggctcaagtgatccttccacctcagcctcccgagtagctgggactacaggtgcataccaccatgcccagctaatttttgtattttttgtagagacagggtttcgccatattggccaggcgggtcttaaactcctgggctcaagtgatcctcctgccttagcctcccaaagtgctgggattacaggtgtgagcctgg

SEQ ID NO: 19664 - DNA, 601 bp, Human
tttgactcttgtttgtttgtttggttttgagacagagtctcactctgtcactcaggccggagtgcagtggcgcgatcttggctcactgcagcctctgcctcctaggttcaagtgattctcctgcctcagtctcccgagtagctgggattacaggcacccaccactacgcccagctaacttttgtatctttagtaaagacagggtttcaccatgttaaccaagctggtcttgaactcctaacctcaggtgatctgcccatctcggcctcccaaagtgctgggattacaggtgtgagccaccrcgcccggcctgttttgttttggttttcgtttttgagaggaggtctcattctgttacccagagtggagtaccatggcatgatcttggctcactgcaacttctgcctcctaggctcaagtgatccttccacctcagcctcccgagtagctgggactacaggtgcataccaccatgcccagctaatttttgtattttttgtagagacagggtttcgccatattggccaggcgggtcttaaactcctgggctcaagtgatcctcctgccttagcctcccaaagtgctgggattacaggtgtgag

SEQ ID NO: 19665 - DNA, 601 bp, Human
gatggaaccaatgtacatcttaaatatattggctgatgtctgcctgtaacttctgacccctaaaacgtataaaatcaagctgtaacccaaccaccttgggcacatgttctcgggacttcctggggctgtgtcacgggccttggtcactcatatttggctcagaataaacctctttaaacattttacagagtttgactcttgtttgtttgtttggttttgagacagagtctcactctgtcactcaggccggagtgcagtggcgcgatcttggctcactgcagcctctgcctcctaggttcargtgattctcctgcctcagtctcccgagtagctgggattacaggcacccaccactacgcccagctaacttttgtatctttagtaaagacagggtttcaccatgttaaccaagctggtcttgaactcctaacctcaggtgatctgcccatctcggcctcccaaagtgctgggattacaggtgtgagccaccacgcccggcctgttttgttttggttttcgtttttgagaggaggtctcattctgttacccagagtggagtaccatggcatgatcttggctcactgcaacttctgcctcctag

SEQ ID NO: 19666 - DNA, 601 bp, Human
ttgtttagttgtttggcaacatgagtggtaaatactgcattcagaaaagagcccaggtcaagaatcaaatgacttgagttctataacagattttgcacatgacctgctaagtcaccttgtacctttctgagcctcagtttctcctatatgtagtttctcctttgttcaaggaaactatgtggataaaaataagaccaaatggaaagtactttacacataagagccactgccaatgaagtatctgcatgtagcccctgaggctactatccaacatgcagggtggagaaaaggatgtgagagkgtattatgtgcttaaaaggacaggggtaggactagatgttcaccttaaatccagccactgctccagactgcaaatcggattcaatatttcctggatccaggtaggcaatgctcataagaaaacctggtccggtgaaagcccagagtttacgaaagctaaaacaagagtactgtacaagagaggaaaagagattaaactgaacatcaccattgaactactgatataattggtctgttatcacatatgaagcaacaaaatccagcctcacaagaaaaaaggatttacaatgtcagatattgc

SEQ ID NO: 19667 - DNA, 601 bp, Human
atatagtttgtactaaaaagaaaaaaaattactttttcaaagtgatggcaaagtcaaacaaaaaaagaacatatataaaatgcaaactgatggagtaacatggaggtatgaataaaagtgcttagagagagcatcctcctccccttgggctgggcattgctagatactggaagccagagtgaatggtaacacagtttttctaagaaaaccttctaggaaatgcgagtctcaagttagattttgaaagagggggaaaacatggcctggcagcaggaggagctacagtatttccgttggtacygtctgtcttcagggccactgacccccaagtccttgactgtctcactatagaatgaggccagcacataccgccagacacacagattcctatggcatgggtgagagacaaacaggacaatacattgctcaccttgggatactgacggtgacatacttcagcaagatgcagcccagtaaccactcccagtctagctgcaagccgctggagcagcagccccacaagggtggccaacagaaggatccagagcaactaagaagaacaaaatctcctgtaacactcattgaacaactgagtttttgt

SEQ ID NO: 19668 - DNA, 601 bp, Human
ctgggcacggtggctcatgcctgtaatcccagcactttgggaggcgaaggctggcagatcacctaaggccaggagttcaagaccagcctgaccaacatggtaaaacctcatctctactaaaaatacaaaaattagccagatggtggcacgtggctgtaatccaagctagtcaggaggctgaggcaggagaatccctggaatcgcctcactgcaagaagcagaggctgtagtgagctgagatcacaccactgaactctgaactccagcctgggcaacagagtgagattctgtctcaaaaaamaaaacaaaacaaacaaacaaacaaatatatatatatataattattattacaaaataactattaacgtgtatgaagaaagagaagctaggcttggtgcagtggctcatgcctgtcgtcccagcactttgagaagctgtggtgggaggactgcctgagcccaggagtttgagaccagcctagacaacatagcaatacctcatctccacaaaaaaaaaaaaaaaaaaaattttaattagctgggtgtggtcgtgctcgcctgtggtcccagctacttgggaggctgagatgggagaatcgctt

SEQ ID NO: 19669 - DNA, 601 bp, Human
cccaaatagggaacagagactaaatgactactgagctctcagttactctcagtggctggaaggaccactgacctataaaaacgacctgatttcagtcctaaggtgtgcatatacctatttataaaggtttctaaaatctcccagcaaactattacataatactgacagtaaaagcctgtttgggctcctttactcctgacctccataaggccactcgagcttttgaaatttaaacacaagagacttgatgcacttccaaccttttatgaagaactttagtcccagctgggtgcagtagctmacgcctgtaatcccagcactttgggaggccaaggcgggtggattgcttgagctcaggagttcgagaccagcctggccaacatggtgaaaccacatctctactaaaaatagaaaaattagccaggcatggtggtgcacgcctataatcccaggtactcaggaggctgaggcacgagaatcacttgaacccgggagggagaggtttgcagtgagtagagatcacgccactgcactccagcctgggcaatagagtgagactccatctcaatttaaaaaaaaaaaaaaaaagaactttagcccc

SEQ ID NO: 19670 - DNA, 601 bp, Human
caaagactgagacaacaaagacattgatgatgaaggaaacaaagagtgcaatgcaggattcaatgaaaaagtacttattggcttctcgaacttcctgcttattgttccggtttacctgtctagactagaaagataacaacagcagtcactttttgaccagttagaacaagtttccttgtgacatttcaggagtttggagtcagctgagagatttaggggacaaaagttgaccagacgaaaagtgagagatccaacactcacctacatcctagttcactgagcaattaagaacttcatatgrggggagaaaaaagaacttcatgccctttcgttgaactgtacattccccaaatagggaacagagactaaatgactactgagctctcagttactctcagtggctggaaggaccactgacctataaaaacgacctgatttcagtcctaaggtgtgcatatacctatttataaaggtttctaaaatctcccagcaaactattacataatactgacagtaaaagcctgtttgggctcctttactcctgacctccataaggccactcgagcttttgaaatttaaacacaagagacttgatgcactt

SEQ ID NO: 19671 - DNA, 601 bp, Human
gatcacaaatccaaacatgcttacccctttgtagatgtccacagccagtgtcgagttatctttaggaaagaggccagcatgaggactgctggtatttgtacagacttcaacctagaacccaaagcaattcaacagcaacttttgtttcagaagcaaggaccaaataagagctctcctacatatcatacacaatcatctataagaggtaggctggagggaaaacactggacatatgctgtgatgtgggcagagactagcagcaatgttatctaggatcttcctctataatccttctacacccacaggtcatcaaaaatctttactgagttacagtgtgcatggtaataatgtacaaacgctggggtactttaaatgatgacaagaggagaggctctgaagaaggcttcagacatgagagaacacccagaatagaatcctcagtcaaagcagacagaggagtcagaggttccatagacgggaaacaaatggtgatcaaaactacacaggcaggccaggcacaggagctcacgcctgtaatccctgtactttgagaggccgaggcaggtggatcacttgaggtcaggagtttgagaccagcctg

SEQ ID NO: 19672 - DNA, 601 bp, Human
tcccaaagtactgggattataggcatgagccactgtgcccagcctgggtctgttcatttctgaatgtcagtgaaccccacctcaaccatccctgatacctatgcccctgctcttccaggctagacttaccaagtagaacacaaagcccagataagccacgctgaccacagcagccaccacatataatgccacatgccctaggtcccggacataaaccactacaaagtacatattgatggaacagatgataaggaccaagattcctcctgcaatccgccagcctctgtaaaagaaatcagcwcagtcactgatggaataatccaacttggccacagacagaaaaggaaacaggatgggaattagaggcagttcaaaatgaatggaaaaattgttcttaatttgaaaaaaaatgattcttcataagtctaagttaaatcacccaaagttagatactggtagacagggagaaagaggggggaaaagacaccaacaaataatccctaatatttaagtccctagagatgcaacaaggcctagaaacgcaatgagccattttattaacgttcccaaaaatgcaacaagtcacttcagatacctcata

SEQ ID NO: 19673 - DNA, 601 bp, Human
caacaagctcattagccttaggctgactgaggacaaactggcatgttcatatccaatttgcattctgaaaggatccccctaacttctatagtgaatttttaaaaacaattcctgtcaaggacacattcagttacttggttttccttgaagttaagttcctagatcatagggtcagtacagtctttgtgtgcacaaagtttattgggaagaaaaaaagaagagatctaggaaataatttttcaacatttactgaagtgattttcttaataaagtatctaatgtgtggcacactggtgtgggsaagtgttctagagattaacagcaggtttccagcctccatctgtagccattctctgcagcaaaaatggtataaattctactattccttatccctaacccctgtgtcttttcaaagaaacctgtatagaacagggaaatggatctgttgttattttggctgtttttcattaatataagcaatgctaaagaagatttggaaaatagagaagaatatatctataatcctagcttcctacaacaactatattgccatttttatataattctagacttcttaaaaaattttttataattgaaatat

SEQ ID NO: 19674 - DNA, 601 bp, Human
caggtggatcacctgaggtcaagagtttgagaccagcctggccaacatggcaaaaccccatctctactaaaaatacaaaaattagccaggcatggttagcacatggctgtagtcccaactactcaggaggctaaggcaggcgaatcacttgaacccaggaggcagaggttgcagtgagctaagatcatgccactataccctagcttgggcgatagagaaaaactctgtctcaaaaataataataataatgggtcttcaacaagctcattagccttaggctgactgaggacaaactggcatsttcatatccaatttgcattctgaaaggatccccctaacttctatagtgaatttttaaaaacaattcctgtcaaggacacattcagttacttggttttccttgaagttaagttcctagatcatagggtcagtacagtctttgtgtgcacaaagtttattgggaagaaaaaaagaagagatctaggaaataatttttcaacatttactgaagtgattttcttaataaagtatctaatgtgtggcacactggtgtggggaagtgttctagagattaacagcaggtttccagcctccatctgta

SEQ ID NO: 19675 - DNA, 601 bp, Human
tgctctatgaagttcctgttttgaagttaaacaacagtaacccactctagaatcagccctctcctctcaaaatgggtcttcaagccagacacggtggctcatgcctgtaatcccaacacttcaggaggctgaggcaggtggatcacctgaggtcaagagtttgagaccagcctggccaacatggcaaaaccccatctctactaaaaatacaaaaattagccaggcatggttagcacatggctgtagtcccaactactcaggaggctaaggcaggcgaatcacttgaacccaggaggcagargttgcagtgagctaagatcatgccactataccctagcttgggcgatagagaaaaactctgtctcaaaaataataataataatgggtcttcaacaagctcattagccttaggctgactgaggacaaactggcatgttcatatccaatttgcattctgaaaggatccccctaacttctatagtgaatttttaaaaacaattcctgtcaaggacacattcagttacttggttttccttgaagttaagttcctagatcatagggtcagtacagtctttgtgtgcacaaagtttattgggaagaa

SEQ ID NO: 19676 - DNA, 601 bp, Human
gaaggaaaaaataattccatctttcaaatacacatgaaacaaagtcttttccaaccaacggttgagtcataaacacagtctgtgcaacggcacatacttttggctatgttcacacagtaaaccatagaaacacactggctctgatggctacctgcagaagacagactaatccagtgttatttaacgtagccacgggtggcttcttctgtcagcaggcctttagagatgcttaccgtatgcccacagtccaggaaggacatgcccagtgcaatcaaacattgccaaccctgaaagacaaaayatggtcatcactcaccaggctctttgaagagccatgactgctcacacagcacttctcaaatgcaaacctgctcccttccttgaacatccagctgtgcccatcttctaccaccaagggttgcacaagtcattctctcaaccccactcccccttcaaaaaatcagctgccttcctcaacaaagtttgtccatactattttaaatattgaatttctctgttcttactgctttgtgtctgtggttttccttttttttaaaatctttattattattttacattttagagacaaggtctccctcta

SEQ ID NO: 19677 - DNA, 601 bp, Human
tattacttgaggggctaagaaaaatgtatggtcagtgaaacacagtagtgtacccttaaatgccttataaaagaccatccatccagtctgcgcttttgactgtgtgcaagtatcagtaataatgcttttgggggctcagatgaacagcgaacaccaatcagccaggactctggaaggaaagctccaaaaatgagaagtccttcaacaccattttccattactgttctcaccaaatcaatgactataaaacagttttgattatttatctccatcaaagtgatttgatttgagataatcacayaatctcaggctcggtatgtaaaaatgtcagaagtggctgaagtaaaagcagcagctttgtgctgaagacacccatttcctctgactccagagctccaccatctggtctcaagatttttccctctgaggaaacagctgtagagaggtagcccagttcaactttgctgagacagtgaactttgcaaccatactaacacctactgacttgcagagaacgctgagaaagacagtgtgctttgcaatggttaagtccacagctcctgagattgcctcgcaagtcatcttgggcatgaagcagagc

SEQ ID NO: 19678 - DNA, 601 bp, Human
cagcacaattatttcatgtcacatttaagaagaacaagaaccaatttatataaagtacaattgtatatccttaaacattccacataaacacactgtcaaaactcactggatatgctggaattggaggacttaaatttctacatattatttattgcacccagagtactggttaaaatgcactttctgtgaagatcaaatgcaataacgtatgagggtatttttaacactgtgaagtacacacataatattataaaatgccatttaattggaaggagttttctatcattgcaagtcataaatrtaacttttaaaagaatactagcagcttttacctaggctcctaaatgcttgtaaatctgagactgactggacccacccagacccagggcaaagatacatgttaccatatcatctttataaagaattttttttttgtcgtcagtttggcctttcctactgcagccaggtgagagcttaagatgtcagtccccaatatcttcacagagtgcctttatgaccagtttggagaattacgatggtaaggggaagaggcagatatgaagaggaatggttaggggaattgtcattcataactctgtgc

SEQ ID NO: 19679 - DNA, 601 bp, Human
gaggcaaaaactctgtctttagaagacagtgtagtgaatatagtccatgtaagaattttaggccaagtgcagtggctcacgcctgtaatcccagcatttcgggagaccgaggcaggaggatcgcttgagtccaagagttcgagttcagcctgggcaacatagggagaccttgactacaaaaaattgaaaaattagccaggcaggcatggtgtcttgtgcctgtagtcccagctactcgggaggctgaggcagaaggattgcttgaggctgggcagtcaaggctgtttccaaaaaaaaaaaagaaagaaagggaagggaagggaggggaagggaggaaaggacaggaaggaaaggaaggaaagagggaaagaaagaaaagaacttatagccccatagacctgggttcaaatcctggaatcctagctctaccagttatgtgtcctggatcaagttatttaactgaaactcatttattcatccataaaatgggtttaatatatccatcttaccaggatttgtggggaggttacatgttataaggactgataagataatctctgttaaaaaaaattcttagcagatacaaactcccattttgaac

SEQ ID NO: 19680 - DNA, 601 bp, Human
tctatttcggggttggaatggggagccttcggacacagacttcaattctgtaaagccacctaataatcttaaggaaaaacaatgaacccccccatccccatcgccacttaacaaggacaaactgtatgcaccatgagcctccttagcgggacctgctggcccaccagacccagccaggcttcatcactggccacaggcagggtgaggaagagcccggaggtcgttgaaacaggggtgcctttgcctgaccctgaaagacacttcccagcagctctcattatcaactgtagttttaggtctrttactggggaaagcactcaagctgtagctacctttcttttaaagattttgcagttgttgttctaactcagcattattacttgctcctcttttattatgtggggaggaaatatttgtgaaaaatgcactcatccctcgaaatctgagatcatctcctttgaaacagacaagaggaagatcaaagaggcaaaaactctgtctttagaagacagtgtagtgaatatagtccatgtaagaattttaggccaagtgcagtggctcacgcctgtaatcccagcatttcgggagaccgaggcaggag

SEQ ID NO: 19681 - DNA, 601 bp, Human
tctatggctttacaaagcaggtcacttatgtcacttatctggatttgagctcagatgttcttcactgtggggctgaagaagggaagcagaggtgagggaaggttgaagaagagtttacagaacagggcttctcagtggggttggctcactggggaatcgatatgaacgccagcatgagccccttcatcaatgctttgcaacctctgtctctatttcggggttggaatggggagccttcggacacagacttcaattctgtaaagccacctaataatcttaaggaaaaacaatgaacccccccatccccatcgccacttaacaaggacaaactgtatgcaccatgagcctccttagcgggacctgctggcccaccagacccagccaggcttcatcactggccacaggcagggtgaggaagagcccggaggtcgttgaaacaggggtgcctttgcctgaccctgaaagacacttcccagcagctctcattatcaactgtagttttaggtctgttactggggaaagcactcaagctgtagctacctttcttttaaagattttgcagttgttgttctaactcagcattattacttgctcctctttt

SEQ ID NO: 19682 - DNA, 601 bp, Human
tcatttactccttcctccaactccaggaaatcaccattgttaccctcttcttatagaggaggaaattgaggctcagaggctaggggacttgccaaaggttacagggctactgagtggcaaagccacttgctcatccccaagcccatcctcttagccactggcattttttgccgcctctgacagatacactcagggccgtcatgctgcacacatccagggggcgccctaccctttgtagtccatgggaaaggctcctctggggcggtggggttgtgtggctatgtggtggtcttgtgtagaygggggctttggtttcagttgcactattgcgttattgcagattgctttgtctttccacctgagcgagcctcaagcctgtcccttgacttgttcattaactgactcattctcttggttctgccctgggaggaaggatgggcccggggaggagggacatgaagaatccaaatctgggctcaagttccaactctgtaaactctgtaattaccggtcattcaggctgggggaagtcataatcctattagagcttctatttccttatctgtgaaatgagtcaatcatatgaacttcaaagagccgc

SEQ ID NO: 19683 - DNA, 601 bp, Human
aacaccaccgctaatgatagcaatgccaacagtgccatttgctgagcacttactccaggccaggccctgtgctaagttgctcacatgggaaagctcatttactccttcctccaactccaggaaatcaccattgttaccctcttcttatagaggaggaaattgaggctcagaggctaggggacttgccaaaggttacagggctactgagtggcaaagccacttgctcatccccaagcccatcctcttagccactggcattttttgccgcctctgacagatacactcagggccgtcatgctgyacacatccagggggcgccctaccctttgtagtccatgggaaaggctcctctggggcggtggggttgtgtggctatgtggtggtcttgtgtagatgggggctttggtttcagttgcactattgcgttattgcagattgctttgtctttccacctgagcgagcctcaagcctgtcccttgacttgttcattaactgactcattctcttggttctgccctgggaggaaggatgggcccggggaggagggacatgaagaatccaaatctgggctcaagttccaactctgtaaactctgtaatta

SEQ ID NO: 19684 - DNA, 601 bp, Human
aatgttatctattgtttttagcagtggtgtatgtaagtaataagtggctcaaacaattcactgatgagcagaagggtttcattgatatcttaactcccagcacagagccaggggagtgggcatctgcatgtactcgtcaatggaatgtgacatgcccaggacacaaaggtggcagccccatgcaggggtccctctggactgcctggatctgaatcccagctctgtcatttgctaattatgagatcttgaaaattactttaactttctgggcttcagggtcctcatctttaaaatgggatarctaaaattccttccttgtggatcgttgggagagttgaatgaattgatgtgtgatatttttttcttcatcccctcttctatctgactggatcctttccgccagcccaccccagcatgaagaggagggggaaaaacatggtcaagttagctggtttgtcacatgtccactgcagctcagggccctccctggagtctgaactcatatttcctgaatggtccaaagacacaagtcagcccccaaagacatagggataactggcaatgctattagagggtgtggggatgagggttaaaggctgca

SEQ ID NO: 19685 - DNA, 601 bp, Human
aactgcagcccagcaagcaacacatagctcgacttggttctgaattccatgtgtcttcacctagatgctcccacatttgcctttgtccctaaaatacacacatgcgtacacacacacgcgcacacacacacacacacacacacacacacacaccatgctcatttcctaattgtttacgaaggtatagaatcaccagtcacttagaataggctcttggtttcatgacacctgaacagattagaaaattactttttaaaatcaaaatatattcattggctctcattgctttcaggatgaaatyccctttgcacggctgcttcctcttccagtaacatcacccctccctcacctgagtggatgttgcactctgggtggacccacctcctccccccaactcctccccacactacagcctgcccaggcacctctgcagtctccccagcagaggcctctagcacggtcccagtacacccacaactacgacctcctgtctacactccatcccacctactcctgacacaatttctccaactcgcattcttcatgtacgtctcccaaaccagcgaggaagacatccgtttccccgtttccttcctgacag

SEQ ID NO: 19686 - DNA, 601 bp, Human
ggggggatggcgccctgggaaatggatctcatttgtgaaacaagaacctccttgctctcttaaccatatttgatccaaagagtgtagcaactttcaaccccagtgctgaaaaatttcaaaagctcccaagtgctgaaacattcgcagcgcaactgaacccgcatagacgcctctcatagtgcatggggggtttctctgggccgcctgggctcctgaattgcgacctctcaagcgttctaaaagaggaaaacgcttttagtaaaccctcaggaatcccacagagcgcacatccccgccctcsgatttctcccagagagagatggggccccgcccgggctcggagcccaccgcttccctcccagggcggacttcggcccgcggggtacctggctctgcgcgggcagcagtcaggcttcggccggaggatcctgcagagcagcctgcacagccggggcccggcggcctcgcacgccgcgcccagcccctcgcgcatggcccggctccttaggcgcagctccgctggctccacgcgcctcccagcgcccgcgctttatcgctcggagcctgcagcccccgccccgggggcggggcgagccgagca

SEQ ID NO: 19687 - DNA, 601 bp, Human
ttcctctcacttacttctggaagtagagttggacaatttcagaagcttcagaccagaaacatctacagtactgtttagattgagaagcaatgtctttgtacatttaacataatcattttaccccatatattaaaaagtatcacttttaaaagttggctaaaaatccactctacagatgggccacgattagcctggtcccattgtccatggctggatgttagactgtgtctagttttgccctcatataaataatgccttaaactgtatacacagtctgatgctggctgtgtgtgtgtgtgtgcgtacaagcacagaaaaacacctcgagggaatgttagtaaatgttaacagtgactagcattaagtgataagatcataggcaatttaacttttcttatacttttccacatcttccaactttttacagtgacaatgaattcctttcataattggacaattctttaaatttgaaaaatgaataaacaaagttttgcccaagtcccctcccacaccatttcttctggctggctgctgggagacagggtgacagggtgaccagactccaggtgagcaccttcagaatctggacacttctttccaa

SEQ ID NO: 19688 - DNA, 601 bp, Human
tgactgattgactgattgatttatattttttgaaacagagccttgcactgtcatccaggctggagtgcagtggcatgatctcagctctctgcaacctccacttctcaggttcaagtgaacctcccacctcagcctcttgggtagctgggactacaggcgcacaccaccacacctggctaatttctgtatttttggtagagatggggtttcaccatgttgcccaggctggcctcaaactcctggcctcaagtgatcctcccaccttagcctcccaaagtgctgggattacaggcaggagccrccgcgcccagccccagccacttgtttttcatgacttaagctttatttaaaacacgtgatttatcttggtttatttacttattctacatttctattacagaaaatgttaagtgtacaaaagtagagagaatagtctaataaccttccatgggcccttcacccagattcaacccaattcaacagtgatcaatccacggccgatcttgtttcacctataccttccctgcccccatcattattttaaaacaaatctaagatgtcaacttaccttcaccaaggtaaaaacaagtattgtaaaaat

SEQ ID NO: 19689 - DNA, 601 bp, Human
gaaggggcttcccacacccatgtgactcactgacctttcccgtctccacgaggggctgcggggactcattctgctgcttgctgaggttgtgatactgaaggtcatcctgtgtcactggactgtgaaaggaaacagctagcatgagatgcggtatccaagggtggaggggcatcttggagttccctctgccagtaacctcatttgacaaatagggaaactgagtccagagggtgggagtgaattgttcatggtcggtctgaccaactgcctccccatccccatcttccctcttcctcttatmttcttcctcccgcagagccaaaagggcatgagcagagctgagccaaagctactggcccaaacagcagcccatagaggatctggaaaatgctccttcaccctctggaaaagccaagtacaaacgtggcacaggggctgggtgggcagagaatggctccaacaactctgcctcccagactagcagcactgcccagcagccacttggattggttgactgattgactgattgatttatattttttgaaacagagccttgcactgtcatccaggctggagtgcagtggcatgatctcagctctct

SEQ ID NO: 19690 - DNA, 601 bp, Human
agaaaggattattttttacattcacatccaattccttcagagttttagatgtgatagccattttcatatagtcattttctaaggcattagaaatgctatgatgtctatgagctctgaaaaaaaggagtggctttcatcatcagtgaacagatttaaatgtaacatgcagcaagtcacaatctctaaatatgctatgattcttcagatacaaaaggccactgaacctgctcagctggtcatgtcttagattgccagggtccctgtgaggagaggctgccattccccgttcacacccccaggwtctcttgctcagggaagcaggggttcaaggtatgtacttgtgacttggaaaaatacaattttcctctgggagaagcaaatgggttccaacaccaccaagcatggccctgtagccctgctgggcttctgaacacccgcccaattgccttccacacaacagcaaggcctcccacgtccagaatagagttgggaacctgcaaggccacacagctaggtactagagcattgatgggaaaagcaagggctcaggcaccagctgcctaggttcgaatccccactctggggcttcgaagggtgtgac

SEQ ID NO: 19691 - DNA, 601 bp, Human
ggagggagggactcagtcagaaaggctttgaaacacacacacacacacacacacacacactaccaccaccaccaacaacaacaaccttgagatttccagtcagcaccaaagccttttgaaacagcatcaaaactatttaaagaatgaactcctgattaaggagagtgggtaactctgaacaaaatggcctttctgtggatgaagagtgtctcgacaacttttccttgattagagaaaaaaagcacaaagacaaaacactgatgatatttatccccaaggacacccctgccataaggagctrctgggtgaggtgggaaccaccccactgctgggagacctccctccccaaacaaagcttccagcaatattcccccctctgcacctgagcatgacaacagtaatgatcaccataacacccacaccaccaacacacatggtggtcagcacgtgcatatgcaagaaaggattattttttacattcacatccaattccttcagagttttagatgtgatagccattttcatatagtcattttctaaggcattagaaatgctatgatgtctatgagctctgaaaaaaaggagtggctttcatcatcag

SEQ ID NO: 19692 - DNA, 601 bp, Human
ttgagggcctgcccacccttctcaggagcctggtcaagccaggactgggacctggctatcggagctcagtctgcagggtcccagggcctggccagaaaagagctgcccacgtcatagtctctctaaaccgtgctgttcctcagcctcagaattgctcattcagtcactccatatgcaattctaaacttgcttctctcctcccctcccagacttcaaaaatatcccaaagggagggagggactcagtcagaaaggctttgaaacacacacacacacacacacacacacactaccaccaccamcaacaacaacaaccttgagatttccagtcagcaccaaagccttttgaaacagcatcaaaactatttaaagaatgaactcctgattaaggagagtgggtaactctgaacaaaatggcctttctgtggatgaagagtgtctcgacaacttttccttgattagagaaaaaaagcacaaagacaaaacactgatgatatttatccccaaggacacccctgccataaggagctgctgggtgaggtgggaaccaccccactgctgggagacctccctccccaaacaaagcttccagcaatattccc

SEQ ID NO: 19693 - DNA, 601 bp, Human
atgttgagggcctgcccacccttctcaggagcctggtcaagccaggactgggacctggctatcggagctcagtctgcagggtcccagggcctggccagaaaagagctgcccacgtcatagtctctctaaaccgtgctgttcctcagcctcagaattgctcattcagtcactccatatgcaattctaaacttgcttctctcctcccctcccagacttcaaaaatatcccaaagggagggagggactcagtcagaaaggctttgaaacacacacacacacacacacacacacactaccaccamcaccaacaacaacaaccttgagatttccagtcagcaccaaagccttttgaaacagcatcaaaactatttaaagaatgaactcctgattaaggagagtgggtaactctgaacaaaatggcctttctgtggatgaagagtgtctcgacaacttttccttgattagagaaaaaaagcacaaagacaaaacactgatgatatttatccccaaggacacccctgccataaggagctgctgggtgaggtgggaaccaccccactgctgggagacctccctccccaaacaaagcttccagcaatatt

SEQ ID NO: 19694 - DNA, 601 bp, Human
gcccaaagatgttgagggcctgcccacccttctcaggagcctggtcaagccaggactgggacctggctatcggagctcagtctgcagggtcccagggcctggccagaaaagagctgcccacgtcatagtctctctaaaccgtgctgttcctcagcctcagaattgctcattcagtcactccatatgcaattctaaacttgcttctctcctcccctcccagacttcaaaaatatcccaaagggagggagggactcagtcagaaaggctttgaaacacacacacacacacacacacacacacyaccaccaccaccaacaacaacaaccttgagatttccagtcagcaccaaagccttttgaaacagcatcaaaactatttaaagaatgaactcctgattaaggagagtgggtaactctgaacaaaatggcctttctgtggatgaagagtgtctcgacaacttttccttgattagagaaaaaaagcacaaagacaaaacactgatgatatttatccccaaggacacccctgccataaggagctgctgggtgaggtgggaaccaccccactgctgggagacctccctccccaaacaaagcttcca

SEQ ID NO: 19695 - DNA, 601 bp, Human
agcccaaagatgttgagggcctgcccacccttctcaggagcctggtcaagccaggactgggacctggctatcggagctcagtctgcagggtcccagggcctggccagaaaagagctgcccacgtcatagtctctctaaaccgtgctgttcctcagcctcagaattgctcattcagtcactccatatgcaattctaaacttgcttctctcctcccctcccagacttcaaaaatatcccaaagggagggagggactcagtcagaaaggctttgaaacacacacacacacacacacacacacaataccaccaccaccaacaacaacaaccttgagatttccagtcagcaccaaagccttttgaaacagcatcaaaactatttaaagaatgaactcctgattaaggagagtgggtaactctgaacaaaatggcctttctgtggatgaagagtgtctcgacaacttttccttgattagagaaaaaaagcacaaagacaaaacactgatgatatttatccccaaggacacccctgccataaggagctgctgggtgaggtgggaaccaccccactgctgggagacctccctccccaaacaaagcttcc

SEQ ID NO: 19696 - DNA, 601 bp, Human
ctttaatcatattcatctcagtaaggggtgcaatccttctcagacacttgcaagcctgggaggagtgtcccatccagccatagcaatgtcctgcctctccattagttagtagagtgccctccttccttgccatgactgagagatgagccagtccctccgtggcagctccggtgtactgggtacccacatgagccaggcactgggtgaagcaacccacaggcagggtctcactgagtctgggagggaggtatttttgcatctattttatagccaaggatctcaaggctctaggaggttaagyaccaggcccaggaacataagtacaggaaagagcaaagtcaggactcagacccaggtcgccctgatgccaagcccaggttcttaactgtcagcaacgtgaccttccatcttccaccctacggggacagtaagcccaaagatgttgagggcctgcccacccttctcaggagcctggtcaagccaggactgggacctggctatcggagctcagtctgcagggtcccagggcctggccagaaaagagctgcccacgtcatagtctctctaaaccgtgctgttcctcagcctcagaattgctcat

SEQ ID NO: 19697 - DNA, 601 bp, Human
gcctccaatctgcacctgccactcaacaccatgcagaagaattcagcctcccatctgcaccaccgctcccatttcatggctgccctctaggggagcacaggcaaccccactcagaagaccccagcaaacccagaattccaagaaaacctgacttgaaagcaccatgaatcgggattgccacagccccaggctaggtcctttcccacaccagcacatactacacagccagagttggtttcactggcagttctaatcgatttctctgtccaagtgcttttgatattatcctgcaacaaatgaytccccaacaaaaagatggcctaggaggctaggctaaataaaatgttctcttggagccaagaattcaagcattggaggaaaacaacacatcttgcagcaccacggcctcaagtgtaataaaaacaaggtcgtggtttactctaatgatggcatttagtctcctgaatttaacacaatagagaatgggcagctagaaaccctggtgctgaaacaggattcaaggcttctagagagggaccctaggtgccccatctcaacatttgggaatgtaagagaggatccagggccatggcttcagtcc

SEQ ID NO: 19698 - DNA, 601 bp, Human
tccaagtggctccacatcagaaggaaaccaagggcatgggttgccgatgggagctgagctcacaggggctgggctcactactggaagtccccgaagaagcctgagtctttctcttttttctttctccctggtttctcctggagctggagatgcctcccctagacccaagtgctgcatcttttggctaagattctcaggcaaggcaagcccctctgcagccctgggaaacgtgcaccgacctgatgttgccattgttggtggagtaacgcacgtgtctgcagatgtgttcaaacatttcccrggcagtggaacagctgcgggcatcgaagacctgcaacagcccatccagaccatgcccatcaaagactgggtagacagaggctttgaggctgatcagaagtcactgggaatcaatagtgcagccgaaacactcaacacacaaacactcaacaccatgccgaagagtgcagcctccaatctgcacctgccactcaacaccatgcagaagaattcagcctcccatctgcaccaccgctcccatttcatggctgccctctaggggagcacaggcaaccccactcagaagaccccagcaaaccca

SEQ ID NO: 19699 - DNA, 601 bp, Human
agactgagggtaagggggcctcctctagcttgagtggtcagagagccttctcagaggaggtgacattataggaaataccttttgacaagaagaaatgagcctagaaaaattctgaggaaaaggcatgtcatgcaaagggaacagggagtacaaaggctgtgagtcaggactgaatttggttcattcaacggccaggaagaagagcccagcccaatgtctgctacagagtaaatctcaatacgcagaggtatttttgcaattatgagaactgcctagagcaggggctgggccagtaggactyttgaagtcactgcagccctatatgatcccgacaggagagggacagctaagagcattggcaggagggcagaagaggcctgggctgctcctttctagaatctcaatgcattcctctcctgcagtcactgcttctcaagctcctggggccccatccgcctaagcctctgcttcccctcagcatcaacacatccacctgtctgaggcccgaggtgccagtgcagaatggctgcagaatgcaacagtgacaaaagagtccttgaaggccagccccctgagtgtcacctgctgctggctgggcttt

SEQ ID NO: 19700 - DNA, 601 bp, Human
actatgtgccaggcactctgctagctgttgggtatacattgtgaacagaaaagaaaagatctccaccctcaaggaacttgtagtctaatgtctagactctagattataaatgggtaaacaaatatataagaaataaaaacaagatgatgtgttagactgagggtaagggggcctcctctagcttgagtggtcagagagccttctcagaggaggtgacattataggaaataccttttgacaagaagaaatgagcctagaaaaattctgaggaaaaggcatgtcatgcaaagggaacagggartacaaaggctgtgagtcaggactgaatttggttcattcaacggccaggaagaagagcccagcccaatgtctgctacagagtaaatctcaatacgcagaggtatttttgcaattatgagaactgcctagagcaggggctgggccagtaggactcttgaagtcactgcagccctatatgatcccgacaggagagggacagctaagagcattggcaggagggcagaagaggcctgggctgctcctttctagaatctcaatgcattcctctcctgcagtcactgcttctcaagctcctggggcc

SEQ ID NO: 19701 - DNA, 601 bp, Human
gcaagcaagagcagccacagctcataggtcccctcccagcatcactcattcatgcacacgtcagacaaggactgaagacccagtttgtgccaggccagatcgcggatgtggccctcatcattcattcttcaaagacaaattattttagcatctaccatgtgccagacactcttctaggccagaggtgcagcagcaaacagacagacaaggtccctgccccatggagcttacattctagtggaggaaaccaaacaataaagaaagctggcccggcaccgtggcttatgcctataatcccagygctttgggaggctgaggcaagcggatcacttgaggccaggagttcggaaccaacctgggcaacatggaaaaacaccatctctactaaaaatataaaaattaggcaagcgtggtatgcacctgtagtcccagctactcggcaggctaaggtgggaggatcacttgagcccaggaggtcaaggctgcagtgatcatgccactgcattccagcctgggtgaccgagtgagatgatgtctcaaaaaaaaaaaaaggaaaagaaagaagaaagtcgatgtcctatataatgccaggaactgtatg

SEQ ID NO: 19702 - DNA, 601 bp, Human
gagttcatctccaaaggaaaaaaaaaaaaaaaaaaactcagtggtagccacgatcatgatgacaacataataaacagtaagaaaatcattgcttactgagtgttgtctatgggccaggcagtgcagctaaacattttgcatgcatttttacttaactcttataatcctcagatgagggaggcactattatccccattttacagaggaggaaacaagggcccatcttttgaagtttaccctgaaggagggtggtgaggaagtcctggagacgctcaggcagtggaaggacacagtcagccayggtgaggagacagcagaggctcacagattttctgggacgtatccacatcctgccagcatcagggctggtgctgggagtccccaggagtcaggatgtgtggtgcaaagccagcccttcccgaaacaccggggggctcttcctgttccatcttcccctcccccgtcaagcacaggcctgatctgcctatggggtgacccagtcatggggaacagtgtgtgctcatctgtactctgttcaccactcacatccttggcccagcctagtgcccagcaccaggcaaatgctgagtaaaacactgct

SEQ ID NO: 19703 - DNA, 601 bp, Human
gtgacaaaacaagaccttgtctccaaaaaaaaagttcttacatcatgaggttgttgaaaggatgcaataagctggaataagcaaagcatagtaagtgcttaataaatattagctgctcttataatctccatctgccaggcactgcataaggcatcggcgttatagaagggaaagacacagccctttctctgcattagagtctagtctaactgggtggggaagccaaggaaaatcagtcattttcacacggcctgatagaaactctgatggaggcaggcaaaggtgctggggaagggcagargagaggatacaacgccagacagaggcccagggtgagttggcgaatttcgggagcagctcctgagaggaagggagacttgtgagaggggtgcaagttagttgagtggggcactgcatgagtcaaggcagggaggcatgagaggatccagctggtgtcaggcctgggaaggccagccatgccttgtaaattcaatagacatacataagttatatatgtgtatataaaagtccggccaccactcttgtggacgtgggctctcattcacttattcttccaagacacagcaactcctgggagcca

SEQ ID NO: 19704 - DNA, 601 bp, Human
tgctaggaagtggcagaatcaatagcgtctgactcaggggccaatcccctcaacactctgctgagtgactgttgccgggccctcccgtggaagcaggtgtaatgacagaccccccatctgagccacaggccactagcggtgcagtggaagccacttccttcagtgccactctccgtggaaatgcacaaaggctgctcagcatccttgagtggggcctggaaagctctaacaacatactcctgcttcccgtcgtgccctacatgtgtaacaatgaggtgcacacacacacacacacatacarccacatctgagcccccaggaaggagagaagaggaaggcccctaacctgatagtagtagaaaggggacaggacgtagttcagcatctcctggtgaaacacgggggtgatgctcccagacatgggagggaccagccaaatccagtctgccgggcagcccccacgggaccggtattcattctgcatgtacttcatgaaggattctgcagccgagtggtggtccatgatggtcacattctgcttctgtatcagaaggcaagatagggagtggagataagggtgggggaatcaggagaggggccg

SEQ ID NO: 19705 - DNA, 601 bp, Human
gacctgccaccactctcctggcagttccagactcctgggagccagcaggtgaggcttggacccaagaggtgttttcagcaacctggccgacctggtcatcagtcagtgcccccttggcctaagcctctacgtggcacagaccacagctcatcccatcgtggcattacactggcctgtgccctgtcctcagagtcacatccatctcccagaagccgtgcgaccctggaaaacccatcaacctgtctaacagtcaggttcctcctctgtgcattaacaatggcattgacgcctgctttgcagrgcgctgggaggggagggtggggtgtatgctggagagctccccaagggcaaggcctggctctgcgccacccactgtcagatcctcagagcccggggctggtccagcacgtggccaccattccctaagagttggattttatccatcagtgctgaaggcaggggatagagcttagacagaccctctgcggcctttttttgtttatctgaagcttactcatctcttccccctttcacatgcagcactgcatcctgcagagcaggtgttcagtgagcctgaataaagttcagccagagcagctga

SEQ ID NO: 19706 - DNA, 601 bp, Human
caaaattggccaggcatggtggcgcgtgcctgtaatcgcagctactcgggaggctgaggcagaagaatcacttgaaccagggaggcagagtttgcagtgagctgagatcgcaccattgcactgtaccctgggcaacaaaagcaaaactccacctaagtaaataaataaataaataaacaaacacacaccaaaaaccaaaaaacaaacaaaacaaacaaagagcaggccttggccagggaatagtatctagctaaaattcattaacttcattttgttttcattgaatttatgttttgctgcyttccatttgtgagagtgatacaagtttcctttaaatatgaatttgtaaatacaaacaggtaggccattcacagaaatatattaaatatgtcataggaaaggtggcactcccatatggcaataattacaatggaggccggcaaatgacctgagtgacccggagtggcctgagcactgactcccaaatgtcctccgtaggacctgccgcatcccccagaccctttcctgggtcctcccgtgccctaccaccccctagaccagccagacctcaagccacccacctctccattgccagggcagt

SEQ ID NO: 19707 - DNA, 601 bp, Human
tgcctcttaatgggggacctggaacagctgggcccccacccatccagccctggcagaggggcctgcctggtagcatgccttctccagaggggctccgaatgcgccgtgattctgtttggaacccggtagaagcaacaacaattggtcctacagtctctgaaataaggctggctttccaggaagccaagatgattccaggaggtatgtgacccagcagaactagcgtcaaatcccatggtgagtatttactcccttttcataatttattttttagttattccccttcaattacattttcatycttcggagcactggagagacagtctcatattggtgctaatagacctttaatacctctctcattgcctattagtcttttttaaaaacaaagatagctgagcacggtggctcacgcctataatcccagcactttgggaggctgaggcgggcggatcacctgaggttgggagttcaagaccagcctgaccaacatggagaaaccccatctctacttaaaaaaaagaatacaaaattggccaggcatggtggcgcgtgcctgtaatcgcagctactcgggaggctgaggcagaagaatcacttg

SEQ ID NO: 19708 - DNA, 601 bp, Human
gctggacccccttctggtcctctccatcccccagccttgtcaccaactcccatgaccaccccatgcttggcctgcagacctgtgagagggacttggtttctgtggtttgaccctcgacacattctgagtacagaccttagacccaggtctctgtgcctgcacggttctgagaagaccccctgtgcacacccagttccatcccctgaacccagactttgggtccacagggcagggctaggagtaggacaacggaaaaagctttacctgaatttgttgttgagctctttcagcatgaagagcratttcttcagtttctagaaagagagggaatgacagagttctcaagccaggatgaataaaaacactgttttttcctttcttctggaaacctggccacagcttgcaggagaaggctcacagcccaccacggaagttggtttacatatggggctacctggccaaggacctggttgtcagctgacaagtttagcttgtctctcactccaactaaactgtagcaacttgtgtaggccctgcctcttaatgggggacctggaacagctgggcccccacccatccagccctggcagaggggcctgcc

SEQ ID NO: 19709 - DNA, 601 bp, Human
cgtacctgcccgaggacacacacagagacacatgtcccatgcaagcagcacctggcacccagcacccagcaccaacagcctggagagccagccccagactctccccctccagctggagaatggagctggacccccttctggtcctctccatcccccagccttgtcaccaactcccatgaccaccccatgcttggcctgcagacctgtgagagggacttggtttctgtggtttgaccctcgacacattctgagtacagaccttagacccaggtctctgtgcctgcacggttctgagaagacmccctgtgcacacccagttccatcccctgaacccagactttgggtccacagggcagggctaggagtaggacaacggaaaaagctttacctgaatttgttgttgagctctttcagcatgaagagcgatttcttcagtttctagaaagagagggaatgacagagttctcaagccaggatgaataaaaacactgttttttcctttcttctggaaacctggccacagcttgcaggagaaggctcacagcccaccacggaagttggtttacatatggggctacctggccaaggacctggttgtcag

SEQ ID NO: 19710 - DNA, 601 bp, Human
atcgcgccactgcactccagcctggacgacagaccgagactccgtctcaaaaaaaaaaaaaaaaaaaaaaaagctccttgatctgatacagggcagcttctaagtgttgcttctaggtgttgggaaattcaatttaggaacctaaaaatggaaagtcccgggacatctccatggcttgggatccacaggagagcattgttgacattggggatatcttaaatatgcagaaaccttcaggactatcttagacagggcacagggcacagcacctgggggtgcagagtggagagttcaccactamagcctggaatcgcctctgtgacaccttctctacgacacttggctgccttcgcagctggaaggctggggctcagaccccaacatggccacaggctagcagcttgcttcacctccttgaactgcaatttctccatctgtgcctttctcccaggaggagtgtccaggctcacttagcccatgtgggccaggagccccgcacagtgtctgacacacagtaggcccttggcggatgctgatcccttctgtctccaccaccctcctggggctccctcctgaaacagcctccctcagcaccttgagt

SEQ ID NO: 19711 - DNA, 601 bp, Human
tttttcttccttttattccacaaataaagatccttggtccagaccgggcatggtggctcatgcctgtaatcccagcacttttggaggccgcggtgggtggattactggaggtcaggagtttgagaccagactggccaacatactgaaaccaggcatggtggtagtgccaatagtcccagctacacgagaatcacttgaagccaggagacggaggttgcagtaagcgggaatcgcgccactgcactccagcctggacgacagaccgagactccgtctcaaaaaaaaaaaaaaaaaaaaaaaagctccttgatctgatacagggcagcttctaagtgttgcttctaggtgttgggaaattcaatttaggaacctaaaaatggaaagtcccgggacatctccatggcttgggatccacaggagagcattgttgacattggggatatcttaaatatgcagaaaccttcaggactatcttagacagggcacagggcacagcacctgggggtgcagagtggagagttcaccactacagcctggaatcgcctctgtgacaccttctctacgacacttggctgccttcgcagctggaaggctggggctc

SEQ ID NO: 19712 - DNA, 601 bp, Human
aagaaagcatccgccttggacatacatggatatcagaagaaacctttccttgttgccaggacaaaccctgttcttattagaaccaaggccagttttcctaatgcatgcggggaggacagcacagatcaatgaaacctgcagataatccacaaggctctttcccagagctgggaaatttccttccctgccaacacttttcctgaaagttcttaagaatgaatcaaacagtttaagtctctcttgcactctccttttagtgaaagagttcaatgaggaaggagaggaagtggagcagatgctyagagtccaagctggaaaagtggctcgtggttaaccaagagtagacgtaaaagcacaggtggccgcaggttaccaggtgggccggtcctaccgacagtgtggctgctaatgccagcatatgctcttctcctctcccttcaaagactgacttcttctgatctttcattcgttaaaataaaatcgacagagtatcacccacgaagccctgcactttcccttacctggatgtcggactttgtagattctgccgagatttgagcctcatggtgaacacgttcttggcatgcatgctgctgagggc

SEQ ID NO: 19713 - DNA, 601 bp, Human
gcaggtagttcaggccttggccatcctcacaggagagttccaccaggatggtggcacggctggggaaggaaaatgaagcctcaggtgacattgcaggatttcctccagggctccttgatgggcaggcgagattccccaggaaatgtgccctcctttcattttcctggctggttccacaagctaggccaccaccctgagcttgggatgaggcatccccacaggcaggggtgcttaagagggccccaggagcttccctctggggaggaggggggcccaccccttcccagcagcccttggagcyccccgagggcttggctacagcctctgcctaaagaaagcatccgccttggacatacatggatatcagaagaaacctttccttgttgccaggacaaaccctgttcttattagaaccaaggccagttttcctaatgcatgcggggaggacagcacagatcaatgaaacctgcagataatccacaaggctctttcccagagctgggaaatttccttccctgccaacacttttcctgaaagttcttaagaatgaatcaaacagtttaagtctctcttgcactctccttttagtgaaagagttcaa

SEQ ID NO: 19714 - DNA, 601 bp, Human
ctcctggacagtgggggtcactgccaggctctgtttctctgatcccactttcttttttatttttttgagatggagtttctgtcacccaggctggagtgtagtggcgagatctcatatcactgcaacctccacctcctggcttcaagcgattcttgtgcctcagcctcccgagtggctgggattgggataacaggcatgtaccaccattcctgtctaattatttttgtatttttagtagagacggggttttgccatgttggccaggattgtctcagactcctgacctcaagtgatccacccrccacggcctcccaaagtgctgagattacaggcgtgagccaccacacccagctcatcccactttctgactttggccactgcattgagggggatgttatcattagggaaactaaggccagggggccatgccttatgggctgggactgtttccacagctgctttcacataagctttggtggcccgccctctcagcaggaaggacagggatggctgtcaccggcaggcccaggctcagcccctcagccaggtggggcggccagagggtgccaggcagcactggctttctagcccgggactcacc

SEQ ID NO: 19715 - DNA, 601 bp, Human
acagcacagaccctggtgccagaagacacgggttcaaaccctggctccccacttctgaggtgactgaagcctctgggccttggcttccctccctgtgaaacagatctgatagcacaacctatcttgctgggttggcatgagcactgaatgaaattgtgccataatagttggtgccgtgcctggtacacagatgctttgtaaacactgggtaaaaataagagcctgacattctctcctctggaacagagtcctgatgaaccacatccttcaccctacagtcacaagggcaactgtcttgtcrtccccacgtctcaggttctctcactttctcctggacagtgggggtcactgccaggctctgtttctctgatcccactttcttttttatttttttgagatggagtttctgtcacccaggctggagtgtagtggcgagatctcatatcactgcaacctccacctcctggcttcaagcgattcttgtgcctcagcctcccgagtggctgggattgggataacaggcatgtaccaccattcctgtctaattatttttgtatttttagtagagacggggttttgccatgttggccaggattgtctc

SEQ ID NO: 19716 - DNA, 601 bp, Human
cagctcagcttccctgactcctactccagtgctccttccaaagactttctccgggaacactcccagctcaccactgagctccactgacagcagcatgaagtggcccctcagggtggctactgctgtgcgtgctcatgagcgtggcccttgctggtagcaaccctgggtggtggatgagctccgcgcatttcagcctgctctggcaccttgctttcctcctcagtgggccctcctgggcttgtagaaacccaggaggtctctctgggttgtgttccctttacaatggcccagcacttgaagraggcctccaaccaactgcagaggtccccctggttttcctcgggattaaattttgctctcacaagacatgtaggcctctcctctcctggtctgggtgggctgttctctagcagggcaaatagagtctctgccaaggttttagaaactgtgtttttgcttcttgaggacagagggctcggaagtgtgggcagctcccagctttgccaacccaggcaatgctcagttacagagggcagggcagggggcagcggccagtggtggagccgagaccacctggacgagatgttggcctcccgctcta

SEQ ID NO: 19717 - DNA, 601 bp, Human
caggtcgtggtggaatcaggtggacagctcagcttccctgactcctactccagtgctccttccaaagactttctccgggaacactcccagctcaccactgagctccactgacagcagcatgaagtggcccctcagggtggctactgctgtgcgtgctcatgagcgtggcccttgctggtagcaaccctgggtggtggatgagctccgcgcatttcagcctgctctggcaccttgctttcctcctcagtgggccctcctgggcttgtagaaacccaggaggtctctctgggttgtgttcccyttacaatggcccagcacttgaagaaggcctccaaccaactgcagaggtccccctggttttcctcgggattaaattttgctctcacaagacatgtaggcctctcctctcctggtctgggtgggctgttctctagcagggcaaatagagtctctgccaaggttttagaaactgtgtttttgcttcttgaggacagagggctcggaagtgtgggcagctcccagctttgccaacccaggcaatgctcagttacagagggcagggcagggggcagcggccagtggtggagccgagaccacctgg

SEQ ID NO: 19718 - DNA, 601 bp, Human
aggtcactcaggtcgtggtggaatcaggtggacagctcagcttccctgactcctactccagtgctccttccaaagactttctccgggaacactcccagctcaccactgagctccactgacagcagcatgaagtggcccctcagggtggctactgctgtgcgtgctcatgagcgtggcccttgctggtagcaaccctgggtggtggatgagctccgcgcatttcagcctgctctggcaccttgctttcctcctcagtgggccctcctgggcttgtagaaacccaggaggtctctctgggttstgttccctttacaatggcccagcacttgaagaaggcctccaaccaactgcagaggtccccctggttttcctcgggattaaattttgctctcacaagacatgtaggcctctcctctcctggtctgggtgggctgttctctagcagggcaaatagagtctctgccaaggttttagaaactgtgtttttgcttcttgaggacagagggctcggaagtgtgggcagctcccagctttgccaacccaggcaatgctcagttacagagggcagggcagggggcagcggccagtggtggagccgaga

SEQ ID NO: 19719 - DNA, 601 bp, Human
tgacttgaaaaaggtcactcaggtcgtggtggaatcaggtggacagctcagcttccctgactcctactccagtgctccttccaaagactttctccgggaacactcccagctcaccactgagctccactgacagcagcatgaagtggcccctcagggtggctactgctgtgcgtgctcatgagcgtggcccttgctggtagcaaccctgggtggtggatgagctccgcgcatttcagcctgctctggcaccttgctttcctcctcagtgggccctcctgggcttgtagaaacccaggaggtytctctgggttgtgttccctttacaatggcccagcacttgaagaaggcctccaaccaactgcagaggtccccctggttttcctcgggattaaattttgctctcacaagacatgtaggcctctcctctcctggtctgggtgggctgttctctagcagggcaaatagagtctctgccaaggttttagaaactgtgtttttgcttcttgaggacagagggctcggaagtgtgggcagctcccagctttgccaacccaggcaatgctcagttacagagggcagggcagggggcagcggccagtgg

SEQ ID NO: 19720 - DNA, 601 bp, Human
aaactgagacggggagaggaaaagtgacttgaaaaaggtcactcaggtcgtggtggaatcaggtggacagctcagcttccctgactcctactccagtgctccttccaaagactttctccgggaacactcccagctcaccactgagctccactgacagcagcatgaagtggcccctcagggtggctactgctgtgcgtgctcatgagcgtggcccttgctggtagcaaccctgggtggtggatgagctccgcgcatttcagcctgctctggcaccttgctttcctcctcagtgggccctccygggcttgtagaaacccaggaggtctctctgggttgtgttccctttacaatggcccagcacttgaagaaggcctccaaccaactgcagaggtccccctggttttcctcgggattaaattttgctctcacaagacatgtaggcctctcctctcctggtctgggtgggctgttctctagcagggcaaatagagtctctgccaaggttttagaaactgtgtttttgcttcttgaggacagagggctcggaagtgtgggcagctcccagctttgccaacccaggcaatgctcagttacagagggc

SEQ ID NO: 19721 - DNA, 601 bp, Human
taatagcattatccccactttacagatgaggaaactgaggcccagcgcattcagatcactcatccatagtcacagaactgaaagtgcggatgcagaattccctcagccaatcggagatcaaaagcagggactttcctgttacctccactcccaggagagggagccctggctactatgcgggagacggaaaggcagccattctaacccgcagaggcccgcacagggaagcaaacttgggaggccttccctcgagagaggtcaggaaccgtttgtggggctgcagttctgctcctaggcaggygctggccccctggtgcccctcccacctgggaagcctccagccttacccttgtgctgggagtcatggagccgttgctgccagaaactgcggaagggcgcgatgcctgtgccaggcccgatgaggatgcaaggatgggagggatcctcggggaggtggaagccgctggcactgaagaggacaggagaagagggggccagtcctcagacaccccaggcccacgcacacacaggatggctggggagctgggcctgtgggaggcggtcgtgagggggtggagaggacaagaagctcctatttgat

SEQ ID NO: 19722 - DNA, 601 bp, Human
aaactttatcagcattcccagcagccaggcaaggcgttggggacgcatgtcatccattcaacacataccttgcctctgaccgtgactagccagcaaggagtcaaaggtaagcttttttcattccgcccatttgccagacctctgttaacctgccaaacccacatagaagtcaaggatctgcgggtggccagggctggtattgaaacagaaaggagtacatgatttgtggcctgagaaatggcagtagagacagaatgtgggcccaggtatgtagctgcagtactttctaggccatagagarttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcacaattgaagaatgcttggttttagttgtaaacaatcatttaacctcactggacttcaatttgttcgtctgtagaggaaagtaaactaggtcacttggagctcaaaaat

SEQ ID NO: 19723 - DNA, 601 bp, Human
ctggtattgaaacagaaaggagtacatgatttgtggcctgagaaatggcagtagagacagaatgtgggcccaggtatgtagctgcagtactttctaggccatagagagttagtgtctaggaaataagaaaataaaaaggagcccattcttctctagtgattctttaccaccaagagctaataaatgtgcatggtactgttctgacaaggcctgggaaatagaaagatgagcaagacagtgttctggcccttacagcattaataagctagtggatcgcacagtacctgctggtgaacttcamaattgaagaatgcttggttttagttgtaaacaatcatttaacctcactggacttcaatttgttcgtctgtagaggaaagtaaactaggtcacttggagctcaaaaattctatgacgaattcatccttttaaacctggcatttttataaatgcacacttttaaaaagggaatcatagaagtttactggctctaattctttaaaacctgagtccttgcatcaggagatgagattttgtttgaaagctacggaaagtagcttgttatagatataaaataatgcactttggtattttgtgtgtg

SEQ ID NO: 19724 - DNA, 601 bp, Human
taatgcactttggtattttgtgtgtgtgtatgtcacaagaagcacaaaaataacaggtactgtattatttaagggtaagagaattgtgccttgtaaaactgggttttctcttttaatagaaacatgtaaatcctacaatttttatgacagaaattttatgagaaattcaaaaataatcaaatgcttgatctttctgattaacatttgataaaatttacctgcttagaacaagcagcatgaatttcacagctttatgactttggaaaagaatattttagtctcatgaatgtattactgttawaagttttaatttctctctataattgcaaattttaaaaacatataaattcaggcttaatttttattttgcctgtgcccttaagaattgtgatggctggctgggcacggtggctcacgcctgtaatcccagcactttgggaggccaaggcaggcggatcacctgaggtcaagagttcaagaccagcctggccaacgtggtgaaaccccgtctctactaaaaatacaaaaattagccaggcatggtggtgggcacctgtaatcccaggtactcgggaggctgaggcaggagaatcgcttgaac

SEQ ID NO: 19725 - DNA, 601 bp, Human
ataaggacattttcagtactgagagaattttccaagcagatgttctaagctgattcgatgatcatttgcaatgcaaatttccaggaagtaggttgagtgtgatggttcatcgtcactggaagatccatttgcttaaaattattttggcaacctgaccaaagggatagctatgatgcatttggtttgatttaaaaattttagtgtttgaagttaggtagccctgagttcgactcccagctctttcatttgctattgagtcttagagctcattaagcaggaatctatacctaaaacgttgaaraggcgttgccatctttttttttttaaacctgcctctttgtttaccatgtctgtctgtctgtaggaatattgaggaggatgatatattttccactgtttggtctaagaattaaggatgagggaagttaggttcatagaactttgttttggtcctaagtctatgttctctaatattaaataccttccccatctgtcttatttttctttttcattttcatttacccccttctttgtgtatcttttgcttagctgcttctcttctcttgtgtccaaaccccaaagtagcagggatgtgatagac

SEQ ID NO: 19726 - DNA, 601 bp, Human
tgttctctaatattaaataccttccccatctgtcttatttttctttttcattttcatttacccccttctttgtgtatcttttgcttagctgcttctcttctcttgtgtccaaaccccaaagtagcagggatgtgatagacattaaaggtaaagagattcctactgtccttttattttttttttaatccctaacttccactcttgaccttttgtcgtttttgtctagaattgcgtcatttttatctaagatgagttcactgatgtctgtggtttgtgagctctgtattttaatcttgataargacttagttgaatgtgaaagtgcaaagttgctgtcacttttaactaaatgttggtgaaaaaaatccatatgttggctcatttaatgtataaaattgaagagactgccttcacttcaggaagggcaatgtggactatgaatgaagtaaactgttaacatcttgacatttattctgtttgtgtcctcttaagtgactcactcccaagaaacacactcagggtcacattcttcctgtgtcatttaaaaagttttcctttccttggttgggactcctctctaaatcatattcagtttggaagga

SEQ ID NO: 19727 - DNA, 601 bp, Human
ctgtttgtgtcctcttaagtgactcactcccaagaaacacactcagggtcacattcttcctgtgtcatttaaaaagttttcctttccttggttgggactcctctctaaatcatattcagtttggaaggaagcagactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaawacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctg

SEQ ID NO: 19728 - DNA, 601 bp, Human
agactttccttggctttctacgctatggttttgtgttccacacctcttttttttcactcaaactagttcaaactttagttttcaagtggcttttatttaacatttgaagtttttgtttagccacatacagaaagacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggagractgtaagagattgcctggtctggctctctgccttcaagtagatgactgctgaaagttctaaaacaagttcatatccatctcttttgactttgaggaatttgcagccagagatcccacagtctctgcaggatgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagc

SEQ ID NO: 19729 - DNA, 601 bp, Human
agacctttcattgttgatcattttttttgctgtgaatacttaattttaaatctgcaaatgatttcttaaatagtttgtgacccattagaaatgtgcctagcatgaacaagtcacttgtcctttaaaacttttgagaagaaaatgaacataaaatcctaagctgaggaggactgtaagagattgcctggtctggctctctgccttcaagtagatgactgctgaaagttctaaaacaagttcatatccatctcttttgactttgaggaatttgcagccagagatcccacagtctctgcaggawgcctgctctagaggtctatgggacaagacagacctgaggccaaggagctgaatggagggactcccacacgcccatatctcccgtcttttaatttgcctttcccagatgcctcactctgatcttctcttttaggcattcgggggaatctgaagagaggggaaatacagcaaagaaaagaattgaaggagaagagggacaccccagtacatattcaccctgttcctttagtggtgacagataaagagcatatggggaggctgaaataattttattttttaagagaaaatttccctttttatt

SEQ ID NO: 19730 - DNA, 601 bp, Human
tagcccttttaatttcctgacttcctctcatcacctgcctattcttctctggttcataatggtgagaatcatctcatgactgggatacccgatccagcaattaggatgagtgtataatttattgtctaaagtgggacactttggggagtaaagtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatyactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgat

SEQ ID NO: 19731 - DNA, 601 bp, Human
gtactgttaattaactttgctggaataacagacatcacccagaatgttccaggacgtgtagtaaccctacctacaatggataagaaaatccaaaacctaaagcacatcaatggggaggaatagatcctttgtgatggaaatatgtaatcactaattagaagaaaatgtacaacaatcttaggattgtttcagttaacgtaataaagatttactgataatttcttgggactttattgcaaaataagtatcctgaaaaataagcagaatgggaaaaaaattatggagatatacattggtattrgtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaacaacaccttttgccaaggtaagactaactgaattcattgatgtggactcaacagttgttttggctttttagaaacttcagttgtttgccacggcttgctcattcgcccagcctgtcacagtg

SEQ ID NO: 19732 - DNA, 601 bp, Human
aggattgtttcagttaacgtaataaagatttactgataatttcttgggactttattgcaaaataagtatcctgaaaaataagcagaatgggaaaaaaattatggagatatacattggtattggtttcttatattaataaatgaataagtaagtttgctgatgccttaaatggcttcagatatcacttacactagtctaagattgtaagaatttaagtatgtaacaaagcatttcttcccttacagcttatcatggatacaaccaaatgatggaatgcctaccgggttataagcgggttaayaacaccttttgccaaggtaagactaactgaattcattgatgtggactcaacagttgttttggctttttagaaacttcagttgtttgccacggcttgctcattcgcccagcctgtcacagtgaaccacctcatgttcactccttttggctaaggaaatgtaaggaaataagtttaaaatatggttattggaattgctttactaccactgaaacttgatgcaagtttttaatctaaaagagtttggatagaatttaaaagagtttggatcacattagagagcacactgtggtttccatgcta

SEQ ID NO: 19733 - DNA, 601 bp, Human
atggaaccttctctaaaatgcatttttattgtggtgataaaaatataatagctaaaactctgaatagagactaagcacaccgaggaaatatgctttgatgaaaagaaaagagagaattaaaatggacatatcaaacttttttggtacctgagagatgacagtaagtttttccttcataaatacggtattttaagcattctttaggttgaattgaactgtgtcccagcttctgcctttaattattccaaattctgagtcactggactctgatttaatgaggtttcacttctttctcaattgkaagagtctggaaaatagttaccaaggccctgtgttttagattttctaattcagtcctaatttcagatattgtcttgttctttaaacccaccaaaatgaccctaaattatactgttttgccttaaaaatgtttctgagattttcccttgtttctgataagggtaaaaatccttcattaaaccacatgttctaatattggttctgaaagatagtttcaccaaagagatactccctctccgtgtaaattaatccatgtaatcactacagatcatatgccattagagaggaatgcattttaggt

SEQ ID NO: 19734 - DNA, 601 bp, Human
cacacgcacacgcacacacacacacacagacacacacacaggcactcaacacagtggttgctaaatgtttgctctggagagagagaaaaccagccagggatgaagcctgcaggcaaatggaggacaaatgacaacatttgctaggacagcatgaatttaggccatatccagagcatacaaggtgtggctgactctctgaactcctgcacatggttatggccaaggaacaacgggaagcactttctcttcttgaatgcactgaactgagatgaaccccccagaattccttgactgcagccaraggttgcaacaatttcactttctctccttgccgcttgccttggcttagccaagctaaaaggaagaaagcaggcaaatgctggcatttgctgcctctgacctctatgtttgaggcttaggatggtgtaggagcattctccagacatgttgctacctgatttatggggaaaggtggaaattcgaggacttttcagagcaaattcaagaaaagtatcatctttgcaatccaagtaggaagactttctggctttctgaactcctgcaggaacttcagagctccaggatgagtgctgctgagaat

SEQ ID NO: 19735 - DNA, 601 bp, Human
taagctgtaaagggattaaatgctaatgtggaatttcatccaagaaatgattaaggatattacagatgtgggtgggagtgattgcagactagtaaggttagctagacttttaaacccttgctcttttctgaaatcctccctacttttcaacttcttctaagtaccagattaattaatatctgcttaatatttgtcattcacattttaacccatttatgcctggtgttccattattggaatgctgagcttgtgggagttatttatatcctgctcaaggtcatctcagtaggtctgatttttaacacacacacacacacacacacacacacacaacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgatttggtactatacttgggtacagagctatatgcttgttaccagtttgaaa

SEQ ID NO: 19736 - DNA, 601 bp, Human
gagttatttatatcctgctcaaggtcatctcagtaggtctgatttttcacacacacacacacacacacacacacacacaacacacacacatttacaacctccagcataaatgggttaatacattagagtagtatgtctttgaaagtataatgtgagtttattatacaatcctataattaaggccataattaaatataagttgcttaatatatcactgaggaacccgaataatagtatcttagctttttactcttgttttgtaattgaattgccatcaccatgggctgtatggttatgattyggtactatacttgggtacagagctatatgcttgttaccagtttgaaaatttgtcttatgtctgtagccaagagcaaaaaaattactttcctggtggatgtggcattttcagtaggttttatgcttctgaagtgcttttccttttagataaagtatcagaatctttttgccgtaattttagtaacacatcctgcacaaaataggatctgacaaagtactgtttcagtgtacaaacatgtaagagcctacaggcaccctttattatcactcctcagttttattcgattctacagctgcttcc

SEQ ID NO: 19737 - DNA, 601 bp, Human
acttatgagaaaaatcctggtgaatgttgatccagggctttagaactaatatgaaggactgattaatgaaaagcaagtctttaaaaatacaaaggcatcaccaacaccctcacaataacgtttatgattgtgtaatgtataatttgttcagtatattgatgctaatctctaattggctcttcctggcttgtgagattctttttcgtaatttagttagcatatctttttgaaaatattcacggggcttcattaaagattggaatacatcaagaatgcagcacatgctgtcatgtctcttacygaaataagtgacattcttttttaacacttgacaccagaaagcatttcaaacattatataccataaggataaacctttaaccaattaatgaaaatgtttgttttctaacatatggaaagttccacataactgagataaggcataaaatgttgtaccagaaagtattgccttcttcttttaattttaattctgaaagagtttgaaagacttgttcacatcttctccatgtgctccagtagttgaggagtaacagcactgagagttctctgttagtcatgtgtaaaattccctaaaatggcag

SEQ ID NO: 19738 - DNA, 601 bp, Human
ataagaaaaagagacttacaattttggagtgatagcactcgtccagaaagaggttatagtattttgagaccaaaaaatgtataacagatatgcatactttgtgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaamtctaaaaaacccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgta

SEQ ID NO: 19739 - DNA, 601 bp, Human
gagacttacaattttggagtgatagcactcgtccagaaagaggttatagtattttgagaccaaaaaatgtataacagatatgcatactttgtgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaamccccaaaattttcttgtatacttttactgcattttatttggggaggagatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaat

SEQ ID NO: 19740 - DNA, 601 bp, Human
gtattttgagaccaaaaaatgtataacagatatgcatactttgtgtgtacttttgaagctcttagcatctctaaagatcagtcacagcgagtagtttgcaattttgttgattttgaatttagtcctggttgatgtatggaagtaattatttagcttgtaggtgggccagccagcatcctggcagcctcatcacgactcagttcttctgtctttatgattgaatttaataactctcattaaaaatctaaaaaacccccaaaattttcttgtatacttttactgcattttatttggggaggasatagtacgaaaaatgcaatcatagcctttgttgtcttggtacttaaaaaagtctcatgatgttatgtgatggatgaagaaaagaaaggatacccagagatgtgcaaaggtgtggtagaggggacagcaagggtcatgaaagacttggtcagaaaccgaattagggactgctttggaaggcttagagtaccaaactgccattgtaatcagtggggaaataccctgcttctcgactggaccgtatttgttaaatgtagaagtggtgtagattaggaagtctgctgcctcacggtgatggggg

SEQ ID NO: 19741 - DNA, 601 bp, Human
gtgggatctatggatatgaaaaagggtgaacaactgtaagaaaaaagtgtcaatggacggggcttgcaatgaaaaatgaaagagggaggactaaaaggtgactttaaacctggatgggacagattaatgactgtggcactggtagaaatgaagttggaatgagagcctggatggttttggaagggtaggctggaggtatctgtgggatatctaaatggacttaccctgtaagcatttgtgcttgcaaagttggatttatgatgagatatccaggcagactatcttagaaaaagcagaaaakaggtgatacttgaagccaggagaagaggataagaggttaacagaggccagaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttc

SEQ ID NO: 19742 - DNA, 601 bp, Human
agaggagtaagctttctggaagaggacagaaccaagtaactcgatgagtacttgaatgtagtgatatgagctccctggtcacatctggtgtgagtgaagtcacagatccttaactaggctaattgttcagtctgcctgagccctgcacagttgtaaatggaagctgagccacggatgatggactgcttctttgcttgaggtccaggggacaagcgtgggcaccaaaatgtgtgatgaagccccaaatccttctccaagccagcacatttctgttgctctgcctggctaccactgttcagasagctggagttgtaaagttatcagacgtgaggttaaagaaggccatagtaactgactggtttaaaatattttaacttaccatgtgttctttgttatggcacatctgctatatccattatttaatctgcaaactgtggctggtcatcttagtggggcagagccacatgtgaatgaggcaatagtcctcgttgggggttagttttgccctgttgcagaccaaatatggacccctgggccaagacatttacttacaagatcagactttgggcctcagggaaatggctgaagatatgtgcgtgga

SEQ ID NO: 19743 - DNA, 601 bp, Human
gttttgccctgttgcagaccaaatatggacccctgggccaagacatttacttacaagatcagactttgggcctcagggaaatggctgaagatatgtgcgtggattagcaccactgggaaaaatttagggctttccatagtagcaccacatcaaaggttcttttttttttttttttttttgtaatttcacacaattatacatgtaaggtcctatgatatttctttgcctttctaagaatataattaattacataaaaatagtaatatgtgggaaactaaaaataatttccactttcaattcttttttttttcttattctcttttaaaatacaaccatccaggaaataccttcattggatcaagagaaaaccaaacttgagcctggtcaaccccagctgtctccaggcatttccactattcatctgcatccacagtttccaggtagcctgtgttgatctgtgctgtttgtcagagtattctgaataaaaatgtaagacgggaaatttttgtctttgactttgtgtagtaaattactagacttcataactgaagttcagtgttaagtatagtaatatacttatataatgttagcataattacag

SEQ ID NO: 19744 - DNA, 601 bp, Human
acactattcagacattattgaaggttatcatttgatgaacgatcatttttcttggcttccgcatcactctcagatattcttgctaaatgttgaacccagagccttgggacatagaacagttctttatatctgacaaatgctgtgatatattgctagactaaattatgcttgcattttgaaatgggatctcaatgcacataacgggctttaattttctttttatcctctgcttcctcatatagtagtgattgaaaaaacatcacctcctgtgcctgttgaagtagctcctgaagcttctacrtctagtgccagccaagtgattgctcctactcaagtgacaggttggtgcagtatttttacattatatatcacatggaggagacgtggggctgagcttcattttaaatgtagtatccattatataagcttgctcatggcagggttagccatactagcaaatatttggaaatcatctaaatacagttaaaaaggaggagtatgtggaaataaattatagtatatatgaaacagaatatcacatagtattaaaataatgtttgaaaagagtagttaatatcatgaggaaatatggcataatctg

SEQ ID NO: 19745 - DNA, 601 bp, Human
taccagtgagatatacctgtatatgctacgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaagrtgaaataatttccaaaagctttttgggtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcatttt

SEQ ID NO: 19746 - DNA, 601 bp, Human
acgagggctacaggttcagtgaacaacagaggaaatgtgtgggtaagagacaatttgattgactaaattattaaatatcaaacatttgaacattaagaacatttttttcttaaaccaacttaaccattttgggaaagtgttactggtttaattttttgaaagtttatcccttagctaagggagctcaaaaaaaggtttgctaaacaactggaattctcttacctctttgttcaacatttgtttacctcgcaaatgtaatatatttacataaaggtgaaataatttccaaaagctttttggrtaaagtaaacaaaatatgaattacagaaacagctacctaaaaacatgtatttagcaaaaacaaattaacattagtgtatactgcagtaaagaattacattcatttatgtacataagacttgatttttttaaagggattttaaaattgaaaatccatatatgctggcctgaaggtgtcagtcaatttagaaatttagggatctcatatatgctccttttggaaaaaaaaaaagtatctcagaaagatatgcagtagagttaaataaatcattttaatgtgactctaaatttaatttctctt

SEQ ID NO: 19747 - DNA, 601 bp, Human
ttgagaccagcctgaccaacttggagaaaccctgtctctactaaaaatacagaattagccaggcatggtggtgcatgcctgtaatcccagctacttgggaggctgaggcaggagaattgcttaaacccaggaggtggaggttgcagtgagccgagatcacaccattgcactccagcctgggcaacaagagcgaaactccatctcaaaaaaaaaaagaaatcagttacttcgttattatatttgagctaagctgggagatgggagaggtttgaaacagtatttggaacacaaaactcaacartgctatctgctcttcgtagatgttgacgaatgcctgaggccggacgtctgtggggaggggcactgtgtcaatactgtgggggccttccggtgtgaatactgtgacagcgggtaccgcatgactcagagaggccgttgtgagggtgagtcagctgagagtgttcagcacacatgacggtgatgtgcagggttggtaggcaccttgcctggttcttgtttccttcccacactcagtgcgtgacaccagtttatccaagctctttctgcttcctagattcacaggctctttgcctcttccttt

SEQ ID NO: 19748 - DNA, 601 bp, Human
tgacggtgatgtgcagggttggtaggcaccttgcctggttcttgtttccttcccacactcagtgcgtgacaccagtttatccaagctctttctgcttcctagattcacaggctctttgcctcttcctttcactggctcttttgggattattttccatcttcatgctctcattatttttcacctcaatatctgcctctctggtatttggaatgaaatcaccatagaatgattaattgcatcatatttagtagaaacacagacttaattacagagtccggaccattcatctgggaacatgctscaggtgtaaccagtgttgattttttgtttttgaccttttcacctacttacattcctttgtctccaatgctttcttttacatgtgttctggtactttctcacagactccccaagaagcatggtctgacaaactttggtcagattccaactgtgcttaataaaatttcctcattattgaccacagcaatgagctttctctcattataaaaatgttataaaaagtatttatagcatggtcacaattattatccttttcatatttcttttcacgtttgtgtccaagttgctctggttctttttg

SEQ ID NO: 19749 - DNA, 601 bp, Human
aatgtagtgaggccaggcacggtggctcacgcctgcaatcccagtgctttgggaggttgaagcgggtggatcacttgaggccaggagtttgagaccagcctggccaacatgctgaaactccctctctcctaaaaatacaaaaattagctggatgtggtggcgcacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacraagcaaaacaaaacaaaacactatggcactttttttgcaattattttcatgaagaaatacactgaccttctgctaaaaacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctgga

SEQ ID NO: 19750 - DNA, 601 bp, Human
aggccaggagtttgagaccagcctggccaacatgctgaaactccctctctcctaaaaatacaaaaattagctggatgtggtggcgcacgcctgtaatcccagctacctgggaggctgagaaacaagaatcacttgaacctgggaggcagaggttgcagtgagctgagatcatgccactgcattccagcccaggtgacagagaaaaaccttgtctccaaaaaacaaagcaaaacaaaacaaaacactatggcactttttttgcaattattttcatgaagaaatacactgaccttctgctaaraacctgtcatggaaatatgagggtgaaggaacacgggatctgtgagggcacgggagcatggtgctggttccttggggttccctgcctggctgtcagcagagcctaatagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttc

SEQ ID NO: 19751 - DNA, 601 bp, Human
atagatctgggctctgttaggtggggcaggatggactaggttggcacagccagccctcagctgtcccctggcttctgcctgttggttttcttcactgctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtmaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagc

SEQ ID NO: 19752 - DNA, 601 bp, Human
gctctaatgacccaggcctggagggagagctaattagacattttttggcagcctacacttgcccctcctgctggtgtcttgcctctgccccttgggttctaatctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgyagccactgactttgcccctttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaag

SEQ ID NO: 19753 - DNA, 601 bp, Human
ctagagagaagtgggagtgttttatgttgctggatctctgatcagcatggagttttgtaccctccccgagggccacgaggctacagaacaagcacaggtgtaaagtgtctccacgctgctcttccagggaactctcctctgctgaagagatgcagcgtgggagcagctcaccacgcccacagtaactgcctgacctgtagccactgactttgcccctttgaaacgtagtacatcatctgtaaaataggaaccatgaagttaactttccaggttttcatgaaaataacttcatgttgccatracttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttt

SEQ ID NO: 19754 - DNA, 601 bp, Human
ttgaaacgtagtacatcatctgtaaaataggaaccatgaagttaactttccaggttttcatgaaaataacttcatgttgccataacttgtatgatgcctgtcactttgttagttttcaagaagttatagtttctttaaatctccccccatccctgactccttttgtgtttgtatagatctcaagcacctctgtagttgcggggagtgctttaaaaaaatggggtgtttatttgacaagcatttatgtgcagagcagtatcccccaacccccaacaaagaagtcaaatactgatttttttttccctttctttctttctttctttctttctttctttctttctctctctctttctttttttctttctttctttctttttttttttttttttttaaagacagtcttgctctgtcgcccaggctggagtgcagtggtgcgatctcagctcactgcaagctccgcctcccgggttcacatcattctcctgcctcagcctcctgagtagctgggactacaggtgaccgccaccatgcccggctaatttttttttctatttttagtagagacagggtgtcaccgtgttagccaggatggtctcgatct

SEQ ID NO: 19755 - DNA, 601 bp, Human
gagacagggtgtcaccgtgttagccaggatggtctcgatctcctgacctcgtgatctgccagcctcagcctcccaaagtgctgggattacaggtgtgagctactgcacccggcccaaatactgattcttaagttctacacacgggtcaagaatggaaagataagatacttaagtaataggatggaaaggaatagaaaataaattggaaaattatgtacttaaattggaagcttgtaggagaatattcggtgatattcaatatatgaaaattatttgggagaaagatgactagcgttccctsagtaaataatatataattctatccccatgaaaagtcttgaaaagaagaaggagccaagaaacgcggctgttttcaaatttcatcatggactagaaccaaacgtccccgggcttctggcacacagaagattttctcagctgtcactaacgaagttgctttcaaatagcaccagtctccaaggagtctattgtagtttacagacattatctcatgcatccttactttattctgttaaggtattataaggcaggtagttcctaatttatagaagaggggaaaagccgaggtgagagcaggtag

SEQ ID NO: 19756 - DNA, 601 bp, Human
tcttttcacatgtctaatggtatgcagtgggagataatttttaagtatttactagaatgtagacatcacatacccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgytgaactctctcttatatctttttcctcattttattgtttgacaatttttaaaaatgcctcaagctgtcgtagttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattc

SEQ ID NO: 19757 - DNA, 601 bp, Human
cccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtakttatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaattt

SEQ ID NO: 19758 - DNA, 601 bp, Human
ccatggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagwtatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttc

SEQ ID NO: 19759 - DNA, 601 bp, Human
catggatatttagtggacccattatatatttctttctttttttgtttctctagtttatgtcctgaaaatccgtttatattttaagtacgattaaaggtcatatatacattgtgtattgggatacttaaacattaaatccactcatataaattcaagatccacctcagaaaaaacacttatttcaaatgcagctagaagccatggtgttaacacttattttaaactgttgaactctctcttatatctttttcctcattttattgtttgacaatttttaaaaatgcctcaagctgtcgtagtaatctcctcacagacttaaccatattttaggagatttttttctccccaaattggaaagaatgatgattaatgacttcagttagctatgaatatgaaaagtaaggtgtatttttaccagaaaatattaccatatggtcatatcaccgtgttttctggaaaggcttggaagtatgtgatgagttcactctctcctcatgtttttttttttttccacctccaaggaattcctgtcatatgaaaggttttaaattattccaacctaggatattcttgggcccatgaagccaaagtgagaatttcc

SEQ ID NO: 19760 - DNA, 601 bp, Human
gaaaccctgtctctactaaaaatacaaaaattagccgggcttggtggcatgcgcatgtaatcccagctacttaggaggctgagacacaagaatcacttgaacccgagaagcagaggttgcagtgaactgagatcgtgccactgcacaccagcctgagtgacagagcaagactcaaaatagagtctcaatgatgataataataataataataataaatatgtgtacattacgtatacatttttggtggtacactgttgtaatttctccaaggcttccctaattttcctttttatgatttttwaaaaattttttcttatggccaaatctgtggatttttttcttttctgcttacttttacatctaaaagtatgttctagcaaagggtaaaagaggaaataagtaaacattttcttcttaagtgtcttgatgtaagtgaaggatgtagggtgataattaatttctcactatggtaggcaagtagtaaatgaataccctggtatcctgtaagaatcgaggcctcttccactggcagtagggaacatgcaggcatctggatttgatgccttgctccaataatacaacagagcaacagtggatcttg

SEQ ID NO: 19761 - DNA, 601 bp, Human
tttatttatttatttatttatttatttatttattgagatggagtctcgctctgtcgcccaggctggagtgcagtggtgcgatctcggcgcactgcaacctctgcctcccaggttcaagtgattcttctgcctcagcctcctgggcagctgggactacaggcacgtgccatcacacctggctaatttttgtatttttagtagagatggggtttcaccatgttagccagaatggtctcctgaccttgtgatccgcccacctcggcctcccaaagtgctggtattacaagcatcagccattacrcccggccctgccttttcaaaacaaaacaaaacaaaacaaaaacaaaaaactaaacactagactttatttggatttcacaagtttttccagtcacgtcctctttctgttccaggatccaatccaggatactacactgcatttagttgtctagtctccccaatgaatctttccctagttttcatgatcttatctatcttaaagagtataggccagaatcctgtagcttttccccactctggatccatctgatgtttttctcatgattaaactggggtcatgggtttttgggaagaagaacac

SEQ ID NO: 19762 - DNA, 601 bp, Human
ggagatggagctcaggcggtaatgctcgctccctgctgctcacctcctgcagtgccgcccggttcctaacaggccacggacccgtaccggtccatggcccagggattgaggacccctgtgctagggcactaaaaatgtaaactgaccatcagcatctcctctgtcctgattcctggccaagccaagaaggaactgcaccattgattaagtcttgggtaactgatgttcattggagggcatgttcctcgctttgtctcttttaatgtgtaagcattttaacagaagtctaaggtttttattmcaaaaacatccattgcatgaaaagtcaaacaaaagcttttagcaaactcgttcttcattattaatgtatataagatatgactatgttccgtaagaaagcttcttttggaatatataatcaggcccttttaaagtcaggactagtttctctagtgtactgggttataaataggactggagtccatccaactaatttagagctccctttgaaactatgttagcacctcagcctgctaattcccaactagcaatgtttccgaccctccccagtgatatttagccataattaactaaaccgtga

SEQ ID NO: 19763 - DNA, 601 bp, Human
aaatggctgggtgcagtggctcacgcctataatcccagcactttgggagttccgaggcaggtggatcacgaggtcaggagatcgagaccatcttagccaacatggtgaaacctcatctctactaaaaatacaaaaaaaaaagaaaaattatctgggtgtggcggcgtgtgcctgtagtcccaactactcaggaggctgaggcagaaaaatcactcgaacccaggaggcagaggttgcaacgagccaagatcacgccattgcactccagcctgggcaacagagcaagactatgtctcaaaaaatatatatatgataaataagtaaaatatatagttcgttaaatggcaataaattttacagagaaaatagagcggggtatatggggagtgttgaggaagggtggtgattttaaataaagaggcaagtagaggcctcgctgggatgataacacttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaagg

SEQ ID NO: 19764 - DNA, 601 bp, Human
cttaatcatttatgggtagagcattcagttcaagggaatagcagatgcggatgcccgaggaaccagctatgtggagacctgaggggcaccacgtcagcactttccacttttgatgcccaagatgaatatttgaaggaagatatctgaaaggcaattgtatctatgcatttggaatttaggggtgagttctaggccatgaaattaattgggaatgagtgtagctagaagagagataaatcccgggccctccaacatttagaagtgaggaaatgggtaagaaccagcaaaggagattgaggaraaagtggcaagtgaagaaggagaaaacccagaatccaagagaagaaagtgtttcaaggaggagggagtgatggattgtgtcaaatgttattgctaggtaacagaagaaccaaaagttaaccatgggatttttagcaagctggaagtagttggtgacctcaacaagctcagtcttggtagaaagatgacagtgattcactgttcctgcccttaaaaccttttactctacttctaggaaaaatatatattttcgcactaccccaggtggtggtacgaaatagtaccatgttgtgctctcgta

SEQ ID NO: 19765 - DNA, 601 bp, Human
agcgagactccatctcaaaaacaaaacaaaacataactgattgtctactttacacccattaaaatagttgtagagctgtcagagtaaatgtggaacaatcggagttctcatatgtttcctgtgggaatgtaattgctacagccacttcagataacagttgttcaaaacttaaatataacctaattccatgacccatgcatcgttttcctgggtatttactcaaaaaaggtaaaatcatatgttcacacaaagacttatgattttagaaatatttatagaaaccttattcacaatggcccaratggaaacaacccaaaatgcttatcaaaaggtgaatgagtaaacaaattatggtgcattcatccaatggaattctacccagcaataaagcccagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgta

SEQ ID NO: 19766 - DNA, 601 bp, Human
aataaagcccagagaactactgatacacacagcaacttgggtgaatctcaaaactattatgccgagaggaagaagccccaaagcacaaaaggagtgagagggaatgtattggggatggaaatgcctgttccttgactgggatggtggtcacaaggatgtgtatacatttgtcaaaactcattgagctgactcttaagtagatcaatttattttatgtacattatacttcagtaaagctagaaaaacacattaaagaaaaagttgagaacctgccttagttgagacaaattcacatcacctrtgttttatgttttagggtcagtacccggaagcattttaattctgggtgaacagtcattataataacgtggttttatttgatagaaagaagtgataaggcactctcttatttctcttttgtttgccctgtgaatagtacagaagcctgttaattggttgattggattctaggagaaaaatgaaattcggtatcaccgtacttgaaccagacagccgggcgtattagacagatggcaacagtctccatattcacttcttcctggaatctctcatattttggcagcaattacaattatttgca

SEQ ID NO: 19767 - DNA, 601 bp, Human
acccggcaaatttttgtatttttactggagacgggggtttcaccaccttggccaggctggtgttgaacacctgacctcgtgatccacccgctttggcctccaaaatgctgggattacaggcatgagccactgcacctggctcaccattgctttttctcttcctaaaaagcctcactaataatttggtcaaaatcatgaagaagaggatcttatattttttcaatgtgctgtcatgtttaatcttccaaactgtacagtgcatgaagggtactaatgaaaacacagcaacacaacacaggtrctaataataacaatcacagcagctgtaactgagcttcttcagtgtgctgagtactgtaggtatcttggtatctcttcgaattcttacagcaacttcagaggtagcttttcttgtattcattttgtgcatgagtaactgaggctccgagaagttagggagtatgctgctctctaatgagtggtaaagttgagatttgaacccagggtcttttcccactactcttccctacattgccataccaattattgttacatttatagccaaaagaaagaagaaagtgaaattaagtgatttctctca

SEQ ID NO: 19768 - DNA, 601 bp, Human
ttaaaagtatattttcttttctaattcttctcgtcacaatttgttttggccaaatacaggcaaaaccaaatcttaataaaaatggaccaagatttcatattgcataaatttaacttctagagttcagtcacacggaactaatttagttatctgattcattaattgcactacttcattctctcaatatattaaatttgtgtctgtggtttgatatcacctctcaaatatgtgactactccaaacatagagagttttattgactatcaatcattattaaattgacttcgttctctgtcacatwtattcctattttccagaataagttaatatgtctgaaaaatgtaaatccaaataaatgagaagcatttctgaagtaggtcttagtactgtttaaagaatagtgtctgtgaatctgttttatcacccaccacctcctgttagaagctgtatatgatggcatgtatatactcacctcgttttgaattatcccttttcgctctttcactagaggcagttttgtgatctttcactctgcctgaagttagtagcctacttttctctaatcccttgatcatgtcagcattctgtggagaggtgtaga

SEQ ID NO: 19769 - DNA, 601 bp, Human
ttaatagtagttattgctttttgacgcttcattgtgtggtaggcactgccctgagccctcattcgctgatttcatcatcggaaaccatgcaaatacgaattttcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgaraggctgaggagagaggattacctgtgccctggagtttgagactgcagtgagccatgatcatgcactgcactgcagcctgggcaaaagagtgagaccctgtctctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcagga

SEQ ID NO: 19770 - DNA, 601 bp, Human
tcatggtctaaaagtccttctcagccaagcatggtggctcacctctgtaattgcggcactttggaaggcggagacaggaggatcacttgaggccaggagttccagaccagcctgggcatcatagtgagaccccatctctgccaaaaatttaaaaaatttgccaggcatggggccagtaccttagtgccagccactcgagaggctgaggagagaggattacctgtgccctggagtttgagactgcagtgagccatgatcatgcactgcactgcagcctgggcaaaagagtgagaccctgtcyctaaaataactaaacaggccttcttttacttgtattttatttctattacccatttccaatgagttatagattggagtctatttcatttatatattcagcagacatttgtgaagtgccatttatgagccaaatactataaataagacatgtctagccttgcccttaagaagcccacatcctagggatggataggcaggaatgtaacaaggtactacagactataacagctgtgtgcatggcaatgggagagggcaaagaaggacagcattctcaccaatgaagagcatctctcagagttgt

SEQ ID NO: 19771 - DNA, 601 bp, Human
cagctgtgtgcatggcaatgggagagggcaaagaaggacagcattctcaccaatgaagagcatctctcagagttgtggagtattcctcaagccccatatgtctaaaataagggtagctttgggttgaacctatgaaattgctttttttgcaggtcaaaaatgattgtacattggctatttcctaactcaacctaaatagtttctctctcataactcagcttgtcctgtggttgatttatggacaaatggtatagttgttccactaaataaatgtccagccatgtcataatagatttatttrccatctgtttgatagtatatgggaatgaaaccgatttttttcaagtttttaagactctattttaaattacagatattaatgaatgtgaacatccagggctctgtggtccgcaaggggagtgcctaaacacagagggttctttccattgtgtctgccagcagggtttctcaatctctgcagatggccgtacgtgtgaaggtaagataaaccatacgaaatcatattgttgtgtgataaaagagagaggagattgctttcacttatacaaagacttgaagacactaagaggtactgcataat

SEQ ID NO: 19772 - DNA, 601 bp, Human
gcaagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaattwtaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcc

SEQ ID NO: 19773 - DNA, 601 bp, Human
caagggtgtgtgggtgagtttttagattttttcccaacgtgtttcacatgtccctagggaaaagaaatcacagtgaacaacaggagcttttaagcaggtaatttgggtagagctttatcgtaatttgattttgtcatacaatttgaggatgtgcaaaaatatcctatgttggctgggtgcatggctcacggttgtaaccccagcactttgggaggccaaggttggagaattgcttgagaccaggagtttgagaccagcctgggtagcatggtgagatcttttctctatgaataaaaatttwaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactccc

SEQ ID NO: 19774 - DNA, 601 bp, Human
atcctatgttggctgggtgcatggctcacggttgtaaccccagcactttgggaggccaaggttggagaattgcttgagaccaggagtttgagaccagcctgggtagcatggtgagatcttttctctatgaataaaaattttaaaaaaaaaattagccaggcttgatggtggatgcctgtagtcccaactacttgggaggccgaggtgggaggatctcatgtgcccaggagtttgaggctgcaataagccgtgatcatgccactgcacggcagcttgggcaacagagaaagaccctgtctcaaaaaaaaaaaaaaaaaatcctatggcttctgaaattgttagggacattaagaaatataaaagtatgactttacatttaaatgaattttaacaagaacatctgtttaaactctaactgagtatgcagaactctagactcccttcagcacaggaaatagagtctggtgtgtggtatagattgtctgtctttgaaatgcatccccttagacagtgcgtttaaggcaaagtattgccaggagcttcagtgtccaggaatgatacctgtaaaaggatgctttgaattgtgcaactgtatttcctc

SEQ ID NO: 19775 - DNA, 601 bp, Human
ttggagcctgctgcaaaaatgattgtgttgggtagatagtaacatagacggaggctgagtgaggtttcttatcgcctttatggttcaccatctctgttacctttagggagagcagtacttctaaaactggaatttgcttgagcagagaataggcaaacatttgccctttataagggccaggtagtatttttttttttttcttttttgagacagagtcttcctctcttgcataggctggagtgcaacggtgcaatcttggctcactgcaacctccacttcctgggttcaagtgattgtcctrcctcagcctcctgagtagccctgggattataggcatgcaccaccatgcccgactaatttttgcatttttagtagagatggagtttcaccacgttggccagggtggtcttgaactcctaaccttgtgatccacctgccttggccttccaaagtgctgggattaaaggtgtgagacaccgcaccgagcccagatggtaaaatttgtaggctttgcaggtcatgtggtttctgttgtaggtattcaactctactgtagtttcacaaaagcagccctagatagcacagcagcaaatgggcgtgg

SEQ ID NO: 19776 - DNA, 601 bp, Human
tgcttgagcagagaataggcaaacatttgccctttataagggccaggtagtatttttttttttttcttttttgagacagagtcttcctctcttgcataggctggagtgcaacggtgcaatcttggctcactgcaacctccacttcctgggttcaagtgattgtcctacctcagcctcctgagtagccctgggattataggcatgcaccaccatgcccgactaatttttgcatttttagtagagatggagtttcaccacgttggccagggtggtcttgaactcctaaccttgtgatccaccwgccttggccttccaaagtgctgggattaaaggtgtgagacaccgcaccgagcccagatggtaaaatttgtaggctttgcaggtcatgtggtttctgttgtaggtattcaactctactgtagtttcacaaaagcagccctagatagcacagcagcaaatgggcgtggctgggtttatttacaaaaataggtagcaggccagatttggaccagagactgtagtgtcctgacctgttttagagtcctgcagaagtattttggggagcctgcctgatgtgtggggagtttcaagttttactttt

SEQ ID NO: 19777 - DNA, 601 bp, Human
tgaccaaatttgtcttcatgttgacctcaggcactttagtcattgttgaaacttcttttttgttgtagttaagagaagtaacaagtaagtctttatttccttgtttagaaaaaaaaaaaaaaaagctggctaagttggttgctttttggtgatcaaggagaccaaactccatatccttgtccaattcctccaagttagaccttattgccctccataagcaatgatattttgctgcctgctgccccctgcagttccactggagaattacttcaaaggccagatagaaagttctagccatatwttttttttttttttgaagctactttgtggtactattgggaagagacaggagatgagaggccacatgacagtgtgttgggtcactgtggatttatgtttagaactttcctctgcaaaatgagagctaaacactcttgatgcctggctaaattgtttttacatcacaaaaactctaaagtctagctctgacttggtttcaagagatctaaactataaaaagagccaaacaagagtttctttgtttccttaaaaaaaaacttttggttctgtttttttttggtgtgtgtgtgtgttttgtttt

SEQ ID NO: 19778 - DNA, 601 bp, Human
ctaaatgggtctcatgtagaaggaggtctgtgaatgttatggaaggctttagacaggctgtatggagaggcctctgcgtaggtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcaccttcgtcttgtctgtgaytgaagcaatgacgagaaagcttccttggggtggtcgggggaagggcctcaggtaagcctcaggttatgtgtcctcacagagcaatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctg

SEQ ID NO: 19779 - DNA, 601 bp, Human
gtatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcaccttcgtcttgtctgtgactgaagcaatgacgagaaagcttccttggggtggtcgggggaagggcctcaggtaagcctcaggttatgtgtcctcacagarcaatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgag

SEQ ID NO: 19780 - DNA, 601 bp, Human
tatctggttcctcttgacaaatctagcagttcctccatacctatgggaaggaatttggaagtaatatagttcctccaacttccttgaggttctactagaaaatgtcaagctcacaaaatgctcatgttttgctagataacagtgaaagaagttctagaacctccctgataatctgcctctttaagatctcaaaaaagtcaccttcgtcttgtctgtgactgaagcaatgacgagaaagcttccttggggtggtcgggggaagggcctcaggtaagcctcaggttatgtgtcctcacagagyaatatccaagattgtttacctgcatggcttgacttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgaga

SEQ ID NO: 19781 - DNA, 601 bp, Human
acttattgcagatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacrgaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttctttt

SEQ ID NO: 19782 - DNA, 601 bp, Human
taaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacggaaacagcatggarttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgtttttttactattgcttgattaaatttggcatttaaatagtggtggaaatattttatataattttcattttttggttgtgcagttccttggctactgtttttcttttacttcagtttttta

SEQ ID NO: 19783 - DNA, 601 bp, Human
cactgggagcctgaggtcctcaccttcctctcagtaactacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgtwgtcttagctactcaggaggctgaggcaggagaatcgcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatg

SEQ ID NO: 19784 - DNA, 601 bp, Human
actacagagaggacgtttccctgtttagggaaagaaaaaacatcttcagatcataggtcctaaaaatacgggcaagctcttaactatttaaaaatgaaattacaggcccgggcacggtggctcacacctgtaatcccagcactttgggaggctgaggcaggcagatcatgaggtcaagagatcgagaccagcctggccaacgtggtgaaaccccatctctactaaaaatacaaaaattagccgggtgtggtggcgcgcgcctgttgtcttagctactcaggaggctgaggcaggagaatcrcttgaaaacaggaggtggaggttgcagtgagccgagatcacgccactgcactccagcctggtgacagcgtgagactctttaaaaaaagaaattaaaagagttgagacaaacgtttcctacattcttttccatgtgtaaaatcatgaaaaagcctgtcaccggacttgcattggatgagatgagtcagaccaaaacagtggccacccgtcttcctcctgtgagcctaagtgcagccgtgctagctgcgcaccgtggctaaggatgacgtctgtgttcctgtccatcactgatgctgctggc

SEQ ID NO: 19785 - DNA, 601 bp, Human
ttacactatatataatacatactgtatacatacatatacacacattgtgtatacatacatatacacacattgtgtatacatacatatacacactatatatacatatacacactgtatatgtatatgtatatacacacacaaattcatatatgacttttctcagaattgatcatttaaaattttttatctctagagattttcattaaattgaactttgagtttggttaccagttttgttttttcccttagtttggaatttccttatgaacaactattttaggtagagaaggaattatttcaratacccttatttaatgttacttgtataaagaaactatttgcaaaatatgcatccaacaagagcttaatatccaaggaactcaaacaatcaacaacaaaacccaaatccatcaaaaggtaggcaaaagataggaatagatatttttcaaaagaaaacatacagtggccaacaagtatgtgaaaaaatggtcaacatcactctaatcatcagagaaatgcaaacgaaacctgccatgagatattgtctccccgcagtcagaatggctgttattaaaaagttaaaaaaggctgggcatggtgg

SEQ ID NO: 19786 - DNA, 601 bp, Human
agctagttgagaggctgaggcaggagaattgcttgaacctaggaagtggaggttgcagtgggccgagattgcaccactgcactccagcctgggcaacagagtaagactctgtctcaaaaaaaaaaaaaaaaaaaaaaagaaatctgctaagttcgtttctatccctcactttccctgcaagctcttcttcccctttctgggcaacatgtccttttctgctttaggcactccatgcccactttatttttcatgtttgccccttttttgaaaggaagaatctaatatcacttcagctttctgwttggccagttccacttccaaaaatttatttgtttatgtaaacattttcagttttgtggtttctgatgatgtaatagaagaaattacggagacaggcaagcagaagggatggtttgcttttggagagggcagaggaaaccttgaaaccatactgattctgaggtctttcttagggaaggtaagtctattcataggaggaggtcagaagggaatcatcaaatccaattccccagtttctatttaattttattttattagagacagggtcttgctcggttgctgaggctggagtgcagtgata

SEQ ID NO: 19787 - DNA, 601 bp, Human
aggttgactcatttacaccatttcgcaaaggtaagaaaaagttgctagctgaattatattctttagtaaatattaccagagcagttcactttccaagccattcatttgcatgatgcaaaatctaacatcttttaaaaagaacaaaaattcccttaaacctatatcttcttcctgctatggctccatttgtcctactttccctgtagtagtggttctcaaagagtgatcctcaaggccctttcagggggctgtaaagacaaagctatatttatgacaaatctaagacttagttgcctttttwatttttgttctttcttgtattcacagtggagttttccagaggaggctgtttgatgtgtgatgtggtgatatggtcactgatttaacatagaattcaatgtgaaattcatctgccttctttattaatccaaacattcaaaagatttggaaaaaaaatgtaaaacagcaccactctgaagtttctatgttccttttggcaaatgtttgttaccataaaataggtttatcattgttatttctttctttttttttttgagacagagttttgttcttgttgcccaggctggagtgcaatggcaca

SEQ ID NO: 19788 - DNA, 601 bp, Human
agcaacagagctagaccatatctcaaaaaaaagtggggatcctgagaccaaaaggtttgagaaccactgccctgtaccaagaatgatctgtactccctttctatactaatcttccaattccctgtcagccctctccattcaaattctgttcctcctcacttaaaaccactctttttggccaggcgcggtggctcacgcctgtaatcccagcactttgggaggccaaggcgggcagatcacgaggtcaggagatcgagaccatcctggctaacacggtgaaaccctgtctctactaaaaatmcaaaaaaaaaaaaaaaaaaactagccgggcatggtggcgggagcctgtagtcccagctactcgggaggctgaggcaggagaatgacatgaacccgggaggcggagcttgcagtgagccgagatcgtgccactgcactccagcctgggcgacagagcgagactccgtctcaaaaaaaaaaaataaataaaccactcttctcaaggtcacagcagcctccacaatgccaagcaaattcccagtcctcttctggcttcatccctctgtagcatagatgtggtcatcactcagtttttccttta

SEQ ID NO: 19789 - DNA, 601 bp, Human
aggctccgtcttagaaaaaaaaaaaagttcaaatattttgtaatgacaaaacttttcatttgttcagaatccacatgaagcaggaggtagctgaactatgagttctgcaagtgggaagaaaaggtggggaagtagttgctagtagacaagttattgttcaagaaagcatacctttgtaagtggaatgttaaaatatgaaagtatcctgatacatttagtaacatctttccaataattaaggtcaagggcaggagctgggatttgtttattttaattgtaaatttcatatgcttttttttttaatcaaacattacggaagggtttaaagtgaagtcttcttctcccttcttatccccaattccattcactagagataagcattgcttagcagtttgtgtatatcctttcacaacttttttcaggatttatgtaagcatatacacagacccacagtttcttgggttttgttttttaaaattacaaaataaaatcttactagaagtattttacagcttgcttacttaacccagtgtgttggggatattctatatcactcaatacagatctattacgttcttcatttgatcttagccatctattg

SEQ ID NO: 19790 - DNA, 601 bp, Human
ttttgtaatgacaaaacttttcatttgttcagaatccacatgaagcaggaggtagctgaactatgagttctgcaagtgggaagaaaaggtggggaagtagttgctagtagacaagttattgttcaagaaagcatacctttgtaagtggaatgttaaaatatgaaagtatcctgatacatttagtaacatctttccaataattaaggtcaagggcaggagctgggatttgtttattttaattgtaaatttcatatgcttttttttttaatcaaacattacggaagggtttaaagtgaagtcktcttctcccttcttatccccaattccattcactagagataagcattgcttagcagtttgtgtatatcctttcacaacttttttcaggatttatgtaagcatatacacagacccacagtttcttgggttttgttttttaaaattacaaaataaaatcttactagaagtattttacagcttgcttacttaacccagtgtgttggggatattctatatcactcaatacagatctattacgttcttcatttgatcttagccatctattgcattctttcttttttacttatttatttatttattt

SEQ ID NO: 19791 - DNA, 601 bp, Human
tgctttacctcttggagactttgcttcctcttctctgaagtggtggtaatcataacaactaaatttttcaaaaggatgtttataaggtttaaaaggaagtaacaaatatgaaaatacctagcacattgctggacaagtagtagagattcaataaattgtagttgccatcttaacctatactggataatatatcaataattgttactatagaaactcttattgaatacttatatgtaaggtactatgctaagtattgtacatgaattgtctcagtcattcttcaaaacaaccctgccggatkatgtgattggttacattgctgtttggcaaatacttgggacggtgacttcttccctgcaccaccagaccgtagatgctggagcccaagtagatgtgctgagaacagaggccttaagtgtgcttgcagggtttggcttggctcttgcactgctcctatttgccaggaagaaaatgtattccacatagtctctggtccaaggaggattagaggctgctggagctgacctaaaccccatgcacagcctccgtgggagctgcccagccagtctgtagacttgtgagtgagaaactacataatcgt

SEQ ID NO: 19792 - DNA, 601 bp, Human
tagaatctgttcctgggaaaccatgtgctcatctagggtgggttttgtgaatttgagcaagtcactaagggcaggtaagcaagtacccttggctgtaaaccaccccatagaggtgttaggagcaaaggagttaaaccataagaaccttaccactctaaaaatgctccgtaaatattaacaattttactattatacccctgagtttttaaatgtcattcctgtgtactgtaatattcatagctattatttaaaatagacttaaaaactagttacaatagctaataatttctcaattgtgctkcttctggatatatatgtgttggatacaaacatttttattatttcaaaaaaaaaaagtcatgatcccagagtccgcccgctcctgtcctttcccgtgttcttccccgcctaccccgatggcacagtgtacctttcttaggtactcttcaaagactcaccacagaaggtactaagatatgagtgacctcactaatgatgcttttaaacattataaggcaattagtatgttcttaggcgactttttaatatgcatgccagaagataggttttctcagtaatggatgtaagaaactaaagctat

SEQ ID NO: 19793 - DNA, 601 bp, Human
gcaagtacccttggctgtaaaccaccccatagaggtgttaggagcaaaggagttaaaccataagaaccttaccactctaaaaatgctccgtaaatattaacaattttactattatacccctgagtttttaaatgtcattcctgtgtactgtaatattcatagctattatttaaaatagacttaaaaactagttacaatagctaataatttctcaattgtgctgcttctggatatatatgtgttggatacaaacatttttattatttcaaaaaaaaaaagtcatgatcccagagtccgcccrctcctgtcctttcccgtgttcttccccgcctaccccgatggcacagtgtacctttcttaggtactcttcaaagactcaccacagaaggtactaagatatgagtgacctcactaatgatgcttttaaacattataaggcaattagtatgttcttaggcgactttttaatatgcatgccagaagataggttttctcagtaatggatgtaagaaactaaagctattacaactagaaaaggaatttttattattttaaataattgatttctactctttccctttttttaaattagtatttctct

SEQ ID NO: 19794 - DNA, 601 bp, Human
tgtcgaattctggggtccaagtgaaatgcagaagttacagaaagagctggggcaggcccagcaccagaaaagtggtggaagcttctggaatctcctctccttggtgtctctggggagtgccttgacagacagcagctaagacagagccactggcctgaggccctgcgtccccgctgggcctgtctggagccttttccttcctgtgatcctgcaaaccttcctagttctcatggacacagtcacctgacaaatgcctgtgaacagactgccaatctaggcaggaccctcctgaagagcggtscattctctagggcctcagggctccttttagggaggagcctgagttaactttaattcaggattctgcagggcacagttggcaaactccggccctgagggccaaatctggcccactgcctgtttttgtaaataaagttttattggcacacagccacacccatttggttgcatatcatttatggctgcttttgcgatacaatggcagaattgagtggttgttccagagactgcctggaccacaaacccccaaaaatgtataatttggccttttctggaaacagtttgctaaccatgcttctag

SEQ ID NO: 19795 - DNA, 601 bp, Human
caaatgtcgaattctggggtccaagtgaaatgcagaagttacagaaagagctggggcaggcccagcaccagaaaagtggtggaagcttctggaatctcctctccttggtgtctctggggagtgccttgacagacagcagctaagacagagccactggcctgaggccctgcgtccccgctgggcctgtctggagccttttccttcctgtgatcctgcaaaccttcctagttctcatggacacagtcacctgacaaatgcctgtgaacagactgccaatctaggcaggaccctcctgaagagsggtgcattctctagggcctcagggctccttttagggaggagcctgagttaactttaattcaggattctgcagggcacagttggcaaactccggccctgagggccaaatctggcccactgcctgtttttgtaaataaagttttattggcacacagccacacccatttggttgcatatcatttatggctgcttttgcgatacaatggcagaattgagtggttgttccagagactgcctggaccacaaacccccaaaaatgtataatttggccttttctggaaacagtttgctaaccatgctt

SEQ ID NO: 19796 - DNA, 601 bp, Human
agctgcaggatggggctgacctgcccctccttggaccactgagcatggtatgcacttgtccaacgcaccacccccagaatcacaagttccaggggttaacatctgttgggtgatgccccaggggtggaagtcaaatgtcgaattctggggtccaagtgaaatgcagaagttacagaaagagctggggcaggcccagcaccagaaaagtggtggaagcttctggaatctcctctccttggtgtctctggggagtgccttgacagacagcagctaagacagagccactggcctgaggccctgsgtccccgctgggcctgtctggagccttttccttcctgtgatcctgcaaaccttcctagttctcatggacacagtcacctgacaaatgcctgtgaacagactgccaatctaggcaggaccctcctgaagagcggtgcattctctagggcctcagggctccttttagggaggagcctgagttaactttaattcaggattctgcagggcacagttggcaaactccggccctgagggccaaatctggcccactgcctgtttttgtaaataaagttttattggcacacagccacacccatttggt

SEQ ID NO: 19797 - DNA, 601 bp, Human
tattgcctttatgaacatttagtaccaaatgacaatgttcccgcccacagtcggcacgcctagaaagacactgaggagacagtaatgtacagacgacatattccaaacgggcccacacagttcagggagctgcgactgatccccagagctctgctagcgtgtctgtgcgccctggctcctctgtatacgtgggggcgggaccaggagaatgacaacgctcctccagtgcagtggaaactagagttgtggacagaggcccagccttggctcacaggactgtccctggtttctgttttttttktttgtttgtttgtttgtttttttgcgacagggtctccctctgtagctcaagctggcgtgcaggctgcagtgcacagggggctgagcagattagactctacatggccccaacaccccccgtgggtggccctggtgccccttccctggcagagaggaggggagagaatgtgatggtctgaacagagtgggaaggagcggcatgcctggagagatggggcaatggggggaccccagcacacccccgctgccctgccctcccctctctgaaacatcagttcagagcctcggctgacaggccccg

SEQ ID NO: 19798 - DNA, 601 bp, Human
cttctattgcctttatgaacatttagtaccaaatgacaatgttcccgcccacagtcggcacgcctagaaagacactgaggagacagtaatgtacagacgacatattccaaacgggcccacacagttcagggagctgcgactgatccccagagctctgctagcgtgtctgtgcgccctggctcctctgtatacgtgggggcgggaccaggagaatgacaacgctcctccagtgcagtggaaactagagttgtggacagaggcccagccttggctcacaggactgtccctggtttctgttttktttttttgtttgtttgtttgtttttttgcgacagggtctccctctgtagctcaagctggcgtgcaggctgcagtgcacagggggctgagcagattagactctacatggccccaacaccccccgtgggtggccctggtgccccttccctggcagagaggaggggagagaatgtgatggtctgaacagagtgggaaggagcggcatgcctggagagatggggcaatggggggaccccagcacacccccgctgccctgccctcccctctctgaaacatcagttcagagcctcggctgacaggc

SEQ ID NO: 19799 - DNA, 601 bp, Human
ccatcagtcaggcgtgatcatagctcactgcagcctccaactcctgggctcatgcgatcctcccaccttggcctcctgattacctgggagggactctaggcacttgtcaccatgtctggctaattttaaaattttttgtagagatattgcccagtttcctaatagcattttaacagtatttagtgaacacatcgccaaaagcataagggagaggaatttgcttgatgcctccccaggtggcaaaggctggagtcagggagagggttccgggtgtggcccgcgggagaagcacgcacatggytccattggtgtagacggcgtctcccccttccacgtactgcacctgggcaggatacacgtgctgcaccggctgcacctgaaacatcggatacgctgcgttaccgccagtcacgccctcgtgagttgcctgcagattattcaagctagacgtgtcttctattgcctttatgaacatttagtaccaaatgacaatgttcccgcccacagtcggcacgcctagaaagacactgaggagacagtaatgtacagacgacatattccaaacgggcccacacagttcagggagctgcgactgatcccc

SEQ ID NO: 19800 - DNA, 601 bp, Human
atcttttctaaaagtaaaaagtacaaaagtctgtgatttctgaaatctccacagggttatgatgtcctaatccctcagctcccaccccgctccttttttttttggacagggtgttgctccatcagtcaggcgtgatcatagctcactgcagcctccaactcctgggctcatgcgatcctcccaccttggcctcctgattacctgggagggactctaggcacttgtcaccatgtctggctaattttaaaattttttgtagagatattgcccagtttcctaatagcattttaacagtatttagtgaacacatcgccaaaagcataagggagaggaatttgcttgatgcctccccaggtggcaaaggctggagtcagggagagggttccgggtgtggcccgcgggagaagcacgcacatggctccattggtgtagacggcgtctcccccttccacgtactgcacctgggcaggatacacgtgctgcaccggctgcacctgaaacatcggatacgctgcgttaccgccagtcacgccctcgtgagttgcctgcagattattcaagctagacgtgtcttctattgcctttatgaacatttagtacc

SEQ ID NO: 19801 - DNA, 601 bp, Human
tggagcagttctgtatcttgacggtggtattgttacacaaatctacacatgggctaaaaatgcaaagaaatagacacgcacgcacatgcaagggtacacacatgaacatgcaaagccacatgtactccacatgcaagcacacacgcaaaagcacgtgcatacagactggtagaactgaataaggcctgtgggctagttaacagttttaccccaatgtcaatttccaggggtttttttgttttgtttttttgagacagggtctccttctgtagcccagacttgagtgcagtggcaaaatcayagctcactgcagcctcagcctcctgagctcaagtgatcctcctgcttcagcctcagaatatgggtgtgcaccgccacagtagctggggtgatgggtgtgcaccgccacagtggctggggttagaatcatacaactccaccaatcacaaccctgaagtcacagccaggttctcatgtacagcccctgcacttgtgaggggagccatccaggccaaatggaaacagacaagcaggcgaaaggactcacgtctaaagtaaagtgagctgcacgggagatgcatactttcctaccccaagcatc

SEQ ID NO: 19802 - DNA, 601 bp, Human
gagaccagcctgggcaacatagagagaaccatctctacaaaaaataaaagatttagccaggtgtggtggtgcgtgccggtagtcccagctactcaggaggctgaggtgggaggactgcttgagcccaggactttgaggttacagtgagctgtgactgcaccattgcactttagcctgggcaacagagcaagaccctatctcttaaaaaaaataaatacaaataaaacttaaaattgtaagtggataaatgggtcacatgagggagctcctgtgtggagatggagcagttctgtatcttgayggtggtattgttacacaaatctacacatgggctaaaaatgcaaagaaatagacacgcacgcacatgcaagggtacacacatgaacatgcaaagccacatgtactccacatgcaagcacacacgcaaaagcacgtgcatacagactggtagaactgaataaggcctgtgggctagttaacagttttaccccaatgtcaatttccaggggtttttttgttttgtttttttgagacagggtctccttctgtagcccagacttgagtgcagtggcaaaatcatagctcactgcagcctcagcct

SEQ ID NO: 19803 - DNA, 601 bp, Human
ttgatgaacttctgggaggagaatggggttagaaccgaagtatggcttgcagactctgttcagggtctacgcctcaccagcaggctgggagccacttatgcaccgggccttcccatccctcggtgctggagcccacacctggcggcacgtcagactgcggcaagcatcacaggtcagttccgtgaaaccgaccacgagggtccagccgctccaaccacactcgcccacctcccctgctcttgagggctcgggtaccttcatgccaggaaaggcagcagctggacggagtcacctttctggyttgggcatgttctgcagtctgctttgtctgctgatatttgcattctttctgtgtcaatatcaaacacaaataagcagaacgctttccaaggaaatgtacatgtgtacccacatttgccacaatctgtcaggacagcacacttcttgatgaaatggatcaaatcattccttttaaggaaaaaaaatcccgaaatgccagcgcctccctctccccggccccccaacaaaggcctgtggttctgggctctttgcaggcacagcccctgtggacagatatcctcacctgccggtgggaaggcag

SEQ ID NO: 19804 - DNA, 601 bp, Human
atctcggggagaaggccagccacggtgtccctgcagtgacctcctggagatgggcctgaccccacctcaatctctgccgaagactcaacccaggagggttctgtttgggctcaaaaaagatcataaacgacatggaagccactgagtgtgtacagagcccacctgaatcatgacatgccagtgagccttccttggccgccccccacccccctgccctccctcatggcaggctctgagttagggccttcccggggcagagatggcaccaccactaagccagctggggaagaacgctgtcccytgagcagcccccagggaagaggccaagactgcctcatgttggggaaccagaagcaccccaaaagctccaggcaagaaggaagaaagcccagatagcaggcaaatcctggtgcaccctgagtagagaatatctagcgttctttctttttttttttctttaattttaaaggcagagtctcgctctgtcacccaggttggagagtagtggcgtgatcatggctcactgcagcctcgaacttctgggctcaagtgatcctcctgcctcagcctcctgagtaggtgggaccacaggagcttgcta

SEQ ID NO: 19805 - DNA, 601 bp, Human
ttttggtagagatggggtttcgccatgttggccaagttggtctcaaactcccaacctcaagtgatctgcctgccttggcttctcaaagtgctgggatggcaggcgtgagccaccgtgcccagtacagtcagggaatttctaagcatcagttttctcaggtagaaaatggagaggatattgtcacctcccaggaacattaaatatgcagacacagagaaagccctgagcccaggccctggcacacagcaagtacccacagagccagctcagggcagcacatctcggggagaaggccagccayggtgtccctgcagtgacctcctggagatgggcctgaccccacctcaatctctgccgaagactcaacccaggagggttctgtttgggctcaaaaaagatcataaacgacatggaagccactgagtgtgtacagagcccacctgaatcatgacatgccagtgagccttccttggccgccccccacccccctgccctccctcatggcaggctctgagttagggccttcccggggcagagatggcaccaccactaagccagctggggaagaacgctgtcccctgagcagcccccagggaagagg

SEQ ID NO: 19806 - DNA, 601 bp, Human
ttttctttttcttttttttttttttggagacagggccttgctctgttgcccaggctggagtgcagtggcacgatctcggttcactgcaacctccagctcctgggatcaagcgattcttctgcttcaaccgcccgagtaactgggattacaggtgggcgccacgatgccagctaatttttgcattttttagtagagacaggatttcgccttgttttggccaggctggtctcgaactcctgacctcaggtgatctgcccacctcggcctcccagaatgctgggattacaggcgtgagccaccrtgcccggccattttttttttttttttttttgagatggagtctcgctctgtcacccaggctggagtgcagtggcacgatcttggcttactgcaacctcctcctcctgggttcaagtgattctcctgtctcagcctcttgagtatttgggattacaggcacgtgccaccacgcctggctaagtttgtattttttttggtagagatggggtttcgccatgttggccaagttggtctcaaactcccaacctcaagtgatctgcctgccttggcttctcaaagtgctgggatggcaggcgtgagc

SEQ ID NO: 19807 - DNA, 601 bp, Human
acagggtcttgctctgttgcccaggctggagtgcagtggtgcgatcatagcttactgcagcctcgacctcttgggctcaggtgatcctcctgcctcagcctcctgggtcgctggactgcaggcatgcaacaccacaccagctaatttttgtattttttttagaaatggggtctcactatgttgcccaggctggtctcaaactcctgggctcaagtgatccttctgcttcagcctccagagtagctagggctacaggcacacaccaccatgcccagctcattttttttttttttttttttttgagacagagtcaagctgagtgcagtggtgtgatctcggctcactgcaacctcttcctcctgggttaaagctattctcctggctcggcctccctagtagctgggactacaggcgtgtgccaccatgcccggctaaatctttgtatttttagtagagatggttttcagcatgttggtcacactggtctcaaactcctgacctcaaatgatctgcccgcctcagcctcccaaagtgctgggattacagacgtgagcaaccttgcctggccccagataaatttttttttttttttttagagaca

SEQ ID NO: 19808 - DNA, 601 bp, Human
atgtgactttttaacaatgacctgatcaatgcttgcatcactgcctaacagatcaattccgaagagcaggcgggtgccctgcagctgcctcctctcacccaagagcccttcaggaaatgctcatgatggctgggtgaggtggctcacgcctgtaatcccggtactttgggaggccaaggcaggtggatcgcctgaggtcaggagttcgagaccagcctggccaacatggcgaaaccctgtctctactaaaaatacaaaaaaattagccaggtgtggtggcgggcacctgtaatcccagctmttcgggaggctgaggcaggagaatcgcttgaacccgggaggcagacgttgcagtgagctgagataacaccattgcactccagcctgggcgacagagtgagactctgtctcaaaaaaaaaaaaaaaaaaaaaaaaaaaaaagaaatgcttgtgagaacggtgggtaatcactctcttttccacaagtcggccaaggttctacatttcaaattcgactgatttgtggccaagattgcagcaataagggtcacagcaaggagattaaatttcccgaataagatgagcacagaaacacgcaatc

SEQ ID NO: 19809 - DNA, 601 bp, Human
agcccccagccccctcctgttcctccgggcccacccaggttggcttccaagccccctttccccaaaggcctcccccacgcagatgaggtgctggcactctgcaaccagcttccccacagccccggtgtctggtgcgatgcttcagtccaaagtatttccagaacatcgcctgcggtcaccccggtatctctgggttcccaaatgggctcgcagctcccagagagtaggagcatcggccgaccaccaccaagggaggcccagccagagcttggggatgaccagccaaggcctcagtccacakgctaccattttctagtgggtgctacagaaataaatcccgtaaacctaatttttattttttatgactgcactgcacgtgcataagaatgaagtcagaccaggcgtggtggctcatgactggaatcgcagcactttgggaggctgaggcaggtggatcacctgaggtcaggagtttgagagcagcccggccaacatggcaaaaccccgtctctactaaaaatacaaaaatcagccaggcctggtggtgggcacctgtaatcccagctattcaggaggctgaggcacgagaagtgcttgaacc

SEQ ID NO: 19810 - DNA, 601 bp, Human
aaattagtgaggcatggtggcacatgcctgtaatcccagctactcgggaggctaaggcaggaaaattgcttgaacctgggaggcggaggctgcagtgagccgagatcatgtcgctgcactctagcctgggtgacagagcaacactccatctcaaaaaaaaagaatgaagtggaacaatgtctcagtcctcctataagacctaaaggacttatatacagtggcacctgattaaaaactttggcctacaagccaggcggcccccaatgcccaactgccccggctcgaagtatactttcataarctctgttacgtctaatcggtatcgagcgataaaaagaagacacaggcttgagaaaggcaaagacagccgcactatgaagaccaccaaagctgtctatccttaagtgtcaagcatagctgcaaagcccccagccccctcctgttcctccgggcccacccaggttggcttccaagccccctttccccaaaggcctcccccacgcagatgaggtgctggcactctgcaaccagcttccccacagccccggtgtctggtgcgatgcttcagtccaaagtatttccagaacatcgcctgcggtca

SEQ ID NO: 19811 - DNA, 601 bp, Human
gcgtccagccctcagcctgtgtgctgacaatgctttacattttgaaatggttggaaaaagtcaaaagaataattatattcggtggcacgtggaaattacatgaaattcacattttggtgtccacagacagtttcactggcacgcgtcatgcccgttcctatgttgtctttcctaggatggctgcaaatactacctggttctttctgggagaggcggcccctgacctaaaggatcagtataagaccaaagggggctaggcacggtcgctcacacctgtaatcccagcactttgggaggccarggcgggcagatcacttggggtcaggagttctagaccagcctggccaacatggtgaaacgccatctctactaagaatacaaaaattagtgaggcatggtggcacatgcctgtaatcccagctactcgggaggctaaggcaggaaaattgcttgaacctgggaggcggaggctgcagtgagccgagatcatgtcgctgcactctagcctgggtgacagagcaacactccatctcaaaaaaaaagaatgaagtggaacaatgtctcagtcctcctataagacctaaaggacttatatacagtg

SEQ ID NO: 19812 - DNA, 601 bp, Human
aaaggccacacagtgtgtgatcccatttctatgaagtgtccaggacaggccgatccacagaggcaggagggggctgcgtgggtgctgtgctgcaggaggagcttgggaatgactgctcctggggacggggtttccttttggggtgacggaatgttctggaactggacagaggtgccagctgcacgttgtggatgtgctaagcgccacttgattgtgcgctttcacgtggaaatctctccctatgtgtgtgttaccacaataaacagaaaactctgggtggtgtgtccgaggcctcccctgygtggcgggacgcccaaggacaacctccttccagagccagcggtgcgatggggactgtgaacttggacagagccccaaatccttcccagtgctgataaaacttgtggttttgatgttttgagacactgctgtgtcctggcacgggtgggcccgtttctgtggcttgttctttatcgagctgcagctctgtccgggcggcagagcagtgggacctgcgagtgtcctctctctgggctgctcagagcacaccgccctctccccacaggcccggccaagccccggccgtcccacccaggagggt

SEQ ID NO: 19813 - DNA, 601 bp, Human
cgcagcccagcaagtccactccaaggtgtggaccccgaagaactgaacacaggagtgcacacaaacacccgcccacacacgcccacgcagccccgttcacgacggccacagagagggagcgcgtgcacaaacacccgcccacacacgcccacgcagccccgttcacgacggccacagagagggagcgaccgtgcagcacggagggacgagcggtcagcacagcgcggccagccacgcaccggaacacaactcagccaggagaggaaccaggctttgacccgggccgcagcgcggatgtcaygttccgtgacagacgccggacacaaaaggccacacagtgtgtgatcccatttctatgaagtgtccaggacaggccgatccacagaggcaggagggggctgcgtgggtgctgtgctgcaggaggagcttgggaatgactgctcctggggacggggtttccttttggggtgacggaatgttctggaactggacagaggtgccagctgcacgttgtggatgtgctaagcgccacttgattgtgcgctttcacgtggaaatctctccctatgtgtgtgttaccacaataaacagaaaactctgg

SEQ ID NO: 19814 - DNA, 601 bp, Human
cccgggggtccctctggcctgcctgtcccactctcctgctgggcgtgggcgcaggagaccaggggctgcctagtctgggcctggtgctgaggtccctgggcagcggctacccagaggccagcggcagtctgagccccagccgagccagtctgcagtgtcacctgctgcccaggcatcacccactgtccggatgacagatcccagggccctcaccccccaaggggctgcccgcatttccacctgttcatcatgagatggggcagacaggccacggccaggagtaccaccctcctgggagggycgtggtgggaaagccgcagacgcacctacctttgtcgagcagcgtcagcgacagagaggcgagatcgttgaactgaaagagaaacctggagtcaggggcgcctgcagaggggcggcagttgctgtttgggggctcgggggatgccggcccaaccttgccttgagccacgtcctccattcacagtgaagcagctggggcctgccctgaaatgtggctctgatgctgccaggtgtctgggtgggtccctgtgccctgtccaggccgcctctgggagctgctgggggtggagggtgctgacta

SEQ ID NO: 19815 - DNA, 601 bp, Human
gcccccagctcgggccaggcgaaagagcctctgccctgtgcctccctttcccagcgccgacgggcctggggcctgctccccacagggctggggcctctggggtcctcccacccgcatgggacagagacggggcccgggggtccctctggcctgcctgtcccactctcctgctgggcgtgggcgcaggagaccaggggctgcctagtctgggcctggtgctgaggtccctgggcagcggctacccagaggccagcggcagtctgagccccagccgagccagtctgcagtgtcacctgctgcycaggcatcacccactgtccggatgacagatcccagggccctcaccccccaaggggctgcccgcatttccacctgttcatcatgagatggggcagacaggccacggccaggagtaccaccctcctgggagggtcgtggtgggaaagccgcagacgcacctacctttgtcgagcagcgtcagcgacagagaggcgagatcgttgaactgaaagagaaacctggagtcaggggcgcctgcagaggggcggcagttgctgtttgggggctcgggggatgccggcccaaccttgccttgagccac

SEQ ID NO: 19816 - DNA, 601 bp, Human
ggaggggtagggtcagtgtccatcatcaggagggcacgagagggagagaaggaagtgcacgttccgagaactgctccggcacgccaggcagggcaccgaggatacatggcagcctgtggaccccacctcggcctctgctccaggctgacctgtcctccccacctgccgttacccagaggtgcccccagctcgggccaggcgaaagagcctctgccctgtgcctccctttcccagcgccgacgggcctggggcctgctccccacagggctggggcctctggggtcctcccacccgcatgggrcagagacggggcccgggggtccctctggcctgcctgtcccactctcctgctgggcgtgggcgcaggagaccaggggctgcctagtctgggcctggtgctgaggtccctgggcagcggctacccagaggccagcggcagtctgagccccagccgagccagtctgcagtgtcacctgctgcccaggcatcacccactgtccggatgacagatcccagggccctcaccccccaaggggctgcccgcatttccacctgttcatcatgagatggggcagacaggccacggccaggagtaccaccc

SEQ ID NO: 19817 - DNA, 601 bp, Human
ctctccataccagaggttctgccccagaagagaagctcgaagatgtcctcccagctgtcccgctgcatcatggcaaagtgttcaaacacagccgacagggagctgccttcacactcctcctgactgggctggtgctggaactggtactcccagtactgtttccctgaggagcggggtggtgggcattaggagggctgggccagggcaagactggagatcccagaggctgttgaagttaggatctcccagcatgaggtgggggtcaggggtgggcacatgctgaggcctgtccccagtgaartgtgaaaggaatccaagactgctccactgcctgctcagtctcccaccaccccctgagtacccttgaagaagtagacccgctcccggccactgtagctatgggcagggagggccaaggctgcatccacgttgtccgggatgccatcgaagccgtcagagatatttcgggggtaatcagggtccaggacaccatcctcaaagcgccagtactgactaccctaagaggtggggaaagtgaaaaggggtatggaggccgctggctgggcacagaggcagagtcccttgccctaaggcagccgtt

SEQ ID NO: 19818 - DNA, 601 bp, Human
cttgagaagtctagggtctctcccagaagggaaagtgaacatccatgatgcagctaaggacttctggcctggctttctgtggtcactacttgcaggctgcgttcagcccttgtgcaccagggacagcaaggaaaacccaagctagaccagcttcaggggtggcagcggctcctacctccagagaagaagaagacactctggatgggttcacaggtggcaggcacaagccagtccatcctgtagtcatcatagttgttggctcccaagttgctctcctcactggagaacaaggacagccacrtggcgcgggatggccggcgggagttctggttgcggccacggctgtggcctcgttgtgaacggtagcctttgcggttgcgatgcctaaacctttgtttcttggccaaggaggggcggggtgccatgcctgagatgtagatgcggccagccatggctgcgtccacttgccctggcacaccgtgccagtcccggctaatgaactggggctgtctggtaccagctgtggcagggaaggggtgaatgagaggtcttgggggtccgaatcttgccccttccagcggggccattagagttcatctgc

SEQ ID NO: 19819 - DNA, 601 bp, Human
agagggcccggccatgtgggctctgactcctacagatggccaggagctgggcagcccagccagtactgagcgatggagcgtgggtagggagggtccacagtgtccactcgccgtgtgcgaagattgactcggtagtacttgtctggaagagaggaaagcagaggatgcgtgaggcccagcctggccctgcccactcttcccttgagaagtctagggtctctcccagaagggaaagtgaacatccatgatgcagctaaggacttctggcctggctttctgtggtcactacttgcaggctgcrttcagcccttgtgcaccagggacagcaaggaaaacccaagctagaccagcttcaggggtggcagcggctcctacctccagagaagaagaagacactctggatgggttcacaggtggcaggcacaagccagtccatcctgtagtcatcatagttgttggctcccaagttgctctcctcactggagaacaaggacagccacatggcgcgggatggccggcgggagttctggttgcggccacggctgtggcctcgttgtgaacggtagcctttgcggttgcgatgcctaaacctttgtttctt

SEQ ID NO: 19820 - DNA, 601 bp, Human
acataccaggagctgcagccggcgcagcagccggtccagtcgggcctgcagggtgcccagctcgggctccagggtcttcagggaagagccacctgcccggcgcagccactgcacgtgccgcaggtaggacagtaggtccgctcgcagccttgtcagcacacctgggagctggggatagagccgggacatcagagaacacccgaccagtgcccctcatcctccccgcccccttcactgcctgcctcccaccttgtccccagcccactcccttgcccttacctgtagagctcccagtgccccygcactcatggccagggtgggcagggaatccaggttgtggtccccgtcagctgggaatttgtccctctggcagggaaaaaagctgtgaggtggcccctgcccagcctcggggctccctccatcccccacgccaggcccccaactcttcccctccctcactctgccacctgagagcccagaacccctccaagtggctgcccgcagactcctctccgttcctctctgcctctcactcctgtgctggccccagcccagtctctcctaccagctgtgcagccagctgccgcgtgtccgccaggag

SEQ ID NO: 19821 - DNA, 601 bp, Human
gttgttgtcgctgctgttagaacaattaagaagccaggcgcgggggctcacgcctgttatcccagcgctttgggaggccgaggcgggcggatggcctgagctcaggagtttgtgaccagcctgggcaacacggtgaaaccctgtgtctactaaaatacaaaaaaattatccgggtgtggcagtgtgcacctgaagtcccagctactcaggaggctgaggcaggagaatcgcttgagcccaggaggcggaggttccagcaagccgaaatggcaccattgcactctagcctgggcaacagagygcgagactctgtctccaaaaaataataataataataataattaagaaacagagtcttgctatgctgcccaggctgtctcaaactcatggcctcaagaggtccttctgccttggcctcccctgccttgggattacaggagtgagccactgctccccaccagagctggggttttacagacagtatctgaggtctgtgggctcgagtctagggtcaggccctggatctcaaggctgaagtcttagagatggggtctctgggttcaagttcaggaactcatgggtgagggctggagtctcagag

SEQ ID NO: 19822 - DNA, 601 bp, Human
ctgttagagtcgccggggctggaatctcagagctgggtttttgttgttgtcgctgctgttagaacaattaagaagccaggcgcgggggctcacgcctgttatcccagcgctttgggaggccgaggcgggcggatggcctgagctcaggagtttgtgaccagcctgggcaacacggtgaaaccctgtgtctactaaaatacaaaaaaattatccgggtgtggcagtgtgcacctgaagtcccagctactcaggaggctgaggcaggagaatcgcttgagcccaggaggcggaggttccagcragccgaaatggcaccattgcactctagcctgggcaacagagcgcgagactctgtctccaaaaaataataataataataataattaagaaacagagtcttgctatgctgcccaggctgtctcaaactcatggcctcaagaggtccttctgccttggcctcccctgccttgggattacaggagtgagccactgctccccaccagagctggggttttacagacagtatctgaggtctgtgggctcgagtctagggtcaggccctggatctcaaggctgaagtcttagagatggggtctctggg

SEQ ID NO: 19823 - DNA, 601 bp, Human
ggcttccagagctgagtgtgggggttgggggtgaagtctgtggagtcagggctggcatctcggttctaggtgagggatcgggcctgggactgttagagtcgccggggctggaatctcagagctgggtttttgttgttgtcgctgctgttagaacaattaagaagccaggcgcgggggctcacgcctgttatcccagcgctttgggaggccgaggcgggcggatggcctgagctcaggagtttgtgaccagcctgggcaacacggtgaaaccctgtgtctactaaaatacaaaaaaattatscgggtgtggcagtgtgcacctgaagtcccagctactcaggaggctgaggcaggagaatcgcttgagcccaggaggcggaggttccagcaagccgaaatggcaccattgcactctagcctgggcaacagagcgcgagactctgtctccaaaaaataataataataataataattaagaaacagagtcttgctatgctgcccaggctgtctcaaactcatggcctcaagaggtccttctgccttggcctcccctgccttgggattacaggagtgagccactgctccccaccagagctggggt

SEQ ID NO: 19824 - DNA, 601 bp, Human
tgtatgacacatttaattccctgttctctgtctcacaaaggtttctcacatttttgtacaaaaacccaggcttccctttcccctccgtccccaccccaacatgaaaagtaattgcttaaataaataatatatgttcctgcccaggcctagatggggaagagccagggcagaagtctgtggacagacttcttggagacccaagaatccgggaccccagtcccctcctcctcggggacccaggagtccacctgcctcccacccctgctcctgaaataaataagtataaataaggcacagatgycccccaggcctcacggaaggactgtctctaactagggggagataatggcggggggatcacctggctgtttcgcccccagtactgaaataaataaataaataagatctggctttggaaggacggtggtggctttgggccccgggtcacagccgagtcttcagcagcagcagtcccctcacggcccagtcaagtgtcaggtgcagcccccccaggatggcgtgggcggccctgatgcccccccaggctgaggaggggggcgccagcgggggcgccggcgggtccgggggtggctggggcagg

SEQ ID NO: 19825 - DNA, 601 bp, Human
gtcccatacgggtactgttgatcacagggtgacttgtggaaccttccattaaatatttattgaagacctatgggtcaggtgtggtggctcacacctgtaatcccagcactttgggaggccgaggcaggaggatcacctgaggtcaggagttcgaaaccagcctggccaacatggtgaaaccctgtctctactaaaaatacaaaagaaataaataattagctgggcatggtggtgcacacctgtgatcccagctaatcgggaggctgaggcaggagaattgcttgaacccgggaggtggagsttgcagtgaccttagattgcctcactgcactccagcctaggcaacagagcgagactccatctcaaaaaacaaacaaacggccctatgcagtgcggggccccaggcaaggctcagaccctgcctccacagagctgtctgggtgaccgacccatctcccagtcgctgccccgcccactcgggacctccacctgaatggaggtctcccctccacctgccctgccccagttacccaagcatccagccccagctctcagacaaatcgccctcaagtggatatgtatgacacatttaattccctgt

SEQ ID NO: 19826 - DNA, 601 bp, Human
taatccatatatagaaagaaaaacacaaaattgggatcacagcatgcagtggttttgtagcctgctgtttcatgtcaggacatcattctttcttttttgagacagggttttgccatgtctcgcaggccggtctcaaactcttggacttcagtgatccactcgcttcgtcctcccaaagtgccaggattacaggcgtgagccaccatgcctggccaatgtcaggatatctttctatatcccaagcaagcctctctccttagcctccctgaatgacagtccctgctccgggcggctgggtggygttctatccacagatgcaccatgttgcttaaccctcactgttggatatctagattgtttccagtttgctatggtgaacacagccataatgaaccatcttgaccttgcagctttgtcccatacgggtactgttgatcacagggtgacttgtggaaccttccattaaatatttattgaagacctatgggtcaggtgtggtggctcacacctgtaatcccagcactttgggaggccgaggcaggaggatcacctgaggtcaggagttcgaaaccagcctggccaacatggtgaaaccctgtct

SEQ ID NO: 19827 - DNA, 601 bp, Human
actgaacaaagatacagcttacttgcttactttgcccttggtgcccatttttctttgggaaactgtgttggaagtttctttctgagttaagaaagcttcaaactcctacccagggagttccgtgtcctataatgagctgtctttgaataaataccattcatgttgcttaattctccaatcacttccttttctcctttgttgctgtaattcacagccctgccggcctcttaccacatcatttgtactattggacttcagctgcaaaccccattgctcccagtgagctccaagattttttaawttcttttttcttttattgaaaaatataaaataatagagaaaagcccattaaacatataaagatgaattaacaaataattatgaagtaaaggaaatttctactcctcacaatcgcccatttaacttacctgttcttctccttcacaaccctgataatcacttccttgcatatttagtggtttactacctatttaagcttctctatccaatagtttaatctagcaaagcctttttatgaatggaatcatagtgtatgtattgtttcatgtcttttttctcccctctactctatgtgagaatc

SEQ ID NO: 19828 - DNA, 601 bp, Human
ttttacatctctgcaactcgaagtgtggtcctcggacaagcatttattcacatcacttgggaatttgttagagatgaaagccctgcctcaaatccactaaatcaaaatctgcatttgaacaatatccccagagaattcattaaaagtctgagaaatgaggcttacatcattattaaatttatctgtaggatataaattaaataaaaatttcatctaattgtaagaatttgggtaaagatgaatgaacagaaattaaatatttaggattctataaccccaattttttctagcctcaaattayatttttaatttcaaatataagcaacattgaaagaaagtagaaagaaacaaacctataatcttctgttctaacactactatgcttacatttggtatacttttcccaaagtctttgaccacattaatgtatatttttcaatagttacataattttgaattatgtttttgaatattatttattttgtttcaaatgaagtatatattaattaacaggaagtttcaaaatgccaaggcctatcaagtttttaaagacaaaaaatagaataagattcatctgtaagctcatcacccactttatgct

SEQ ID NO: 19829 - DNA, 601 bp, Human
aaaaggaagagggagatagagatagagattttgacagggttgggggtaggagagaggagatcatgagaaaaaattagaatatattgatactgtaatttcatgacaaagagttaaagagtttgtagctggatcttatagatattattttaaagacaagggatcttaaagaaaaataagaagttaaattctacattatagtcattacattttttatttcttgaaaaaaaaacaggtgtattaaagtttaccttgatataatgtctcaagtttttccctctataacagagagaatagatttatkgagtttgaataaggtagatggcctataaaaatctattgagtgaactgtttgaaatcagctctgaattacctgagtcagataattgctggagaatagatgtgttttacatctctgcaactcgaagtgtggtcctcggacaagcatttattcacatcacttgggaatttgttagagatgaaagccctgcctcaaatccactaaatcaaaatctgcatttgaacaatatccccagagaattcattaaaagtctgagaaatgaggcttacatcattattaaatttatctgtaggatataaatta

SEQ ID NO: 19830 - DNA, 601 bp, Human
atttttctgagcctctcctccctccatccttcatccttaagtaggacccagtgtgcctgtcattgccccatttgtgtccatgtgttctcattatttagctcctacttataagtaagaacattcagtatttggttttctgttcctacaatagtttgctaaggataatggctgacagcttcatccatatttctgcaaaggacatgatcttgttcttttataaggtgtcatttgttaaacatggaagtttcagttagagctaacctcataactttgcttcatgggacagtttctcagtgctatrtgtaaataaagtgaccacatttcctagattttattagacaattctgatttcaaatattctgtcctattgctagactgtgataaattgtgtctctcgttttactttggaaaagatggtccccttttgtaaatagagatcaattatagcatgccaagccaggactctatcaataattatctctgaaatattgtgacatttccattttttctgaataaaataaaatacctggtttgacgttggtcactcctggcccaatactttccacaatacctgcagcctcatggccaacgatcactggga

SEQ ID NO: 19831 - DNA, 601 bp, Human
ttgtcacccaggtactaaacatagtacccgatagttatttttctgagcctctcctccctccatccttcatccttaagtaggacccagtgtgcctgtcattgccccatttgtgtccatgtgttctcattatttagctcctacttataagtaagaacattcagtatttggttttctgttcctacaatagtttgctaaggataatggctgacagcttcatccatatttctgcaaaggacatgatcttgttcttttataaggtgtcatttgttaaacatggaagtttcagttagagctaacctcrtaactttgcttcatgggacagtttctcagtgctatgtgtaaataaagtgaccacatttcctagattttattagacaattctgatttcaaatattctgtcctattgctagactgtgataaattgtgtctctcgttttactttggaaaagatggtccccttttgtaaatagagatcaattatagcatgccaagccaggactctatcaataattatctctgaaatattgtgacatttccattttttctgaataaaataaaatacctggtttgacgttggtcactcctggcccaatactttcca

SEQ ID NO: 19832 - DNA, 601 bp, Human
ggctgaagcaggataattgcttgaacccaggaggcggaggttgcagtgagctgagatcgtgccactgcactccagcctgggtgacagagcaaggctccatctcaaaaaaaaaaaaaaaggaaaaacaacacctttaattttagatttaggggtacatgtgcaggtttgctatataagtaaacttgtgtcatggaagtttggtgtacagataattttgtcacccaggtactaaacatagtacccgatagttatttttctgagcctctcctccctccatccttcatccttaagtaggacccartgtgcctgtcattgccccatttgtgtccatgtgttctcattatttagctcctacttataagtaagaacattcagtatttggttttctgttcctacaatagtttgctaaggataatggctgacagcttcatccatatttctgcaaaggacatgatcttgttcttttataaggtgtcatttgttaaacatggaagtttcagttagagctaacctcataactttgcttcatgggacagtttctcagtgctatgtgtaaataaagtgaccacatttcctagattttattagacaattctgattt

SEQ ID NO: 19833 - DNA, 601 bp, Human
gtttcgaacaaaaaaaaaagtctgggcaaggtggctcatgcctgtaatcccagcactttgggaggccgaggtgggtggatcacctgaggtcagtagttcgagaccagcctagccaacatggtgaaaccccgtctctactgaaaatacaaaattagccgggtgtggtggcacatgcctgtaatcccagctactcgggaggctgaagcaggataattgcttgaacccaggaggcggaggttgcagtgagctgagatcgtgccactgcactccagcctgggtgacagagcaaggctccatctcaaaaaaaaaaaaaaaggaaaaacaacacctttaattttagatttaggggtacatgtgcaggtttgctatataagtaaacttgtgtcatggaagtttggtgtacagataattttgtcacccaggtactaaacatagtacccgatagttatttttctgagcctctcctccctccatccttcatccttaagtaggacccagtgtgcctgtcattgccccatttgtgtccatgtgttctcattatttagctcctacttataagtaagaacattcagtatttggttttctgttcctacaatagttt

SEQ ID NO: 19834 - DNA, 601 bp, Human
caacatggtgaaaccctgtctctactaaaaatacaaaaattagccagatgtgatggctcatgcctgtaatcccagctactctggaggctgaggcacaagatttgtgtgaacttgggaggtgcaggttgcagtgagccaagatcgtgccacagcactccagcctggcacagagtgagactctgtttcgaacaaaaaaaaaagtctgggcaaggtggctcatgcctgtaatcccagcactttgggaggccgaggtgggtggatcacctgaggtcagtagttcgagaccagcctagccaacatrgtgaaaccccgtctctactgaaaatacaaaattagccgggtgtggtggcacatgcctgtaatcccagctactcgggaggctgaagcaggataattgcttgaacccaggaggcggaggttgcagtgagctgagatcgtgccactgcactccagcctgggtgacagagcaaggctccatctcaaaaaaaaaaaaaaaggaaaaacaacacctttaattttagatttaggggtacatgtgcaggtttgctatataagtaaacttgtgtcatggaagtttggtgtacagataattttgtcaccc

SEQ ID NO: 19835 - DNA, 601 bp, Human
ggaggctgaggtaggcagatcacctgaggttgggagttcaagagcagcctggccaacatggtgaaaccctgtctctactaaaaatacaaaaattagccagatgtgatggctcatgcctgtaatcccagctactctggaggctgaggcacaagatttgtgtgaacttgggaggtgcaggttgcagtgagccaagatcgtgccacagcactccagcctggcacagagtgagactctgtttcgaacaaaaaaaaaagtctgggcaaggtggctcatgcctgtaatcccagcactttgggaggcygaggtgggtggatcacctgaggtcagtagttcgagaccagcctagccaacatggtgaaaccccgtctctactgaaaatacaaaattagccgggtgtggtggcacatgcctgtaatcccagctactcgggaggctgaagcaggataattgcttgaacccaggaggcggaggttgcagtgagctgagatcgtgccactgcactccagcctgggtgacagagcaaggctccatctcaaaaaaaaaaaaaaaggaaaaacaacacctttaattttagatttaggggtacatgtgcaggtttgct

SEQ ID NO: 19836 - DNA, 601 bp, Human
ttttttatatagaagttattataacatgtcatttaaaaaccttttattttacaccaggtgcagtggctcacatctgtaatcccagtgctttgggaggctgaggtaggcagatcacctgaggttgggagttcaagagcagcctggccaacatggtgaaaccctgtctctactaaaaatacaaaaattagccagatgtgatggctcatgcctgtaatcccagctactctggaggctgaggcacaagatttgtgtgaacttgggaggtgcaggttgcagtgagccaagatcgtgccacagcacwccagcctggcacagagtgagactctgtttcgaacaaaaaaaaaagtctgggcaaggtggctcatgcctgtaatcccagcactttgggaggccgaggtgggtggatcacctgaggtcagtagttcgagaccagcctagccaacatggtgaaaccccgtctctactgaaaatacaaaattagccgggtgtggtggcacatgcctgtaatcccagctactcgggaggctgaagcaggataattgcttgaacccaggaggcggaggttgcagtgagctgagatcgtgccactgcactccagcct

SEQ ID NO: 19837 - DNA, 601 bp, Human
ttatctttatcttacaaacttccaaaaaaacacttcagctaacgttgacatatatataatatttctcactaaagctacctctaagtcctcattctttacatagtttgctgttaatattaaaatagtttgcttttttatatagaagttattataacatgtcatttaaaaaccttttattttacaccaggtgcagtggctcacatctgtaatcccagtgctttgggaggctgaggtaggcagatcacctgaggttgggagttcaagagcagcctggccaacatggtgaaaccctgtctctacyaaaaatacaaaaattagccagatgtgatggctcatgcctgtaatcccagctactctggaggctgaggcacaagatttgtgtgaacttgggaggtgcaggttgcagtgagccaagatcgtgccacagcactccagcctggcacagagtgagactctgtttcgaacaaaaaaaaaagtctgggcaaggtggctcatgcctgtaatcccagcactttgggaggccgaggtgggtggatcacctgaggtcagtagttcgagaccagcctagccaacatggtgaaaccccgtctctactgaaaat

SEQ ID NO: 19838 - DNA, 601 bp, Human
aataatttcagctattggggtgcttcatttaggtattatctttatcttacaaacttccaaaaaaacacttcagctaacgttgacatatatataatatttctcactaaagctacctctaagtcctcattctttacatagtttgctgttaatattaaaatagtttgcttttttatatagaagttattataacatgtcatttaaaaaccttttattttacaccaggtgcagtggctcacatctgtaatcccagtgctttgggaggctgaggtaggcagatcacctgaggttgggagttcaagascagcctggccaacatggtgaaaccctgtctctactaaaaatacaaaaattagccagatgtgatggctcatgcctgtaatcccagctactctggaggctgaggcacaagatttgtgtgaacttgggaggtgcaggttgcagtgagccaagatcgtgccacagcactccagcctggcacagagtgagactctgtttcgaacaaaaaaaaaagtctgggcaaggtggctcatgcctgtaatcccagcactttgggaggccgaggtgggtggatcacctgaggtcagtagttcgagaccagcct

SEQ ID NO: 19839 - DNA, 601 bp, Human
aatcacagaaaagtgacataactggccaagatcacatagccagtaagtggcagagctggggctaaagggattatattggccagactccttcattgacacaaaattttgggaagcaatttgtttgtacaatcttttttggaatggaaagatactaatatacctctaactttggagcattctcattaaaagagaaaagagtggcacggttcatctggcctgccaaatgaggattacatagcccatattccagtatctggaggatctgttgtaaaatgtggagtaaataatttcagctattggkgtgcttcatttaggtattatctttatcttacaaacttccaaaaaaacacttcagctaacgttgacatatatataatatttctcactaaagctacctctaagtcctcattctttacatagtttgctgttaatattaaaatagtttgcttttttatatagaagttattataacatgtcatttaaaaaccttttattttacaccaggtgcagtggctcacatctgtaatcccagtgctttgggaggctgaggtaggcagatcacctgaggttgggagttcaagagcagcctggccaacatggt

SEQ ID NO: 19840 - DNA, 601 bp, Human
tgcttcgatgcctgaggtctaatgatgataattcacattcattcaacatttaatacataccacacaccattataactacttacatgtattatttcagaacttaattctcagagcaactctttgagacgagccctatttttattcacactatagaaaacagaaatctgagctgaatcacagaaaagtgacataactggccaagatcacatagccagtaagtggcagagctggggctaaagggattatattggccagactccttcattgacacaaaattttgggaagcaatttgtttgtacartcttttttggaatggaaagatactaatatacctctaactttggagcattctcattaaaagagaaaagagtggcacggttcatctggcctgccaaatgaggattacatagcccatattccagtatctggaggatctgttgtaaaatgtggagtaaataatttcagctattggggtgcttcatttaggtattatctttatcttacaaacttccaaaaaaacacttcagctaacgttgacatatatataatatttctcactaaagctacctctaagtcctcattctttacatagtttgctgtt

SEQ ID NO: 19841 - DNA, 601 bp, Human
tagcttcttaaataactgctttcaattagtgttaaggatgaaaggatccttctgtagtctagtaaagcaaaaacaagatgattaagattttagactccagagccatactgccggggttaaaaacctggctctaagacttataactatgttgccttggagtaaattactttactgtgccttattgtatccctctctcatccctgtagaagtagctattattctgaaattggcatttattatttcagtgatttgtttatgcttttactacatatacaaataaccataagaaagtatagtattstttttgtatatgacactttactaaatattccttcagcaatttgcttatttcccttaacattatgtgtgtgagattattttatgttaatacatgcagctcaagtttagccatttttattgttgtgtagtagtccattgtgctactacatagcagttttaaaattcattctctttctgatggacatttgtgctgttttaaattgcttactctaataaacagtgttacaaagaacattccagcacatgtttctttgtgtgcacttgcaatagtatcttgtacacacctaggattagaattagt

SEQ ID NO: 19842 - DNA, 601 bp, Human
caggcattattttgctcctcattttatagatgaaaaaattgaggcacagtaatagatgtaagagtagtacaattttagcttcttaaataactgctttcaattagtgttaaggatgaaaggatccttctgtagtctagtaaagcaaaaacaagatgattaagattttagactccagagccatactgccggggttaaaaacctggctctaagacttataactatgttgccttggagtaaattactttactgtgccttattgtatccctctctcatccctgtagaagtagctattattctgaawttggcatttattatttcagtgatttgtttatgcttttactacatatacaaataaccataagaaagtatagtattctttttgtatatgacactttactaaatattccttcagcaatttgcttatttcccttaacattatgtgtgtgagattattttatgttaatacatgcagctcaagtttagccatttttattgttgtgtagtagtccattgtgctactacatagcagttttaaaattcattctctttctgatggacatttgtgctgttttaaattgcttactctaataaacagtgttac

SEQ ID NO: 19843 - DNA, 601 bp, Human
tctttttataacatttattagaaagaatttattggtattgcctaaatccattatttcattaaagctttgcaaaaaaaattagttctttgaatatctagaacaagtctatgaagcaggcattattttgctcctcattttatagatgaaaaaattgaggcacagtaatagatgtaagagtagtacaattttagcttcttaaataactgctttcaattagtgttaaggatgaaaggatccttctgtagtctagtaaagcaaaaacaagatgattaagattttagactccagagccatactgcckgggttaaaaacctggctctaagacttataactatgttgccttggagtaaattactttactgtgccttattgtatccctctctcatccctgtagaagtagctattattctgaaattggcatttattatttcagtgatttgtttatgcttttactacatatacaaataaccataagaaagtatagtattctttttgtatatgacactttactaaatattccttcagcaatttgcttatttcccttaacattatgtgtgtgagattattttatgttaatacatgcagctcaagtttagccatt

SEQ ID NO: 19844 - DNA, 601 bp, Human
gtaatactttataggtggtatcgtatatttcatttggaatatctgattatctctttttataacatttattagaaagaatttattggtattgcctaaatccattatttcattaaagctttgcaaaaaaaattagttctttgaatatctagaacaagtctatgaagcaggcattattttgctcctcattttatagatgaaaaaattgaggcacagtaatagatgtaagagtagtacaattttagcttcttaaataactgctttcaattagtgttaaggatgaaaggatccttctgtagtctaktaaagcaaaaacaagatgattaagattttagactccagagccatactgccggggttaaaaacctggctctaagacttataactatgttgccttggagtaaattactttactgtgccttattgtatccctctctcatccctgtagaagtagctattattctgaaattggcatttattatttcagtgatttgtttatgcttttactacatatacaaataaccataagaaagtatagtattctttttgtatatgacactttactaaatattccttcagcaatttgcttatttcccttaacatt

SEQ ID NO: 19845 - DNA, 601 bp, Human
aggattactttaggtccacatttttgttgtctcttaattatcttaaattatagatcccttctccctctctttttccccttgcaatttatttgttgaagaaattgaatcatttgtcctatagagtttttctcattctgaattttgctcataacattcctgtaatctggttgaacatatttctctatccctgcatcccctcataaattagtatttttgatctaaacacttgatctgattcagattttatatttttgtggtaatactttataggtggtatcgtatatttcatttggaatatctrattatctctttttataacatttattagaaagaatttattggtattgcctaaatccattatttcattaaagctttgcaaaaaaaattagttctttgaatatctagaacaagtctatgaagcaggcattattttgctcctcattttatagatgaaaaaattgaggcacagtaatagatgtaagagtagtacaattttagcttcttaaataactgctttcaattagtgttaaggatgaaaggatccttctgtagtctagtaaagcaaaaacaagatgattaagattttagactccagagccat

SEQ ID NO: 19846 - DNA, 601 bp, Human
caccaccaggcccggctaatttttgtatttttagtagagatgagctttcatcgtgttggccaggctggtctcgaactcctgacttcgctatccacccgcctcagcctcccaaagtgctgggattataggtgtgagccacctcgcctggccctaattttgtatttttagtagagacggggtttctccgtgttggtcaggctggtctcgaactcctgacctcaggtgatctgccagctttggcctcccaatgtgctgggattacaggcatgacccaccgcacccggccagggaacaaactttyattgaatgcttttgtgtaccagaaatgcttttaagggctttacatgtattaactcttaaaacatttttgttgtggaaaatttgaacatgtataaaagtagaaggaatagcataatgaacccttatgtgtccatgtcccagctccagtaaccatcaactcatggccagtcaggtttcatctattattcctccacaatatctgctccctcccccacattggaatattttgaagcaaatcccagatatcacgatttcatctgtaaaaacattaccatatatctctaaaggattactttaggtc

SEQ ID NO: 19847 - DNA, 601 bp, Human
gcctcccgagtagctgggactacaggcacgcaccaccaggcccggctaatttttgtatttttagtagagatgagctttcatcgtgttggccaggctggtctcgaactcctgacttcgctatccacccgcctcagcctcccaaagtgctgggattataggtgtgagccacctcgcctggccctaattttgtatttttagtagagacggggtttctccgtgttggtcaggctggtctcgaactcctgacctcaggtgatctgccagctttggcctcccaatgtgctgggattacaggcatgasccaccgcacccggccagggaacaaactttcattgaatgcttttgtgtaccagaaatgcttttaagggctttacatgtattaactcttaaaacatttttgttgtggaaaatttgaacatgtataaaagtagaaggaatagcataatgaacccttatgtgtccatgtcccagctccagtaaccatcaactcatggccagtcaggtttcatctattattcctccacaatatctgctccctcccccacattggaatattttgaagcaaatcccagatatcacgatttcatctgtaaaaacatta

SEQ ID NO: 19848 - DNA, 601 bp, Human
tccgcctcctgggttcaaggaactctcctgcctcagcctcccgagtagctgggactacaggcacgcaccaccaggcccggctaatttttgtatttttagtagagatgagctttcatcgtgttggccaggctggtctcgaactcctgacttcgctatccacccgcctcagcctcccaaagtgctgggattataggtgtgagccacctcgcctggccctaattttgtatttttagtagagacggggtttctccgtgttggtcaggctggtctcgaactcctgacctcaggtgatctgccagcyttggcctcccaatgtgctgggattacaggcatgacccaccgcacccggccagggaacaaactttcattgaatgcttttgtgtaccagaaatgcttttaagggctttacatgtattaactcttaaaacatttttgttgtggaaaatttgaacatgtataaaagtagaaggaatagcataatgaacccttatgtgtccatgtcccagctccagtaaccatcaactcatggccagtcaggtttcatctattattcctccacaatatctgctccctcccccacattggaatattttgaagcaaa

SEQ ID NO: 19849 - DNA, 601 bp, Human
agctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactacaggcacgcaccaccaggcccggctaatttttgtatttttagtagagatgagctttcatcgtgttggccaggctggtctcgaactcctgacttcgctatccacccgcctyagcctcccaaagtgctgggattataggtgtgagccacctcgcctggccctaattttgtatttttagtagagacggggtttctccgtgttggtcaggctggtctcgaactcctgacctcaggtgatctgccagctttggcctcccaatgtgctgggattacaggcatgacccaccgcacccggccagggaacaaactttcattgaatgcttttgtgtaccagaaatgcttttaagggctttacatgtattaactcttaaaacatttttgttgtggaaaatttgaacatgtataaaagtaga

SEQ ID NO: 19850 - DNA, 601 bp, Human
tagctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactacaggcacgcaccaccaggcccggctaatttttgtatttttagtagagatgagctttcatcgtgttggccaggctggtctcgaactcctgacttcgctatccacccgcckcagcctcccaaagtgctgggattataggtgtgagccacctcgcctggccctaattttgtatttttagtagagacggggtttctccgtgttggtcaggctggtctcgaactcctgacctcaggtgatctgccagctttggcctcccaatgtgctgggattacaggcatgacccaccgcacccggccagggaacaaactttcattgaatgcttttgtgtaccagaaatgcttttaagggctttacatgtattaactcttaaaacatttttgttgtggaaaatttgaacatgtataaaagtag

SEQ ID NO: 19851 - DNA, 601 bp, Human
cctaggctggactgcagtggcacaatctccgttcaccgcaacctccgccttccgagttcaagcgattttcctgcctcagcctcccgagtagctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactacaggcacgcaccaccaggccyggctaatttttgtatttttagtagagatgagctttcatcgtgttggccaggctggtctcgaactcctgacttcgctatccacccgcctcagcctcccaaagtgctgggattataggtgtgagccacctcgcctggccctaattttgtatttttagtagagacggggtttctccgtgttggtcaggctggtctcgaactcctgacctcaggtgatctgccagctttggcctcccaatgtgctgggattacaggcatgacccaccgcacccggccagggaacaaactttcattgaatgcttt

SEQ ID NO: 19852 - DNA, 601 bp, Human
gacttttcacaaaatatagtttgttgaataacagcaaatttaaaaaataacagcaacaattttttaaaaagtgacagggtgtcattttgtcactcaggctggagtgcagggaacaatttttttttttttagacggagtttttgctcttgttgcctaggctggactgcagtggcacaatctccgttcaccgcaacctccgccttccgagttcaagcgattttcctgcctcagcctcccgagtagctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactacaggcacgcaccaccaggcccggctaatttttgtatttttagtagagatgagctttcatcgtgttggccaggctggtctcgaactcctgacttcgctatccacccgcctcagcctcccaaagtgctgggattataggtgtgagccacctcgcctggccctaattttgta

SEQ ID NO: 19853 - DNA, 601 bp, Human
aagacttttcacaaaatatagtttgttgaataacagcaaatttaaaaaataacagcaacaattttttaaaaagtgacagggtgtcattttgtcactcaggctggagtgcagggaacaatttttttttttttagacggagtttttgctcttgttgcctaggctggactgcagtggcacaatctccgttcaccgcaacctccgccttccgagttcaagcgattttcctgcctcagcctcccgagtagctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactacaggcacgcaccaccaggcccggctaatttttgtatttttagtagagatgagctttcatcgtgttggccaggctggtctcgaactcctgacttcgctatccacccgcctcagcctcccaaagtgctgggattataggtgtgagccacctcgcctggccctaattttg

SEQ ID NO: 19854 - DNA, 601 bp, Human
ataaatggaacactgatcattttcctacaaaatatgttgagcattatatatttttgatgacaatttacaagacagaaaaattagggaaacaacaagacttttcacaaaatatagtttgttgaataacagcaaatttaaaaaataacagcaacaattttttaaaaagtgacagggtgtcattttgtcactcaggctggagtgcagggaacaatttttttttttttagacggagtttttgctcttgttgcctaggctggactgcagtggcacaatctccgttcaccgcaacctccgccttccragttcaagcgattttcctgcctcagcctcccgagtagctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactacaggcacgcaccaccaggcccggctaatttttgtatttttagtagagatgagctttcatcgtgttggccaggct

SEQ ID NO: 19855 - DNA, 601 bp, Human
ttgatcactagcaggacttttgagattactagaaaattaaaaaaaagagtgatacaaataaagagaagttataataaatggaacactgatcattttcctacaaaatatgttgagcattatatatttttgatgacaatttacaagacagaaaaattagggaaacaacaagacttttcacaaaatatagtttgttgaataacagcaaatttaaaaaataacagcaacaattttttaaaaagtgacagggtgtcattttgtcactcaggctggagtgcagggaacaatttttttttttttagayggagtttttgctcttgttgcctaggctggactgcagtggcacaatctccgttcaccgcaacctccgccttccgagttcaagcgattttcctgcctcagcctcccgagtagctgggattataggcatgcaccaccacgcctggctaattttgtattattattattattattattttttgagacggagtcttgctctgtcgcccaggctggagtgcagtagtgcgatctcagctcaatgcaacctccgcctcctgggttcaaggaactctcctgcctcagcctcccgagtagctgggactac

SEQ ID NO: 19856 - DNA, 601 bp, Human
cagtgtactgagagaatgtactggttccaaagaaatggtaaactggttttcctttgcaggtaaacctgctggttttgtcttccattagttgttgatcactagcaggacttttgagattactagaaaattaaaaaaaagagtgatacaaataaagagaagttataataaatggaacactgatcattttcctacaaaatatgttgagcattatatatttttgatgacaatttacaagacagaaaaattagggaaacaacaagacttttcacaaaatatagtttgttgaataacagcaaatttwaaaaataacagcaacaattttttaaaaagtgacagggtgtcattttgtcactcaggctggagtgcagggaacaatttttttttttttagacggagtttttgctcttgttgcctaggctggactgcagtggcacaatctccgttcaccgcaacctccgccttccgagttcaagcgattttcctgcctcagcctcccgagtagctgggattataggcatgcaccaccacgcctggctaattttgtattattattattattattattttttgagacggagtcttgctctgtcgcccaggctgg

SEQ ID NO: 19857 - DNA, 601 bp, Human
gtatcacactgcctcctagtaacttctgttttacacaaactggtgtttaaccatttaccttggcattgttgattgcagccccatagccagttgaaaacccacatccaagcagacaaactctctctaaatttgcatcatcatctattttggcaagattgatatctgacaccacagtgtactgagagaatgtactggttccaaagaaatggtaaactggttttcctttgcaggtaaacctgctggttttgtcttccattagttgttgatcactagcaggacttttgagattactagaaaattaaaaaaaagagtgatacaaataaagagaagttataataaatggaacactgatcattttcctacaaaatatgttgagcattatatatttttgatgacaatttacaagacagaaaaattagggaaacaacaagacttttcacaaaatatagtttgttgaataacagcaaatttaaaaaataacagcaacaattttttaaaaagtgacagggtgtcattttgtcactcaggctggagtgcagggaacaatttttttttttttagacggagtttttgctcttgttgcctaggctggactgcagtg

SEQ ID NO: 19858 - DNA, 601 bp, Human
tcttctctgcattgttgctggaagccaagtgtggaaagcccagagaccacagtgactgaagcctggagactcagagtggagccaagggaacagtgagtgcacagtggaaagggagaagtaggaagtcactgtagcctactgaggaatttgagctcaccctgagggaaaaatgaaataatgcaggaaaaataaaatcttcagacttgttgtttgaaagaccactctggctgcattttgcggttttgagtcaggaataaagattgatgtcagggaggttcagataagcaggttgagatgtccrattgtgagatccctctttgatgtctctctagttctagatcagatgctttgtaagagtttctaaattctaacatgggattccagggacacatctggtcaacattacggctgctaccagagaccctcctttgaagccacaaagggacatgatgagtagcagaaatgaattactactgatggagggagataaatctgtagcaacagggagaagacaggggtggttgtgtgaagatggaagtgagtttctgtcatttttgttgccctttgactgagtcagctgtcctaggatgagcattcatcc

SEQ ID NO: 19859 - DNA, 601 bp, Human
ttaatgttctctccacaaaaagataagtatatgaagtgatggatacattattagcttgatttaattattctacagtgtatatatatatcaaaacgttaattgcacttcataaatgtataaatttttttcaattaaaaataaataagtaattaaaaaagaaagctgtagctgaacctctagtgctgatggcccttaaaaggactggagtagtagaagaggatggactgcatggagcccagcaaaggaagacttgaagagtgatacttcttccctaagtctctagcgccatacagcagaaaayaggctttgactgccatgtgcacatctgctgtcaactccacccagctactagtacccttctctgattgtagtttggtttctaacacaattttttaaattttttattaatgagtaattgtgtgcgtaaatacatttttaaagggagataacatgttgatagcaaagggtagcatttttgtctatgtggcagataaaattctcaatgaagagtcatactttggtatcttggctactagatcaacctcttattgtggtgaggctgactttgtttccttgacactgaacaactctaggtaacctg

SEQ ID NO: 19860 - DNA, 601 bp, Human
ctaagatagtagatttttaatgttctctccacaaaaagataagtatatgaagtgatggatacattattagcttgatttaattattctacagtgtatatatatatcaaaacgttaattgcacttcataaatgtataaatttttttcaattaaaaataaataagtaattaaaaaagaaagctgtagctgaacctctagtgctgatggcccttaaaaggactggagtagtagaagaggatggactgcatggagcccagcaaaggaagacttgaagagtgatacttcttccctaagtctctagcrccatacagcagaaaataggctttgactgccatgtgcacatctgctgtcaactccacccagctactagtacccttctctgattgtagtttggtttctaacacaattttttaaattttttattaatgagtaattgtgtgcgtaaatacatttttaaagggagataacatgttgatagcaaagggtagcatttttgtctatgtggcagataaaattctcaatgaagagtcatactttggtatcttggctactagatcaacctcttattgtggtgaggctgactttgtttccttgacactgaac

SEQ ID NO: 19861 - DNA, 601 bp, Human
gactaggatggtggttaccagagtctggggggataaatgacgaataggaggatgttggtcaaaggttacaaaatttcggatagagtggaggaataatttctggaatttcattgtacgctctggtgactataattaataataatgtattgtatatctgaaaattgctaagatagtagatttttaatgttctctccacaaaaagataagtatatgaagtgatggatacattattagcttgatttaattattctacagtgtatatatatatcaaaacgttaattgcacttcataaatgtataartttttttcaattaaaaataaataagtaattaaaaaagaaagctgtagctgaacctctagtgctgatggcccttaaaaggactggagtagtagaagaggatggactgcatggagcccagcaaaggaagacttgaagagtgatacttcttccctaagtctctagcgccatacagcagaaaataggctttgactgccatgtgcacatctgctgtcaactccacccagctactagtacccttctctgattgtagtttggtttctaacacaattttttaaattttttattaatgagtaattgtgt

SEQ ID NO: 19862 - DNA, 601 bp, Human
tgatctcacttatatgtggaaaagacaagctcacagaagcagagactaggatggtggttaccagagtctggggggataaatgacgaataggaggatgttggtcaaaggttacaaaatttcggatagagtggaggaataatttctggaatttcattgtacgctctggtgactataattaataataatgtattgtatatctgaaaattgctaagatagtagatttttaatgttctctccacaaaaagataagtatatgaagtgatggatacattattagcttgatttaattattctacagtgtatatatatatcaaaacgttaattgcacttcataaatgtataaatttttttcaattaaaaataaataagtaattaaaaaagaaagctgtagctgaacctctagtgctgatggcccttaaaaggactggagtagtagaagaggatggactgcatggagcccagcaaaggaagacttgaagagtgatacttcttccctaagtctctagcgccatacagcagaaaataggctttgactgccatgtgcacatctgctgtcaactccacccagctactagtacccttctctgattgtagtttggtt

SEQ ID NO: 19863 - DNA, 601 bp, Human
gatttttcaatcagaaatcaatgcctgtctttttgcttttcttttattatataatttataacctgccttgattgtgtgtgtatgtgtgtttctttaaaagaccgtaaattttatgaaggcagaaactttttaaattccacattattatgaaagagtcttctgtatattgagtctttaataaatatttgtttcattgcattaaatggaaataatagataagatggtaagaaaagatgctgtaactggaatatgttattctacagactattatagcgatagaaaaatactacatagagaaatwcttaatatttcctaatgaggatgcaaagctgttaggattaaaacataaacaaaaggaaaagagaaaatctgctcaaggtaagtattaatacattctaaattggaaacaaaattactaagcaacaggtaaactgcaatattttccttatttactataatattaggtatacacacctctggcttttgctactcagaggaaataataaatatgtatatatattgcaaatagtaagaatattgttcttatgatggcttctttactataatgttgtggcatgtgttcagtatgattcttaatata

SEQ ID NO: 19864 - DNA, 601 bp, Human
cttgatttttcaatcagaaatcaatgcctgtctttttgcttttcttttattatataatttataacctgccttgattgtgtgtgtatgtgtgtttctttaaaagaccgtaaattttatgaaggcagaaactttttaaattccacattattatgaaagagtcttctgtatattgagtctttaataaatatttgtttcattgcattaaatggaaataatagataagatggtaagaaaagatgctgtaactggaatatgttattctacagactattatagcgatagaaaaatactacatagagarattcttaatatttcctaatgaggatgcaaagctgttaggattaaaacataaacaaaaggaaaagagaaaatctgctcaaggtaagtattaatacattctaaattggaaacaaaattactaagcaacaggtaaactgcaatattttccttatttactataatattaggtatacacacctctggcttttgctactcagaggaaataataaatatgtatatatattgcaaatagtaagaatattgttcttatgatggcttctttactataatgttgtggcatgtgttcagtatgattcttaat

SEQ ID NO: 19865 - DNA, 601 bp, Human
cttccaagacattctgtctatgaaacttttcttgatttttcaatcagaaatcaatgcctgtctttttgcttttcttttattatataatttataacctgccttgattgtgtgtgtatgtgtgtttctttaaaagaccgtaaattttatgaaggcagaaactttttaaattccacattattatgaaagagtcttctgtatattgagtctttaataaatatttgtttcattgcattaaatggaaataatagataagatggtaagaaaagatgctgtaactggaatatgttattctacagactaytatagcgatagaaaaatactacatagagaaattcttaatatttcctaatgaggatgcaaagctgttaggattaaaacataaacaaaaggaaaagagaaaatctgctcaaggtaagtattaatacattctaaattggaaacaaaattactaagcaacaggtaaactgcaatattttccttatttactataatattaggtatacacacctctggcttttgctactcagaggaaataataaatatgtatatatattgcaaatagtaagaatattgttcttatgatggcttctttactataatg

SEQ ID NO: 19866 - DNA, 601 bp, Human
ttgacgctgctccctcagactgatgtacttttaaccttattttctttaattaaagtataacctatactcctaggcctgacttccaagacattctgtctatgaaacttttcttgatttttcaatcagaaatcaatgcctgtctttttgcttttcttttattatataatttataacctgccttgattgtgtgtgtatgtgtgtttctttaaaagaccgtaaattttatgaaggcagaaactttttaaattccacattattatgaaagagtcttctgtatattgagtctttaataaatatttgwttcattgcattaaatggaaataatagataagatggtaagaaaagatgctgtaactggaatatgttattctacagactattatagcgatagaaaaatactacatagagaaattcttaatatttcctaatgaggatgcaaagctgttaggattaaaacataaacaaaaggaaaagagaaaatctgctcaaggtaagtattaatacattctaaattggaaacaaaattactaagcaacaggtaaactgcaatattttccttatttactataatattaggtatacacacctctggcttttgcta

SEQ ID NO: 19867 - DNA, 601 bp, Human
cagtacaagaactgcgaacagattgttgcactttcttctcatgccgtagttgacgctgctccctcagactgatgtacttttaaccttattttctttaattaaagtataacctatactcctaggcctgacttccaagacattctgtctatgaaacttttcttgatttttcaatcagaaatcaatgcctgtctttttgcttttcttttattatataatttataacctgccttgattgtgtgtgtatgtgtgtttctttaaaagaccgtaaattttatgaaggcagaaactttttaaattccayattattatgaaagagtcttctgtatattgagtctttaataaatatttgtttcattgcattaaatggaaataatagataagatggtaagaaaagatgctgtaactggaatatgttattctacagactattatagcgatagaaaaatactacatagagaaattcttaatatttcctaatgaggatgcaaagctgttaggattaaaacataaacaaaaggaaaagagaaaatctgctcaaggtaagtattaatacattctaaattggaaacaaaattactaagcaacaggtaaactgcaatat

SEQ ID NO: 19868 - DNA, 601 bp, Human
tattgctttccttttaaaattggatcactattaatttgacatctatatttcgaatagtcctcatttggttgtattaatattacagtgatttacttgatcactccaaatcaccagtttggaatgaagtccaatttgttttgcatggcatgaaagcatttttattgtctgacctctgtttaccttccagcttcatccccatgatattcccagtacaagaactgcgaacagattgttgcactttcttctcatgccgtagttgacgctgctccctcagactgatgtacttttaaccttattttctttaattaaagtataacctatactcctaggcctgacttccaagacattctgtctatgaaacttttcttgatttttcaatcagaaatcaatgcctgtctttttgcttttcttttattatataatttataacctgccttgattgtgtgtgtatgtgtgtttctttaaaagaccgtaaattttatgaaggcagaaactttttaaattccacattattatgaaagagtcttctgtatattgagtctttaataaatatttgtttcattgcattaaatggaaataatagataagatggtaagaaaag

SEQ ID NO: 19869 - DNA, 601 bp, Human
aagagtcaggaggaagtgggggcatgaacatatgaattaaagacagccttctattaaactctatgatatagccaatggaggaaatctgccaatgcgaaaatggatgcattactacttaaatttggagaattatttagtgttcattaagattataagaaacaaacccaagtaaaaataattcccttgttttactttttcccttcagtgttatctgaacaaaatttgaaaacccacacattctgaagggtttattgctttccttttaaaattggatcactattaatttgacatctatatttcraatagtcctcatttggttgtattaatattacagtgatttacttgatcactccaaatcaccagtttggaatgaagtccaatttgttttgcatggcatgaaagcatttttattgtctgacctctgtttaccttccagcttcatccccatgatattcccagtacaagaactgcgaacagattgttgcactttcttctcatgccgtagttgacgctgctccctcagactgatgtacttttaaccttattttctttaattaaagtataacctatactcctaggcctgacttccaagacattctgt

SEQ ID NO: 19870 - DNA, 601 bp, Human
acaaacttctcactgttgatgtcaatacctatgattctggaagctcctgctgctttacaacccattacagcagaaagacccacacctcctaggccaaagacagcacaagtcgaaccaggggtgacctgcaagcaggaaaattataaagtaacttctaaagcagccagtcccactttttttcttttaagagtcaggaggaagtgggggcatgaacatatgaattaaagacagccttctattaaactctatgatatagccaatggaggaaatctgccaatgcgaaaatggatgcattactacytaaatttggagaattatttagtgttcattaagattataagaaacaaacccaagtaaaaataattcccttgttttactttttcccttcagtgttatctgaacaaaatttgaaaacccacacattctgaagggtttattgctttccttttaaaattggatcactattaatttgacatctatatttcgaatagtcctcatttggttgtattaatattacagtgatttacttgatcactccaaatcaccagtttggaatgaagtccaatttgttttgcatggcatgaaagcatttttattgtct

SEQ ID NO: 19871 - DNA, 601 bp, Human
tcctggatcggtttatgtaagtctctaggattgaggcagtcagtggctcccagggctttagccttcacaaacttctcactgttgatgtcaatacctatgattctggaagctcctgctgctttacaacccattacagcagaaagacccacacctcctaggccaaagacagcacaagtcgaaccaggggtgacctgcaagcaggaaaattataaagtaacttctaaagcagccagtcccactttttttcttttaagagtcaggaggaagtgggggcatgaacatatgaattaaagacagcctkctattaaactctatgatatagccaatggaggaaatctgccaatgcgaaaatggatgcattactacttaaatttggagaattatttagtgttcattaagattataagaaacaaacccaagtaaaaataattcccttgttttactttttcccttcagtgttatctgaacaaaatttgaaaacccacacattctgaagggtttattgctttccttttaaaattggatcactattaatttgacatctatatttcgaatagtcctcatttggttgtattaatattacagtgatttacttgatcac

SEQ ID NO: 19872 - DNA, 601 bp, Human
agatccacctgcacagtcaagggcaaaatccacacctcccttggtcaattcaatgataacttcctggatcggtttatgtaagtctctaggattgaggcagtcagtggctcccagggctttagccttcacaaacttctcactgttgatgtcaatacctatgattctggaagctcctgctgctttacaacccattacagcagaaagacccacacctcctaggccaaagacagcacaagtcgaaccaggggtgacctgcaagcaggaaaattataaagtaacttctaaagcagccagtcccactttttttcttttaagagtcaggaggaagtgggggcatgaacatatgaattaaagacagccttctattaaactctatgatatagccaatggaggaaatctgccaatgcgaaaatggatgcattactacttaaatttggagaattatttagtgttcattaagattataagaaacaaacccaagtaaaaataattcccttgttttactttttcccttcagtgttatctgaacaaaatttgaaaacccacacattctgaagggtttattgctttccttttaaaattggatcactattaatttgac

SEQ ID NO: 19873 - DNA, 601 bp, Human
actcaccaagatagtactggcatttggggggacacattcatgggcattgaaggaaatggagtatagctgagggaatgggaaatgatttgtggcttatagttctaccaccctgtcatccatttgaaagtactaagtaccataataaacataatccactttcccctattatttgacagccaaagaatacattgaaaatatgatccaagaacaaaatatacataccatggtttcagatccacctgcacagtcaagggcaaaatccacacctcccttggtcaattcaatgataacttcctggatmggtttatgtaagtctctaggattgaggcagtcagtggctcccagggctttagccttcacaaacttctcactgttgatgtcaatacctatgattctggaagctcctgctgctttacaacccattacagcagaaagacccacacctcctaggccaaagacagcacaagtcgaaccaggggtgacctgcaagcaggaaaattataaagtaacttctaaagcagccagtcccactttttttcttttaagagtcaggaggaagtgggggcatgaacatatgaattaaagacagccttctattaaa

SEQ ID NO: 19874 - DNA, 601 bp, Human
acatttctctaattaaaaatgaaaaaacccctaaaattgtctccaaggaataggaattggaattatcatagaaaacaaaattagaaaatattatctccagacaaataatattgagctttttaaagggatctcaaaagaaaaatcagcatctacaaataatgctggtatggcttcttatcacaagagaagactgaactcaccaagatagtactggcatttggggggacacattcatgggcattgaaggaaatggagtatagctgagggaatgggaaatgatttgtggcttatagttctaccmccctgtcatccatttgaaagtactaagtaccataataaacataatccactttcccctattatttgacagccaaagaatacattgaaaatatgatccaagaacaaaatatacataccatggtttcagatccacctgcacagtcaagggcaaaatccacacctcccttggtcaattcaatgataacttcctggatcggtttatgtaagtctctaggattgaggcagtcagtggctcccagggctttagccttcacaaacttctcactgttgatgtcaatacctatgattctggaagctcctg

SEQ ID NO: 19875 - DNA, 601 bp, Human
actttctatagaagcttttcctagctatagaaacttttggtgggagagtaggtaactcatcttttggtgattaaataaatctttctctttccatttggattctctaatataattctgttccataattgaaaatgactttcatggtataataagtcagcttaataatagaagatgctaatttttaggtcagtggttctcaacttgagaaattaatttttaaaatgttgtcagtgggctcccagcacacaagaatatcctgggtttggcccattcattggtattaaaaaagcaacaaaacaaygaaaaacccctcaggaaattctaacatatagctagtgttgagaatatgttaatattaaatataacaacacatgcacatattgtttattaattttaaatattatatactgttaaagaaaagattctacattaacaaatgttaatattaataatgtatataatgcataagatagctaaacaaaataggtgtttattcctatttatgcattgcagttaattcatccctttatatctttggctaaagaatgctgtctagttaatgcacttgtcattttatttgatttaatagtcaaaaggaaca

SEQ ID NO: 19876 - DNA, 601 bp, Human
gtgctggtaagctacagggtgttgacccttggtttagagggttagaggtcattggaacctagaaactttctatagaagcttttcctagctatagaaacttttggtgggagagtaggtaactcatcttttggtgattaaataaatctttctctttccatttggattctctaatataattctgttccataattgaaaatgactttcatggtataataagtcagcttaataatagaagatgctaatttttaggtcagtggttctcaacttgagaaattaatttttaaaatgttgtcagtgggcycccagcacacaagaatatcctgggtttggcccattcattggtattaaaaaagcaacaaaacaacgaaaaacccctcaggaaattctaacatatagctagtgttgagaatatgttaatattaaatataacaacacatgcacatattgtttattaattttaaatattatatactgttaaagaaaagattctacattaacaaatgttaatattaataatgtatataatgcataagatagctaaacaaaataggtgtttattcctatttatgcattgcagttaattcatccctttatatctttg

SEQ ID NO: 19877 - DNA, 601 bp, Human
gtatcactacattcagctccttaaaagggtccttagcaggtgttagtaaacaatccttgtgctggtaagctacagggtgttgacccttggtttagagggttagaggtcattggaacctagaaactttctatagaagcttttcctagctatagaaacttttggtgggagagtaggtaactcatcttttggtgattaaataaatctttctctttccatttggattctctaatataattctgttccataattgaaaatgactttcatggtataataagtcagcttaataatagaagatgctaayttttaggtcagtggttctcaacttgagaaattaatttttaaaatgttgtcagtgggctcccagcacacaagaatatcctgggtttggcccattcattggtattaaaaaagcaacaaaacaacgaaaaacccctcaggaaattctaacatatagctagtgttgagaatatgttaatattaaatataacaacacatgcacatattgtttattaattttaaatattatatactgttaaagaaaagattctacattaacaaatgttaatattaataatgtatataatgcataagatagctaaac

SEQ ID NO: 19878 - DNA, 601 bp, Human
tgctgggggttatcaaagctctaaaaaattaatcactgcaaggttataaaatctttctacagcttccagtcaggtcatagactccagtatcactacattcagctccttaaaagggtccttagcaggtgttagtaaacaatccttgtgctggtaagctacagggtgttgacccttggtttagagggttagaggtcattggaacctagaaactttctatagaagcttttcctagctatagaaacttttggtgggagagtaggtaactcatcttttggtgattaaataaatctttctctttccrtttggattctctaatataattctgttccataattgaaaatgactttcatggtataataagtcagcttaataatagaagatgctaatttttaggtcagtggttctcaacttgagaaattaatttttaaaatgttgtcagtgggctcccagcacacaagaatatcctgggtttggcccattcattggtattaaaaaagcaacaaaacaacgaaaaacccctcaggaaattctaacatatagctagtgttgagaatatgttaatattaaatataacaacacatgcacatattgtttattaatt

SEQ ID NO: 19879 - DNA, 601 bp, Human
ctctgacttattgctgggggttatcaaagctctaaaaaattaatcactgcaaggttataaaatctttctacagcttccagtcaggtcatagactccagtatcactacattcagctccttaaaagggtccttagcaggtgttagtaaacaatccttgtgctggtaagctacagggtgttgacccttggtttagagggttagaggtcattggaacctagaaactttctatagaagcttttcctagctatagaaacttttggtgggagagtaggtaactcatcttttggtgattaaataaatcyttctctttccatttggattctctaatataattctgttccataattgaaaatgactttcatggtataataagtcagcttaataatagaagatgctaatttttaggtcagtggttctcaacttgagaaattaatttttaaaatgttgtcagtgggctcccagcacacaagaatatcctgggtttggcccattcattggtattaaaaaagcaacaaaacaacgaaaaacccctcaggaaattctaacatatagctagtgttgagaatatgttaatattaaatataacaacacatgcacatatt

SEQ ID NO: 19880 - DNA, 601 bp, Human
ttacatccatacatcctcatgtattgcctttaaagtcttttgatgatttatttggctaaataagtaactattgttttacaatgacctgtggttctgttttaatcaaatgttttgaggcctttaacatttttgacaaacactttcaaaattaaattctaaattaagtctctgacttattgctgggggttatcaaagctctaaaaaattaatcactgcaaggttataaaatctttctacagcttccagtcaggtcatagactccagtatcactacattcagctccttaaaagggtccttagcwggtgttagtaaacaatccttgtgctggtaagctacagggtgttgacccttggtttagagggttagaggtcattggaacctagaaactttctatagaagcttttcctagctatagaaacttttggtgggagagtaggtaactcatcttttggtgattaaataaatctttctctttccatttggattctctaatataattctgttccataattgaaaatgactttcatggtataataagtcagcttaataatagaagatgctaatttttaggtcagtggttctcaacttgagaaattaattt

SEQ ID NO: 19881 - DNA, 601 bp, Human
tactaagaattatgtattcccctgctgtactcataatcctgaacacacttttcccatgtctgattaaattcaagcacttttcccatcaggtttattgaaatgggcttcccataaggagaagcagtcacactaccagtttttctttccatttctggtaactgacttaagaaacaacattttacattttatcaaaataattcccatgttgtctacattaggtttttaattgcttaaaaaaatagtgttaaggtttttacatccatacatcctcatgtattgcctttaaagtcttttgatgatytatttggctaaataagtaactattgttttacaatgacctgtggttctgttttaatcaaatgttttgaggcctttaacatttttgacaaacactttcaaaattaaattctaaattaagtctctgacttattgctgggggttatcaaagctctaaaaaattaatcactgcaaggttataaaatctttctacagcttccagtcaggtcatagactccagtatcactacattcagctccttaaaagggtccttagcaggtgttagtaaacaatccttgtgctggtaagctacagggtgttgacc

SEQ ID NO: 19882 - DNA, 601 bp, Human
cccttggacagagataactcttttctttagctttttcatcagctattataagtttttttcctccagttctaactattcttatggcctgatactaaaatgttttatcttaaaggtctaggagtgaatgttttcctccagtacaacttgattctgtactcttggcttttcttgatatgtttaaatttttcaatgtaaccagaaaatttctcatgcagttactaagaattatgtattcccctgctgtactcataatcctgaacacacttttcccatgtctgattaaattcaagcacttttcccrtcaggtttattgaaatgggcttcccataaggagaagcagtcacactaccagtttttctttccatttctggtaactgacttaagaaacaacattttacattttatcaaaataattcccatgttgtctacattaggtttttaattgcttaaaaaaatagtgttaaggtttttacatccatacatcctcatgtattgcctttaaagtcttttgatgatttatttggctaaataagtaactattgttttacaatgacctgtggttctgttttaatcaaatgttttgaggcctttaacatttttg

SEQ ID NO: 19883 - DNA, 601 bp, Human
tacaattaaaagaaacttaacttttagttttataacctgtttcttttgaaaacttctcaaaatcatatgtcagttcaccttttgctatgtctccctgctttcagctttgtctccccttggacagagataactcttttctttagctttttcatcagctattataagtttttttcctccagttctaactattcttatggcctgatactaaaatgttttatcttaaaggtctaggagtgaatgttttcctccagtacaacttgattctgtactcttggcttttcttgatatgtttaaatttttsaatgtaaccagaaaatttctcatgcagttactaagaattatgtattcccctgctgtactcataatcctgaacacacttttcccatgtctgattaaattcaagcacttttcccatcaggtttattgaaatgggcttcccataaggagaagcagtcacactaccagtttttctttccatttctggtaactgacttaagaaacaacattttacattttatcaaaataattcccatgttgtctacattaggtttttaattgcttaaaaaaatagtgttaaggtttttacatccatacatcctca

SEQ ID NO: 19884 - DNA, 601 bp, Human
tcagaagtccaagcatgtcatagatcatctgtgtaagtcatagtaagtttcatgaagaggaatttataaaaaaattttgtatgtgattaaatttgctgtgattaaaaaaggattatttagaatagtctttctaagattattcccctatgttaaaacaaagtctctttacagtattgatttgctcttaatacaattaaaagaaacttaacttttagttttataacctgtttcttttgaaaacttctcaaaatcatatgtcagttcaccttttgctatgtctccctgctttcagctttgtctmcccttggacagagataactcttttctttagctttttcatcagctattataagtttttttcctccagttctaactattcttatggcctgatactaaaatgttttatcttaaaggtctaggagtgaatgttttcctccagtacaacttgattctgtactcttggcttttcttgatatgtttaaatttttcaatgtaaccagaaaatttctcatgcagttactaagaattatgtattcccctgctgtactcataatcctgaacacacttttcccatgtctgattaaattcaagcacttttccc

SEQ ID NO: 19885 - DNA, 601 bp, Human
ggcatgacccactgtgcctggcctgtattcttattaaagaataattttacataatttggaaattattttaaagttatttacttaaaaagataaaaaaaagtaagtaggggagagaaatataaagttataaatataaaaatgtatttttaataaaagggttattaaaaaagaataatttcatataaaaaagaatcttatggtaaaatcttgtcctaaaataaaatgacttattatttaaaaggaaaaaattaggataagtcagaagtccaagcatgtcatagatcatctgtgtaagtcatartaagtttcatgaagaggaatttataaaaaaattttgtatgtgattaaatttgctgtgattaaaaaaggattatttagaatagtctttctaagattattcccctatgttaaaacaaagtctctttacagtattgatttgctcttaatacaattaaaagaaacttaacttttagttttataacctgtttcttttgaaaacttctcaaaatcatatgtcagttcaccttttgctatgtctccctgctttcagctttgtctccccttggacagagataactcttttctttagctttttcatcag

SEQ ID NO: 19886 - DNA, 601 bp, Human
cctgactaattttcatatttttagtagaggtgggtttttgccatgttgcccaggctgctctcgaactcctgggctcaagcagtctgcccacctcagccttccaaagtgctggaattacaggcatgacccactgtgcctggcctgtattcttattaaagaataattttacataatttggaaattattttaaagttatttacttaaaaagataaaaaaaagtaagtaggggagagaaatataaagttataaatataaaaatgtatttttaataaaagggttattaaaaaagaataatttcatrtaaaaaagaatcttatggtaaaatcttgtcctaaaataaaatgacttattatttaaaaggaaaaaattaggataagtcagaagtccaagcatgtcatagatcatctgtgtaagtcatagtaagtttcatgaagaggaatttataaaaaaattttgtatgtgattaaatttgctgtgattaaaaaaggattatttagaatagtctttctaagattattcccctatgttaaaacaaagtctctttacagtattgatttgctcttaatacaattaaaagaaacttaacttttagttttataac

SEQ ID NO: 19887 - DNA, 601 bp, Human
tagctcactgcagcctcaacttcctgggcttaagttattttctcaccttaccctcccaagtagctggtactataggcgtgtgccactacacctgactaattttcatatttttagtagaggtgggtttttgccatgttgcccaggctgctctcgaactcctgggctcaagcagtctgcccacctcagccttccaaagtgctggaattacaggcatgacccactgtgcctggcctgtattcttattaaagaataattttacataatttggaaattattttaaagttatttacttaaaaagatwaaaaaaagtaagtaggggagagaaatataaagttataaatataaaaatgtatttttaataaaagggttattaaaaaagaataatttcatataaaaaagaatcttatggtaaaatcttgtcctaaaataaaatgacttattatttaaaaggaaaaaattaggataagtcagaagtccaagcatgtcatagatcatctgtgtaagtcatagtaagtttcatgaagaggaatttataaaaaaattttgtatgtgattaaatttgctgtgattaaaaaaggattatttagaatagtctttctaa

SEQ ID NO: 19888 - DNA, 601 bp, Human
aaaatttaaggttactaggaataagaattctaattcatatataaatatataattgtattatctttttttttgaggcagtctcactctgttgcccaggctacagtggagtggcgtgatcatagctcactgcagcctcaacttcctgggcttaagttattttctcaccttaccctcccaagtagctggtactataggcgtgtgccactacacctgactaattttcatatttttagtagaggtgggtttttgccatgttgcccaggctgctctcgaactcctgggctcaagcagtctgcccacmtcagccttccaaagtgctggaattacaggcatgacccactgtgcctggcctgtattcttattaaagaataattttacataatttggaaattattttaaagttatttacttaaaaagataaaaaaaagtaagtaggggagagaaatataaagttataaatataaaaatgtatttttaataaaagggttattaaaaaagaataatttcatataaaaaagaatcttatggtaaaatcttgtcctaaaataaaatgacttattatttaaaaggaaaaaattaggataagtcagaagtccaagca

SEQ ID NO: 19889 - DNA, 601 bp, Human
taatgtttagactttagttaacaagggccaggcatggtggctcacgcctgtaatcccagcactttgggaggccaaggcaggtggatcacttgagatcaggagttcaagaccagcctggccaacatggagaaaccccgtctctactaaaaatacaaaaaagtagccagacatggcagcatgtgcctgtagtcccagctactcaggagtctgaggaaggaaaattgcttgagcccaggaggtggaggttgcggtgagccaaaatcgtgccactgcactccaccgggcgacagagtgagactcyatctcaaaaaaaaagttaacaaggaaataactttaaataatggctagttctgcataatatctcagttatcaaaagttatctagataactattaaaaatgaaaaagtatatgtaaatgaaataaatgcttataagtggactttttgtgtaatataaaatctgaaaattattttaaattaaataataaatgctggatatgtgagtcatttccaattaaaaaattatgatataggaaaacatgtttctaaaattgtgaaatgatttcatctataaaatgcttacatctaacagttcaggattt

SEQ ID NO: 19890 - DNA, 601 bp, Human
cagcaaaatacctatgtgtttaaccttatggttcttacttaggttttcacctaatgtttagactttagttaacaagggccaggcatggtggctcacgcctgtaatcccagcactttgggaggccaaggcaggtggatcacttgagatcaggagttcaagaccagcctggccaacatggagaaaccccgtctctactaaaaatacaaaaaagtagccagacatggcagcatgtgcctgtagtcccagctactcaggagtctgaggaaggaaaattgcttgagcccaggaggtggaggttgcrgtgagccaaaatcgtgccactgcactccaccgggcgacagagtgagactccatctcaaaaaaaaagttaacaaggaaataactttaaataatggctagttctgcataatatctcagttatcaaaagttatctagataactattaaaaatgaaaaagtatatgtaaatgaaataaatgcttataagtggactttttgtgtaatataaaatctgaaaattattttaaattaaataataaatgctggatatgtgagtcatttccaattaaaaaattatgatataggaaaacatgtttctaaaa

SEQ ID NO: 19891 - DNA, 601 bp, Human
agtaaataagttttatatttgcctctgctaaatgtttaaagtgtcagggtttgggacaaaggttgtgagactgtaaacccagccaaatctatcattgtgtgacttttttttttttgacaaataagactaatttaaaattgttaggtcaataacagcaactgaatcacctaatttatcagcaaaatacctatgtgtttaaccttatggttcttacttaggttttcacctaatgtttagactttagttaacaagggccaggcatggtggctcacgcctgtaatcccagcactttgggaggccraggcaggtggatcacttgagatcaggagttcaagaccagcctggccaacatggagaaaccccgtctctactaaaaatacaaaaaagtagccagacatggcagcatgtgcctgtagtcccagctactcaggagtctgaggaaggaaaattgcttgagcccaggaggtggaggttgcggtgagccaaaatcgtgccactgcactccaccgggcgacagagtgagactccatctcaaaaaaaaagttaacaaggaaataactttaaataatggctagttctgcataatatctcagttatcaaa

SEQ ID NO: 19892 - DNA, 601 bp, Human
agcctgggtcacagagtgagactctgtctcaaaaaaaaaaaaaattattagtaaaataaaaataaagatgtctaaaaaatcagcatacatttgtgtgtaagtaaataagttttatatttgcctctgctaaatgtttaaagtgtcagggtttgggacaaaggttgtgagactgtaaacccagccaaatctatcattgtgtgacttttttttttttgacaaataagactaatttaaaattgttaggtcaataacagcaactgaatcacctaatttatcagcaaaatacctatgtgtttaaccktatggttcttacttaggttttcacctaatgtttagactttagttaacaagggccaggcatggtggctcacgcctgtaatcccagcactttgggaggccaaggcaggtggatcacttgagatcaggagttcaagaccagcctggccaacatggagaaaccccgtctctactaaaaatacaaaaaagtagccagacatggcagcatgtgcctgtagtcccagctactcaggagtctgaggaaggaaaattgcttgagcccaggaggtggaggttgcggtgagccaaaatcgtgccactgcac

SEQ ID NO: 19893 - DNA, 601 bp, Human
ctgtagtcccagctactcgggaagctgagactggagaactgcctgaacccgggaggaggaggaggttgcagtgagccgagaccacaccactgcactgcagcctgggtcacagagtgagactctgtctcaaaaaaaaaaaaaattattagtaaaataaaaataaagatgtctaaaaaatcagcatacatttgtgtgtaagtaaataagttttatatttgcctctgctaaatgtttaaagtgtcagggtttgggacaaaggttgtgagactgtaaacccagccaaatctatcattgtgtgacttttttttttttgacaaataagactaatttaaaattgttaggtcaataacagcaactgaatcacctaatttatcagcaaaatacctatgtgtttaaccttatggttcttacttaggttttcacctaatgtttagactttagttaacaagggccaggcatggtggctcacgcctgtaatcccagcactttgggaggccaaggcaggtggatcacttgagatcaggagttcaagaccagcctggccaacatggagaaaccccgtctctactaaaaatacaaaaaagtagccagacatggcagc

SEQ ID NO: 19894 - DNA, 601 bp, Human
ttgtgcctgcctgtagtcccagctactcgggaagctgagactggagaactgcctgaacccgggaggaggaggaggttgcagtgagccgagaccacaccactgcactgcagcctgggtcacagagtgagactctgtctcaaaaaaaaaaaaaattattagtaaaataaaaataaagatgtctaaaaaatcagcatacatttgtgtgtaagtaaataagttttatatttgcctctgctaaatgtttaaagtgtcagggtttgggacaaaggttgtgagactgtaaacccagccaaatctatcrttgtgtgacttttttttttttgacaaataagactaatttaaaattgttaggtcaataacagcaactgaatcacctaatttatcagcaaaatacctatgtgtttaaccttatggttcttacttaggttttcacctaatgtttagactttagttaacaagggccaggcatggtggctcacgcctgtaatcccagcactttgggaggccaaggcaggtggatcacttgagatcaggagttcaagaccagcctggccaacatggagaaaccccgtctctactaaaaatacaaaaaagtagccag

SEQ ID NO: 19895 - DNA, 601 bp, Human
ttgatcctagtcttactaatcccccaacccctaagaatcttccaggtggaacatttctatgcatcagttcctgggatccctgacatgggagcactgtataactaaaatagtggatcagaaggtatcttagaggaactccatgacaaagcaagagaatgagacagttggggcatcctttacatgtctgatccctgccacagaggcatggttttcaccccattctgattgtgaagggtctggggtaggcactctgtgtcaaactgcagaacaccacggtgctaaactcaggggtacactgtaytagagggatctaacattatactacacagaaacctctctttctagggagcagccccaactgagttaatggtttgtgaaatggaaattgtatcaatttatgccaccattctatattgtaacagtgtacagatgtgcattattgaaatggaaggttttcccctctgaaatgaccactatttaatcttttaagcacatctagtacctgggatgtggaaaatgtcagaaaaaacaagctggttgcttcttaacatcaaaaagaagatagaatcattgtaaacgttttttaaatcattcagtcatc

SEQ ID NO: 19896 - DNA, 601 bp, Human
atgtttttgacctttgtttctattgatcaaggctgtgcttgaacattttacctagaatcattgatcctagtcttactaatcccccaacccctaagaatcttccaggtggaacatttctatgcatcagttcctgggatccctgacatgggagcactgtataactaaaatagtggatcagaaggtatcttagaggaactccatgacaaagcaagagaatgagacagttggggcatcctttacatgtctgatccctgccacagaggcatggttttcaccccattctgattgtgaagggtctggrgtaggcactctgtgtcaaactgcagaacaccacggtgctaaactcaggggtacactgtactagagggatctaacattatactacacagaaacctctctttctagggagcagccccaactgagttaatggtttgtgaaatggaaattgtatcaatttatgccaccattctatattgtaacagtgtacagatgtgcattattgaaatggaaggttttcccctctgaaatgaccactatttaatcttttaagcacatctagtacctgggatgtggaaaatgtcagaaaaaacaagctggttgc

SEQ ID NO: 19897 - DNA, 601 bp, Human
caaagttggtgtgttgggatgctactttttaagaacccagatgttcttatttctgggtaactccaacatgtagacacaaagagggggataagcctcaacgacagagcagtccttatctcaaacattactgctggaactgtggaacccctgctatgagcagggtgctatgcataaatgttttcttcacccaggactggaagacacccctacctgtggaaggagaatctctgtgtcctttcctcactctggggcaggatcactacacctcaacaggctagtcagtcattgtatcccatccccwtccccccacttccttgcttctttgcagttgggtggtaggagggcctgccctctcttgtgcttcctgtgcccatatggtggacacacctgatgaggcccaacttctgccttcctcattgccacctttccatctgtgtgggcagtcaggtggtattctcagtgggccagagaaggagcaggaggcctcactctggtgtctacccctaggctgattaccagggaagcctcctgggagaatgtgggagacttgcccataaagcaatgcagcattttccacctggctgccacttagcattcctta

SEQ ID NO: 19898 - DNA, 601 bp, Human
aaacaatttctaaagatgatatgattctattcataaacactagttattattattatttaacatagggaatattcatatatataacaggtacaaagtctataatatttaaagctcttttatgttcccatattaaatgtaaatatttgtttaaacgcatggctttccttggttcatcaaatcaggtaataaattaaccaggcaggttcacattcaatcagatagtattccgaattgctcctggcatcttcaaaagatgaggattgttcggacgctgttaataacaataaaacattaataagtrtaattttcatgataaatttaaccaaagctcacaaataagttttgccttttcatttcaggatctggtcttcctttatagacattcactttattaagcctaatttcttttatcccgtcatcctcttccattcatggtgttaataatattttatgcatgtgctagtaaacttggggggaattgaggacccttacttaccttaggcagcgtccttgttactcagtggtgctgttgaggagaattagaatgtaccaaggagggagtcaggttttagtcttggaatagtcactgttctcggatctc

SEQ ID NO: 19899 - DNA, 601 bp, Human
tccccactttcaacttcccagaactaattttaaacaatttctaaagatgatatgattctattcataaacactagttattattattatttaacatagggaatattcatatatataacaggtacaaagtctataatatttaaagctcttttatgttcccatattaaatgtaaatatttgtttaaacgcatggctttccttggttcatcaaatcaggtaataaattaaccaggcaggttcacattcaatcagatagtattccgaattgctcctggcatcttcaaaagatgaggattgttcggaygctgttaataacaataaaacattaataagtgtaattttcatgataaatttaaccaaagctcacaaataagttttgccttttcatttcaggatctggtcttcctttatagacattcactttattaagcctaatttcttttatcccgtcatcctcttccattcatggtgttaataatattttatgcatgtgctagtaaacttggggggaattgaggacccttacttaccttaggcagcgtccttgttactcagtggtgctgttgaggagaattagaatgtaccaaggagggagtcaggtttt

SEQ ID NO: 19900 - DNA, 601 bp, Human
ataaacatatggccaatctagttttatttattatctcttcattccccactttcaacttcccagaactaattttaaacaatttctaaagatgatatgattctattcataaacactagttattattattatttaacatagggaatattcatatatataacaggtacaaagtctataatatttaaagctcttttatgttcccatattaaatgtaaatatttgtttaaacgcatggctttccttggttcatcaaatcaggtaataaattaaccaggcaggttcacattcaatcagatagtattcygaattgctcctggcatcttcaaaagatgaggattgttcggacgctgttaataacaataaaacattaataagtgtaattttcatgataaatttaaccaaagctcacaaataagttttgccttttcatttcaggatctggtcttcctttatagacattcactttattaagcctaatttcttttatcccgtcatcctcttccattcatggtgttaataatattttatgcatgtgctagtaaacttggggggaattgaggacccttacttaccttaggcagcgtccttgttactcagtggtgct

SEQ ID NO: 19901 - DNA, 601 bp, Human
ttttcaacatagacaaaagtggagagaaaagtataatgaaactccatgtattcattacccaatctaaaaaaattataaacatatggccaatctagttttatttattatctcttcattccccactttcaacttcccagaactaattttaaacaatttctaaagatgatatgattctattcataaacactagttattattattatttaacatagggaatattcatatatataacaggtacaaagtctataatatttaaagctcttttatgttcccatattaaatgtaaatatttgtttaaackcatggctttccttggttcatcaaatcaggtaataaattaaccaggcaggttcacattcaatcagatagtattccgaattgctcctggcatcttcaaaagatgaggattgttcggacgctgttaataacaataaaacattaataagtgtaattttcatgataaatttaaccaaagctcacaaataagttttgccttttcatttcaggatctggtcttcctttatagacattcactttattaagcctaatttcttttatcccgtcatcctcttccattcatggtgttaataatattttatgc

SEQ ID NO: 19902 - DNA, 601 bp, Human
atactgacctattttcaaataaaaaaaaacaaagcaaagctgtttctaaagttaataccaactctgctaactctgttgtttttagaacgataaacatactttaccaataatatagtcttgattttaaagaatttttaaatatatattttgataaaaattacatttgtaagaaacctaaaattcatgacactttcttggccattttgcatcccagaattagcattttccattcttaatggcaggaacgtttcttccaacatctgggcatgagaccctggtttcccattgaactactgcagcragtgcagcacatgctactgagacgattgaagtgtccttgtggaaacatttggcttcctggagcaattgcccagctatccggaaatcaaattatgaataatgccaatataaatcaatttctctattttccaccaatgtcttgctgacattggatatactatttccaacttacccctgcttccactgacattctctgaaacaccatatccagtgtttccctcactgtatgcctgctcaccaagcatttcattcctcaaggaatatctccaagtgtttaattactttaatggattcaaagttc

SEQ ID NO: 19903 - DNA, 601 bp, Human
aaacttatttcaaattctaacatcatagagtctcctgacttgtcacattacccagacttctcatgtcatctttatttttccaaaaccttaagcaagctaaatgcaaaattgttcaagttaaaacaaaacaaacaaaaaaatttagtcctttaagcaattatgtacccatttaaagtaaggaaatatactgacctattttcaaataaaaaaaaacaaagcaaagctgtttctaaagttaataccaactctgctaactctgttgtttttagaacgataaacatactttaccaataatatagtgttgattttaaagaatttttaaatatatattttgataaaaattacatttgtaagaaacctaaaattcatgacactttcttggccattttgcatcccagaattagcattttccattcttaatggcaggaacgtttcttccaacatctgggcatgagaccctggtttcccattgaactactgcagcgagtgcagcacatgctactgagacgattgaagtgtccttgtggaaacatttggcttcctggagcaattgcccagctatccggaaatcaaattatgaataatgccaatataaatcaat

SEQ ID NO: 19904 - DNA, 601 bp, Human
aaatagtactgagggaaaatattaaatagataaaagttaccacatttgataaatacaatgcttactcaaatttacagaggaagtgttaacaacttcactcctaacactccttcccacttccacataccacacttacatcctgggagatacatagcaggcaaaggacctatggaaaaaactgcaacagattaatgaatagattgtgacatgtttgttctcactcataaaaacgccttttaaaaaaataaaaatgagatacaattctgtgcctatcaagtctgtaatgaattaaaaaaaaaawtttttttaagacaatatcacactctgttgcccagattgtactctagttcctgggctcaagtggtcttcccatctcagcctccccagttagctgggactacaggcacaagccaccatgctctgaaaatgactttttacttaatgagaacttaatgagaatacacagtattgtcagataaatggtaaaatgggccatcttacctatgtcaaccctttagaaagtaatttgcatggtacatcaagatatttaaggatgttgtggcatgtttacccatgtaattccatttttaaaggctacctc

SEQ ID NO: 19905 - DNA, 601 bp, Human
agaaaatgtggtacatatttgccacagaatactatgcagccataaaaaaataagatcatattctttgcagggacatggaaggagctggaggccattatcctgagcaaacgaatgcagaaacagaaaactaaatactacatgttctcacttataagtggaagctaaatattgagtacctatggacacaaagaaaagaacaatggacaccagggcccatttgagggtggaaggtggagggagggtaaggatgaaaaaaccaccaattaggtaccatgcttattatctgggtgacaaaataatytgtacaccaaaccccatgatacacaatttgcctatgtagcaaacctgcacatgtacccctgaacctaaaataaaagttaaaaaaagtcataaaggaaacagcttctaagaattaaaattttgtgtgttgagaaatagtaaattttccacattgacatcaaatagtactgagggaaaatattaaatagataaaagttaccacatttgataaatacaatgcttactcaaatttacagaggaagtgttaacaacttcactcctaacactccttcccacttccacataccacacttacatcctg

SEQ ID NO: 19906 - DNA, 601 bp, Human
gttccacgaagttgtcatttctccaggcacaagtgagttcctcattctttgcaaaaagtaacctcaaaacaatctgactcccagaagattttaaaagaagtctttagctatgattattaaccattttaaattagacactatatgaataaaaattcaacaaatcaaaggtataataaagcatgttagcactgttgttttttaaaaggataatgaactcattaatttcacatcgagtacaaccagatccttaacaatatataagagccagtaaaggaattaatactccaaacatgggaagcacctccttatttaagaatccagcctcacaacagtgctatattcaatataagtttgataacgcttttggcttaagttctctagggctcacgcttaccttaatgcgaacttctttagtctttggtggggcaacttctatttcctcaatggagaagggttgcttctgctcccaaagcacagctgctttgcatttaataacctaagaaataggcaagtattataatgggtctgaattatgcctttaacttacagactccctgactagtataaatatgaacagaagagcatatataatattttaagt

SEQ ID NO: 19907 - DNA, 601 bp, Human
acaagaaactaggagtaaaagctctgacaaaaagcctctgctgtaactaaaatactgagattgtcctatcttaacaaacttaacatatggggaaggggtatattttaaagatggagaaatgatgcagtttgcaaatatagtcaataaatattctcaagtgtaaaaagaagaaataaaatttctaatctgaattttttatttttcttttagttgatttggcattgtgttgcttggcagcctgaatatgcaatacattcttttaaatgttttttttttttccaaaactcttcaagattccaarcaaatcatttaagaaaaggaaagaagaacaaataaactagcctaccctgtttcttaccttgccagttttaacagcagcgccatatccagtggaaaacccacagccaattaaacagactttctcaggaggagctgcatcatcaatcttagcaacagaagattcatccaccactgtgtactcggtaaatgtactggtgttcatgaagtggtggactggtttgcccttgcatgtaaatctggtggtgccatcagccagtactccacgaccagtaatactgtttgatacatcaaatacacgtat

SEQ ID NO: 19908 - DNA, 601 bp, Human
attttgtagttatacaataaatcttacttagctgacaagaaactaggagtaaaagctctgacaaaaagcctctgctgtaactaaaatactgagattgtcctatcttaacaaacttaacatatggggaaggggtatattttaaagatggagaaatgatgcagtttgcaaatatagtcaataaatattctcaagtgtaaaaagaagaaataaaatttctaatctgaattttttatttttcttttagttgatttggcattgtgttgcttggcagcctgaatatgcaatacattcttttaaatgttttttttttttccaaaactcttcaagattccaagcaaatcatttaagaaaaggaaagaagaacaaataaactagcctaccctgtttcttaccttgccagttttaacagcagcgccatatccagtggaaaacccacagccaattaaacagactttctcaggaggagctgcatcatcaatcttagcaacagaagattcatccaccactgtgtactcggtaaatgtactggtgttcatgaagtggtggactggtttgcccttgcatgtaaatctggtggtgccatcagccagtactccacgac

SEQ ID NO: 19909 - DNA, 601 bp, Human
aggccagcatcatcctgatatcaaagctgggtagagacacaaccaaaaaagagaattttagaccaatatccttgatgaacattgatgcaaaaatcctcaataaaatactggcaaaccgaatccaacagcacatcaaaaagcttatccaccatgatcaaatgggctttcatacctgcgatgcaaggctggttcaatatatgcaaatcaataaatgtaatctgcatataaacagaaccaaagacaaaaaccacatgattatctcaatagatgcagaaaaggcctttgacaaaattcaacaatscttcatgctaaaaactctcaataaactaggtattgatgggacgtatctcaaaataataagaggtcaaagattcttaattccttgaactccaatttacttgtgaaatttcatgtgattaacttaaaattccagggatcctatctaacatcacagttgatggaaaaatgtatactgagaaatcagttttggtgaacagtaacagcattactgataataggcaacaaacactactgtattttatttctgatacgcattataggtggtaatcaaaatgattaatgattttattgctctttatat

SEQ ID NO: 19910 - DNA, 601 bp, Human
gaggccagcatcatcctgatatcaaagctgggtagagacacaaccaaaaaagagaattttagaccaatatccttgatgaacattgatgcaaaaatcctcaataaaatactggcaaaccgaatccaacagcacatcaaaaagcttatccaccatgatcaaatgggctttcatacctgcgatgcaaggctggttcaatatatgcaaatcaataaatgtaatctgcatataaacagaaccaaagacaaaaaccacatgattatctcaatagatgcagaaaaggcctttgacaaaattcaacaaygcttcatgctaaaaactctcaataaactaggtattgatgggacgtatctcaaaataataagaggtcaaagattcttaattccttgaactccaatttacttgtgaaatttcatgtgattaacttaaaattccagggatcctatctaacatcacagttgatggaaaaatgtatactgagaaatcagttttggtgaacagtaacagcattactgataataggcaacaaacactactgtattttatttctgatacgcattataggtggtaatcaaaatgattaatgattttattgctctttata

SEQ ID NO: 19911 - DNA, 601 bp, Human
agccgaattctacaagaggtacaaggaggaactggtaccattccttctgaaactattccaatcaatagaaaaagagggaatcctccctaactcattttatgaggccagcatcatcctgatatcaaagctgggtagagacacaaccaaaaaagagaattttagaccaatatccttgatgaacattgatgcaaaaatcctcaataaaatactggcaaaccgaatccaacagcacatcaaaaagcttatccaccatgatcaaatgggctttcatacctgcgatgcaaggctggttcaatatatrcaaatcaataaatgtaatctgcatataaacagaaccaaagacaaaaaccacatgattatctcaatagatgcagaaaaggcctttgacaaaattcaacaatgcttcatgctaaaaactctcaataaactaggtattgatgggacgtatctcaaaataataagaggtcaaagattcttaattccttgaactccaatttacttgtgaaatttcatgtgattaacttaaaattccagggatcctatctaacatcacagttgatggaaaaatgtatactgagaaatcagttttggtgaacagtaa

SEQ ID NO: 19912 - DNA, 601 bp, Human
gagtccggggccagatggattcacagccgaattctacaagaggtacaaggaggaactggtaccattccttctgaaactattccaatcaatagaaaaagagggaatcctccctaactcattttatgaggccagcatcatcctgatatcaaagctgggtagagacacaaccaaaaaagagaattttagaccaatatccttgatgaacattgatgcaaaaatcctcaataaaatactggcaaaccgaatccaacagcacatcaaaaagcttatccaccatgatcaaatgggctttcatacctgygatgcaaggctggttcaatatatgcaaatcaataaatgtaatctgcatataaacagaaccaaagacaaaaaccacatgattatctcaatagatgcagaaaaggcctttgacaaaattcaacaatgcttcatgctaaaaactctcaataaactaggtattgatgggacgtatctcaaaataataagaggtcaaagattcttaattccttgaactccaatttacttgtgaaatttcatgtgattaacttaaaattccagggatcctatctaacatcacagttgatggaaaaatgtatactga

SEQ ID NO: 19913 - DNA, 601 bp, Human
agtcaacagatgcagcaaaccaccatggcgcacgtatacctgtgtaacaaacctgcacgctctgcacatatatcccattttttaatagaagaaataaaaaatcataactctgagtcatttgtaaataaatttagatacaaatataaattttagaaatttgaatcagaaggagatgtggaagaaacaaaaattaaatctagaaacttcattttcaattgcatttcttgataaaggtttttcttttaataatgtattaggtcaaagattcttttttttttctaataaaatagacctattttatttttttttctaataaaatagatctattttatttatttatttattattattattatactttaagttttagggtacatgtgcacaatgtgcaggttagttacatatgtatacatgtgccatgctggtgtgctgcacccattaacttgtcatttagcattaggtatatctcctaatgctatccctcccccctccccccaccccacaacagtctccagagtgtgatgttccccttcctgtgtccatgtgttctcattgttcaattcctatctatgagtgagaacatgcggtgtttgtttttttg

SEQ ID NO: 19914 - DNA, 601 bp, Human
tactggataaagaaaatgtagtacatatacaccatggaatattatgcagccataaaaagaaatgagatcatgtcctttgcagggacgtggaagaagctggaagccatcattctcagcaaactaacacaagaacagaaaaccaaacaccacatgttctcactcataagtgggagttgaacaatgagaacacatggacacagagaggggaacaacacacatcagggcctgttaggaggtggggggtgaggggagggaacctggaggacgagtcaacagatgcagcaaaccaccatggcgcacrtatacctgtgtaacaaacctgcacgctctgcacatatatcccattttttaatagaagaaataaaaaatcataactctgagtcatttgtaaataaatttagatacaaatataaattttagaaatttgaatcagaaggagatgtggaagaaacaaaaattaaatctagaaacttcattttcaattgcatttcttgataaaggtttttcttttaataatgtattaggtcaaagattcttttttttttctaataaaatagacctattttatttttttttctaataaaatagatctattttattt

SEQ ID NO: 19915 - DNA, 601 bp, Human
ataatttaatacttgctagattggagcaacagatggcattgtttttagagaccagccttcatcaagtagcaactggaaatcagtaggctctaatgatatatccagtatcacatatggcttcaaaaacttatgacctagaatgctatttgttgatatgaaataaatctaagtgattcactaggaaagaaatatgacagcaatgataaattaaggactatttattcttaaattaccaaaagcattaaggtgagttaatctgccactcaatcttgagcaaaagtggctttattccatttttccwagtctctttacgctatgccaggttggagctttctagttccaggaatctcagatctgttttacaggtctaactgaaggtctggtgctgcgggctgccatacaggtggcatggttagaaaattgaaggttcatattctaagggaattcagatgagggcaaacaaagctcagatgtaaagagtgagaaggtcgatggatcacagatttgggggaatagaccacaacatttggaataatcccttttcacctctcctcagtcaccttctgatgcttactttgctgacattcaagagacagaattg

SEQ ID NO: 19916 - DNA, 601 bp, Human
cctcagaagcctctgtggttttatttctctctcagaataaactcctaaaaccttgcaatggcccaaaggccccatataatttaaggtcctctgaccccagctgtgactgttcttctgtcctcactctgttgtagccatactgaccttttccccgttcttatggttcttgccaacaccctgttgtatttactacgtctccttcctggaatattctttcccaagatttctgaatatcttatttatgtttttgctccaatgttaccttatcaaggaggccttccttgaactttataaaatagcwttcacctccacctccaccccagtcctctggcactgcccgttacccatcctttattattatcctttgcacttgtaaccttatggtatattctgcattcatttatttattgtcagtctctctataccaaagtgagaggattctcacacttcctgagatcagggacttggtatgttttgtctcttctccgttcctagctcctggaatggtacactatgtacacaatggtacctgtactcagtatacactcaacaaatatttgctgaataactgaattttacctctaatattcctgaataatct

SEQ ID NO: 19917 - DNA, 601 bp, Human
agcagccagaaggagagtgttaaaatggaagtcagatcaggtgacacctccctcagaagcctctgtggttttatttctctctcagaataaactcctaaaaccttgcaatggcccaaaggccccatataatttaaggtcctctgaccccagctgtgactgttcttctgtcctcactctgttgtagccatactgaccttttccccgttcttatggttcttgccaacaccctgttgtatttactacgtctccttcctggaatattctttcccaagatttctgaatatcttatttatgtttttgytccaatgttaccttatcaaggaggccttccttgaactttataaaatagcattcacctccacctccaccccagtcctctggcactgcccgttacccatcctttattattatcctttgcacttgtaaccttatggtatattctgcattcatttatttattgtcagtctctctataccaaagtgagaggattctcacacttcctgagatcagggacttggtatgttttgtctcttctccgttcctagctcctggaatggtacactatgtacacaatggtacctgtactcagtatacactcaac

SEQ ID NO: 19918 - DNA, 601 bp, Human
cacaggtacctgcacaagtgtaacctgccccaaaccactcctggtttctaccacttccaccctagcccccaatctattccttctatagtcttccttctcaataaatgatgatggtgacatgattcctgttgcttaggcccaaaaatcttggatgctactctttttgccatacaataactatttcggcaaattttgttgactctatcttcaaaatgtatccaagagctgactacttctcaccagccccatcactccaagccagcatcctttccttccagcattataatgacttcttccatgstctccctgcttgtgccctttgccccatttagagtattccccatagagcagccagaaggagagtgttaaaatggaagtcagatcaggtgacacctccctcagaagcctctgtggttttatttctctctcagaataaactcctaaaaccttgcaatggcccaaaggccccatataatttaaggtcctctgaccccagctgtgactgttcttctgtcctcactctgttgtagccatactgaccttttccccgttcttatggttcttgccaacaccctgttgtatttactacgtctccttcctg

SEQ ID NO: 19919 - DNA, 601 bp, Human
gattaatatagtacaatggcatactaagttggtgatatggttagactttgtgtccccacccaaatctcatcttgaattataatccctataatccctacatgtcaagggagagaccaggtggaggtaattgaatcatggggcagtttccctcatgctgttctcatgatagtgagtgagttttcacaagatctgatggttttgtaaggggctcttcccgctttgctcgacacttctccttcctgcagcctgtgaagaaggtgccttgcttcctctttgccttccaccatgattataagtttcytgaagcccccagccatgctgaactgtgagtcaattgaatctgtttgctttataaatgacccagtctcgggcagttttttttttttatagtagtatgaaaatacactaatgcagtgggtaaagagaagtaattagctgtatcaatctggctagattaaataattagaaataaaatatgaagaaaacaggcacatttataagtactaaattttaaaagtagcctgtggagaagagacaagatcatcataagaaacagttacctttgtcctgaattgagcagctcaaatccttcactgatttt

SEQ ID NO: 19920 - DNA, 601 bp, Human
ttataggcccaatgagtgaaagtcatttcatcttgtagacaggctttttgattgctgtttgagacctccatgaggtagatgttgtagataaaatttgcatgaattcatacttgacctctatccttgcccaaccctcagaagcaacaagagtagtaatcatcacacccatgtttacccaaagcttgccaagctctgtcagagaagtttgttatatggtcaaaagagcacaagttttgcaattagtttatatcctggcactaccccaggaggtttgaccagttatttatttgctttcacaacmttggtcttcatctaaaaatggtaaaaataatacctggcttacagggatctgaataatgcacatttgagaaagcactttgaaaactgtaaaataaggaaattttgtggcctacttgaaataaatagcagctttatgatgaaataaaaatagccacaatgaaatcaactaggtaaacaaaatccaaaagattttaaaaaattgattaatatagtacaatggcatactaagttggtgatatggttagactttgtgtccccacccaaatctcatcttgaattataatccctataatccctacat

SEQ ID NO: 19921 - DNA, 601 bp, Human
tattttccaagcaggccatactaagctgttagttttgcttatctgagtaaagtagtactgagtggttctgacagtttttcttacaaaatcccattgtttacttgcttaaaaaaatgtatgttcataatatgatgatcctgtaggctagaccaaatgtggagacaagacacaacattgaaaaatctctcaggtaaaaaaaaaaattagtaaaaatttggatctcaatatacagttccttttactaatgaaatccacgtccttggcacatagtggaagctcaataattatttataggcccaaygagtgaaagtcatttcatcttgtagacaggctttttgattgctgtttgagacctccatgaggtagatgttgtagataaaatttgcatgaattcatacttgacctctatccttgcccaaccctcagaagcaacaagagtagtaatcatcacacccatgtttacccaaagcttgccaagctctgtcagagaagtttgttatatggtcaaaagagcacaagttttgcaattagtttatatcctggcactaccccaggaggtttgaccagttatttatttgctttcacaaccttggtcttcatc

SEQ ID NO: 19922 - DNA, 601 bp, Human
tcccttaatcttttctgtctttcttaatctaatccagtaatatgcatcatggaatgaactgatttcaaaatgtaatccaagttaactcataacaagtgtttaaaaaatacatttatattcaaatctaaaaaataatagtttcaatgtgttaagtgaatattactctaggagatgcatttactatatctttatacgctatatctgttttgagttatatatctgcagcagctggttaaaactcttaaaaatctccatttcaacatagaaatccaagtgtatgttttcttaaaagatacaattrtagccttacaaaatgtaaatcaaaaatattaacattgttattatactaattcccaggtgctcacaagactttaaatgtttataaaggttaataattctttataagggttctatgtcttcaacaaatcttctacttatgcttgtatttgtgagacagatacatgatttcagatgagggaactctcacaagagaaactccagttcaccatgacaacacagacctcctgccactttggatctcaaaacgtcaggaccgttcgaatgctgaaatgtaaaatgagagtttttaatgacttgtttt

SEQ ID NO: 19923 - DNA, 601 bp, Human
tgtcttataaagtatttttatgttttcaggcgcttcaacactttgtttataacaaataaaagcttaataacaacatatgcctgtttaaaaatatatcaccacaaaacattttatataatttttaattttcttaagaatttttaacatgttatagatatatatagatacatcagtgtagttgttaaaaactaaaaacactttttattaaatggagtcactactaagcacagtgaatagggacttagggacttgcaattctactgtatcaaattgaacattatgataagtatgataatatgaytctagctctatgtttatattcagtattacaaaaggaatattttctaaaatattaatatatgctggcaaatagccttgtgtacccatatgatatactttttcagtttcaccaagttatgtaatgatgattcttaatcgttgaaaaatgtgcccgtcccttaatcttttctgtctttcttaatctaatccagtaatatgcatcatggaatgaactgatttcaaaatgtaatccaagttaactcataacaagtgtttaaaaaatacatttatattcaaatctaaaaaataatagtttcaatgt

SEQ ID NO: 19924 - DNA, 601 bp, Human
agaaagcggaaggaggagaggcagatctggggagtggcagcgaggtcccgggcacccccctggccagcaggcacccttccgttgtccgagctgggttgccaccgcctccttttcctgggattcccggacaccctccaagggaaccaagggaacagctctgggtccagctgccccaggaaggactgtgcgccccttccccacaggggtcaagtatcccttccagcaacagccgtttcctgggcaccagcctgcatgcccagtgctgatgcagggatgtggccatgaatgactctgggaaagratcattcttagcaatggactttgtcagggtccaagaaaggagtggccagccagccccgccccgcctgcaggaggcacttctcatcccgggaactgtgccccatcagggagccgaggctgttcagcctctttgtgacccggggctgggttggcccgagccacaaatgaggggatacgctggtccctggctccccaagggaggggctgctgagctttgggaggcctcatgaaaatccagcttaaggccatcaaaagacaaaatgacaacacatttagttatagatcaaattggcttctattc

SEQ ID NO: 19925 - DNA, 601 bp, Human
tccagctgccccaggaaggactgtgcgccccttccccacaggggtcaagtatcccttccagcaacagccgtttcctgggcaccagcctgcatgcccagtgctgatgcagggatgtggccatgaatgactctgggaaagaatcattcttagcaatggactttgtcagggtccaagaaaggagtggccagccagccccgccccgcctgcaggaggcacttctcatcccgggaactgtgccccatcagggagccgaggctgttcagcctctttgtgacccggggctgggttggcccgagccacmaatgaggggatacgctggtccctggctccccaagggaggggctgctgagctttgggaggcctcatgaaaatccagcttaaggccatcaaaagacaaaatgacaacacatttagttatagatcaaattggcttctattcatgattcgtgaatccggacagcctccattctacaaaatggagtgagagctcccaccaggcagtggcagagcagggggttcataaggcagaaaggaggaaacagaaaaataggaaacaccaaaccgcctaataccggatcgctgcagactgcttttttctaag

SEQ ID NO: 19926 - DNA, 601 bp, Human
tgtctgcaagcccctgtgggtgcaggcaggtcaggggtgcccagaccctggggcggctgggtggtgcccatgaaggaggggcagccctggccacccagttcatgccaccccatctggcaggatggacccccttggggacacgctgcggcgactgcgggaggccttccacgcggggcgcacgcggccagctgagttccgggctgcgcagctccaaggcctgggccgcttcctgcaagaaaacaagcagcttctgcacgacgcactggcccaggacctgcacaaggtgggctggggttggggktatgagagggtgcactggggcaggggggcatggagggcagctgggacagcaggggatgaagacacctgcgccctccatgaagcggggctaaaagcagctcctcccctaggccagagccacccttgcacattcatccagtcacttatttctgtattcatgcagcaactatttgctgagcacctactatgtgccaggtactgttctaggctctggggatatagcagagaataaaacacagttcccatgcctacgaagatgaccttctatcggagacaataaaacagcaaataaataattgca

SEQ ID NO: 19927 - DNA, 601 bp, Human
gtggtgggcacctgtaatcccagctactcaggaggctgaggcatgagaatcgcttgaacctgggaggtggaggttgcagtgagccaaggtcacaccactgcactccagcttgggcaacacagtgagactccatctcaaaaataataataaagataataattacacagcatattgggttgaaatatgtgccctggagacacacccagggtgaaggggagagagggggccaggatcagggtgctgttgtatatgtgggggtcagggaaggtttctctgagaagggggctttagagcagagacrtgaagatggaggggaggctccccatggatgctggggagatggcagcgggcacagcacgtgcaaaggccctgaggcaggaggtgctgggtgtttctgcttgaggagcagcaaggaggccagcatagctgtcgggggtgggagaggaagaaacagcaaagatgaggtctggggtatgggccacactatgtagggcctcggaggccgtgaggccttggccttctctctgggtacagcaggcatcatggcctctgtctagaccctgaaggcttggggcctcagcccctcccaatcccagtggca

SEQ ID NO: 19928 - DNA, 601 bp, Human
ggaaggtttctctgagaagggggctttagagcagagacgtgaagatggaggggaggctccccatggatgctggggagatggcagcgggcacagcacgtgcaaaggccctgaggcaggaggtgctgggtgtttctgcttgaggagcagcaaggaggccagcatagctgtcgggggtgggagaggaagaaacagcaaagatgaggtctggggtatgggccacactatgtagggcctcggaggccgtgaggccttggccttctctctgggtacagcaggcatcatggcctctgtctagaccctraaggcttggggcctcagcccctcccaatcccagtggcagccaaggcagaaccccaagaaacacacttcccccaacccctcacccatcagggcccatgcacctgcctgcccctgcctcaggacacctgcccctgcctcaggacaccacctgcccctgcctcagcacatctgccccaggggctgcccccggctcctattctctggacaaaatatctcctccctttgccttgaaggctgtagtgttcagaccttcccccagcccattgggctccctggggactgactcccccgccaccactga

SEQ ID NO: 19929 - DNA, 601 bp, Human
agcccctcccaatcccagtggcagccaaggcagaaccccaagaaacacacttcccccaacccctcacccatcagggcccatgcacctgcctgcccctgcctcaggacacctgcccctgcctcaggacaccacctgcccctgcctcagcacatctgccccaggggctgcccccggctcctattctctggacaaaatatctcctccctttgccttgaaggctgtagtgttcagaccttcccccagcccattgggctccctggggactgactcccccgccaccactgagcttctgccaccggcygcctgccggccttcatgagacttgacctgacgtctgtctggtcccttttctcccttcggctctgattccacctcctgccttcccatcccagctgcaggagcggggccctacaaaggcagcagtagcccagaacattcaacctggtccctccctctggacctggtcacccccctgtccccaccctcagcaggcagcatctgcccagcgtcacgtgcaccctctcagttaaccctttggtgaatctggttgggcaaccacacccagtggcccccagaagaggctcagagagagtgtgttctt

SEQ ID NO: 19930 - DNA, 601 bp, Human
ccccggctcctattctctggacaaaatatctcctccctttgccttgaaggctgtagtgttcagaccttcccccagcccattgggctccctggggactgactcccccgccaccactgagcttctgccaccggccgcctgccggccttcatgagacttgacctgacgtctgtctggtcccttttctcccttcggctctgattccacctcctgccttcccatcccagctgcaggagcggggccctacaaaggcagcagtagcccagaacattcaacctggtccctccctctggacctggtcacycccctgtccccaccctcagcaggcagcatctgcccagcgtcacgtgcaccctctcagttaaccctttggtgaatctggttgggcaaccacacccagtggcccccagaagaggctcagagagagtgtgttcttgcccaagggcatgcagccaggaagagcagagccagagtttgaacctggctcaaaatagcccagtctcccaaagtcaggtcccaggtgacctaggaggtgtggcgggcaggccaccaggctcatggggccagagcacaggctgtgggaaagtccgtgtggaaggcacct

SEQ ID NO: 19931 - DNA, 601 bp, Human
cctgtccccaccctcagcaggcagcatctgcccagcgtcacgtgcaccctctcagttaaccctttggtgaatctggttgggcaaccacacccagtggcccccagaagaggctcagagagagtgtgttcttgcccaagggcatgcagccaggaagagcagagccagagtttgaacctggctcaaaatagcccagtctcccaaagtcaggtcccaggtgacctaggaggtgtggcgggcaggccaccaggctcatggggccagagcacaggctgtgggaaagtccgtgtggaaggcaccttcscccagcctcagtggctaggaggtgccagtgggcgtggcgtcttcctccctcttggggctcagctgtagccctggccttgcccctggttcgctgagtgacctcaggcagggcatctccttctctgggcttcgctggtcctctggcccatccagcaccccactggcccgtccccctctgccctgacccgggagagcctgcaccccataacctcaggcgctgcctcagccagggagccagcctggccccagtgtccctgacctgttctccagcggcctgcagcctgctgcctggctggtctct

SEQ ID NO: 19932 - DNA, 601 bp, Human
gtgtggcgggcaggccaccaggctcatggggccagagcacaggctgtgggaaagtccgtgtggaaggcaccttcccccagcctcagtggctaggaggtgccagtgggcgtggcgtcttcctccctcttggggctcagctgtagccctggccttgcccctggttcgctgagtgacctcaggcagggcatctccttctctgggcttcgctggtcctctggcccatccagcaccccactggcccgtccccctctgccctgacccgggagagcctgcaccccataacctcaggcgctgcctcagscagggagccagcctggccccagtgtccctgacctgttctccagcggcctgcagcctgctgcctggctggtctctcctcccttggggcgcagagggcagggagcactggctagccgagagcaggacaatgtccctattgattcgggtctcctcactcctgcttagaagcctgacagtggccctggcccctgggctgtgggaactgacagcatttacctaggggtggctgtgcctgtgtctcctgtggaccaatctccaccctgctctttgggagactgaggtgggaggattgtttgaggcc

SEQ ID NO: 19933 - DNA, 601 bp, Human
ccctggccttgcccctggttcgctgagtgacctcaggcagggcatctccttctctgggcttcgctggtcctctggcccatccagcaccccactggcccgtccccctctgccctgacccgggagagcctgcaccccataacctcaggcgctgcctcagccagggagccagcctggccccagtgtccctgacctgttctccagcggcctgcagcctgctgcctggctggtctctcctcccttggggcgcagagggcagggagcactggctagccgagagcaggacaatgtccctattgattcrggtctcctcactcctgcttagaagcctgacagtggccctggcccctgggctgtgggaactgacagcatttacctaggggtggctgtgcctgtgtctcctgtggaccaatctccaccctgctctttgggagactgaggtgggaggattgtttgaggccaggagttcaagacctacctaggcaacacagcaaggcactctgcaaaaaatcaaaacaaactttttttgaaattaaaaaaaaacaaaaccctaagtcagatcccatccctgctcttctcaggagtccttgcctggctgcctggc

SEQ ID NO: 19934 - DNA, 601 bp, Human
ctgtgggaactgacagcatttacctaggggtggctgtgcctgtgtctcctgtggaccaatctccaccctgctctttgggagactgaggtgggaggattgtttgaggccaggagttcaagacctacctaggcaacacagcaaggcactctgcaaaaaatcaaaacaaactttttttgaaattaaaaaaaaacaaaaccctaagtcagatcccatccctgctcttctcaggagtccttgcctggctgcctggccccctcaccttgcccactctgcttcttgctaaacaggagcagagcaagckcacagccacctcggggcctttgcagccgccagggcctctgcccaaagtatgccgcctcccagtacccacgacttgcttgttccttgccttcaggtcactgctccaatgtgaccgccgcctggagacctgcactgaccgctttgtaaaaacagcacacacacacatgctcatgtggatgtatacatgtgcacacctgtgcacgcccacagccacacgctccagcagtctccacccccaccctgctccatgatttccctagcacagccacgtcctaatggagccgtcagcgttctcactttc

SEQ ID NO: 19935 - DNA, 601 bp, Human
gtgggaggattgtttgaggccaggagttcaagacctacctaggcaacacagcaaggcactctgcaaaaaatcaaaacaaactttttttgaaattaaaaaaaaacaaaaccctaagtcagatcccatccctgctcttctcaggagtccttgcctggctgcctggccccctcaccttgcccactctgcttcttgctaaacaggagcagagcaagctcacagccacctcggggcctttgcagccgccagggcctctgcccaaagtatgccgcctcccagtacccacgacttgcttgttccttgmcttcaggtcactgctccaatgtgaccgccgcctggagacctgcactgaccgctttgtaaaaacagcacacacacacatgctcatgtggatgtatacatgtgcacacctgtgcacgcccacagccacacgctccagcagtctccacccccaccctgctccatgatttccctagcacagccacgtcctaatggagccgtcagcgttctcactttcacatggaacgactgccccctgcaaggtcggcctcagggccggtccctctgtttggcacagagacagcacctcacacaggaagcacgc

SEQ ID NO: 19936 - DNA, 601 bp, Human
aagaggactgtctggtccaccgtccccgggctgtgtggccctgggcccgtcatgttacctctctgaaccaggttctgcatctgaaagtgggtgaggctgatgcctgccctgcaggtgtgtggagaccaggagctggctacgcctcctccagctctctccctgcactgccctgcagggaactgtgtggtgctgaagccatcggagattagcaagaacgtcgagaagatcctggccgaggtgctgccccaatacgtggaccaggtgagcagggctgccgggcaggtagagcgggaacaggcarggctcaagggctgggcagcccctggcatggaagggcctgtcagtcagacccgagtccccacctcaatcctgcctcttctgagttgtgtaaacttgaccaagtcaccgcccctgtcagcctcagtttccctctgaggagcagcgagggcagcctgttgcccaggggttccgtgtctgcctccacctggccctggcatcagcccctccagcgccagctggactccaagctgggcctgccaatgccagccaaccttggggagctcccttctccccactttgcctccacccaaccctcctagag

SEQ ID NO: 19937 - DNA, 601 bp, Human
gctgctagagcacaggttcgactacatcttcttcacaggtgaggccgggacgagggtcgggacaggctggggtcggggaggacagctgctcaggggtcctgtccctaactctgggagtccacagggagactgaattctcctctctctctctctctggaccaggctgggagcagtcctggacccccaggaccccttaggaagggatggagtcccatgtccagggccagcccactgtgccaaccacagcgtcaggaaccatagcctctgcccccactgtccccagaccctcatacgtgacccygctgccccccaggctcttagacaccaccctactggtgcccacagccctctctgcaggcagatgagggactgggcctcagtgtcctgcccagggtcaccctgctggccaggatggggacaggctggaatgtgcacacaagcccttggagaaatccacgccagaggtcactttttttttctttttttttgagacagagtcttgctctgtcacccaggcagtggcacaatcttggcacaatcttggctcactgcaacctctgcgcctcctgggttcaagtgatgctcatgcctcagcttccca

SEQ ID NO: 19938 - DNA, 601 bp, Human
ttcgagtttttgagctagggaggggcagagggagcgagaggaagacagtggtgctggcaggcgagtctgcgccttacaggtcgaggcagtcgtggggaagggcctggcaggattgacctggccgcctcccagcaaaggcaaaggagccctggaaggaaccacagagcccaggaagcactgtgccaggatggggcaggggtgagagtagagaaggcacagtggctcctgccggctttaatccttgaccacaagggggagaaatgccagggccatccccacagacgcagcagcgtggtccccragtcaggtctggagaggaggccttgaggcccagacagggctagggcagagaaggctgtgtgcatgcggagactgctgggcccctggaggccagcacagaggagaggtgaggccaagccaggcaggacatggggacgcctgcatcagcctgggacagtccacctcaagggtcagaaaaaaagggctgggcaggtggcagaacttccaggtttaggtttagagaagagagacctgaatgccgtagacagagctggactccatccttgggtgataagggatccccgaagtttccaaaggagat

SEQ ID NO: 19939 - DNA, 601 bp, Human
tgagctgtctctggtgcctgcagcccccacggtgctggtggatgtgcaggagatggagcctgtgatgcaggaggagatcttcgggcccatcctgcccatcgtgaacgtgcagagcttggacgaggccatcgagttcatcaaccggcgggagaagcccctggccctgtacgccttctccaacagcagccaggtgggggtgcggccgggctgggcagggtcaggagcccgcagtgggcagcacaagtggtggcagcagggggggcaccaaaatccagtggcttcaggactttgggatggtggwcctcttggctctgtctctgcccactctcctggaagcagctgagcctcacccaccccaaccctgtccccagtctgggccccactctcctaggccttcagtgggcagcttcctggggtatgggccttctctagggtccagtgtttcctctaggtcagcccctgcctttgtccttcttacacatcggggcctggtggccacatgacccctcaagcctggctctgaaggcacaggcaacgtgtcggggatgacccaaaggtgcaggtccaagaatgagccctgatcccctacccctgcttaagc

SEQ ID NO: 19940 - DNA, 601 bp, Human
ctgcccactctcctggaagcagctgagcctcacccaccccaaccctgtccccagtctgggccccactctcctaggccttcagtgggcagcttcctggggtatgggccttctctagggtccagtgtttcctctaggtcagcccctgcctttgtccttcttacacatcggggcctggtggccacatgacccctcaagcctggctctgaaggcacaggcaacgtgtcggggatgacccaaaggtgcaggtccaagaatgagccctgatcccctacccctgcttaagctgcagaggcagcctggsaggcccaaggccagagtcctcagattaaaaaacaccaagaggtaccagcagtccctacccaccccgcccccttccccggccctcagccagttcctcgattccctccacttgaactttttttttttttttttgagacagagtctcactctgtcacccaggctggagtgcagtagcacagtcttggctcactgcaacctctgcctcccgggttcaagcgattctcctgcctcaacctcctgtgtagctgggattacaggcgtgtgccactatgcccggctaattctttgtatttttagtaga

SEQ ID NO: 19941 - DNA, 601 bp, Human
ggtccagtgtttcctctaggtcagcccctgcctttgtccttcttacacatcggggcctggtggccacatgacccctcaagcctggctctgaaggcacaggcaacgtgtcggggatgacccaaaggtgcaggtccaagaatgagccctgatcccctacccctgcttaagctgcagaggcagcctgggaggcccaaggccagagtcctcagattaaaaaacaccaagaggtaccagcagtccctacccaccccgcccccttccccggccctcagccagttcctcgattccctccacttgaactttttttttttttttttgagacagagtctcactctgtcacccaggctggagtgcagtagcacagtcttggctcactgcaacctctgcctcccgggttcaagcgattctcctgcctcaacctcctgtgtagctgggattacaggcgtgtgccactatgcccggctaattctttgtatttttagtagagatggggttttgccacattggtcaggctagtcttgaactgctgacctcaggtgatccacctgcctcggcctcccaaagtgctgggattacagggatgagccaccgtgcccggcca

SEQ ID NO: 19942 - DNA, 601 bp, Human
atgacccctcaagcctggctctgaaggcacaggcaacgtgtcggggatgacccaaaggtgcaggtccaagaatgagccctgatcccctacccctgcttaagctgcagaggcagcctgggaggcccaaggccagagtcctcagattaaaaaacaccaagaggtaccagcagtccctacccaccccgcccccttccccggccctcagccagttcctcgattccctccacttgaactttttttttttttttttgagacagagtctcactctgtcacccaggctggagtgcagtagcacagtctyggctcactgcaacctctgcctcccgggttcaagcgattctcctgcctcaacctcctgtgtagctgggattacaggcgtgtgccactatgcccggctaattctttgtatttttagtagagatggggttttgccacattggtcaggctagtcttgaactgctgacctcaggtgatccacctgcctcggcctcccaaagtgctgggattacagggatgagccaccgtgcccggccacttgaactttttttaaataaactttgtattgggaaatacttttagatttacagaaaagttgccaaaa

SEQ ID NO: 19943 - DNA, 601 bp, Human
tggttttaggagagaatcccacagaggtgagcctgcctctcacaccacatctggggcacctgagatgcacacgtggctagtgagtggaaccttcactaccgggtcaggacggtatctgccagggtttccctgggaagctactattgtttgtttctttattatttggaagcaagtctctaagcctaccccaccctcaccaggtggaggtaattaagctgtatgctgctctatcatattgttagttattatctagttattttatacattcttttcttattccatttgtggtttggtggaattytgttgtattgccatttgatacctttctcttcctcctttgtatgattgttttatagggcctgtgagttttgtacttttgtgtgtattatggcaaataccaacttgtttttatgttaagactcctttgagcatttcttgcaggactgatctagtagtgataaattcccccagcctttgcttgtctgggaaaggctttatttcttcatctacgaagcatagtcttagctggataccgtattcttggctaacagcagtatctacatctatttcctggaattctgtaagaaagattcatctcttg

SEQ ID NO: 19944 - DNA, 601 bp, Human
gggtaatgctggtctcatgccatgaagtgacgtctgaatccactgggggcagtccgctttccccacatcagacaagccctgacccagctgtgatcagaggttcacggtgattgcaactaaatatactgaagtttttgtgcagcaactatttagtgtctaccaatctttttttcctttcagtcttcaaataagtctacagattgaggaagaaggtccttctcaaggaccttcaagcaagggccaagcttctgtttctaaagtgcaaatctgaccacatcattatgttttcatgtccctgtgytcacaccacacagctcttcagcctccactctgtctgcagtgccctctttgcctgaacaacttctgtccctcccagtccctccactcagcaggcacatgacacccctctcctgggatgcctccctactgtccagtactgccctgctgccactacaccctccatgtccccaagcaacactaggtttcctgcccctacccccagccctaagagtctgtgccatcagcatggaccacacatgagcagatgtccaggaaacatgtcccaagttggaagcttcatgaggagctgctacacaacccc

SEQ ID NO: 19945 - DNA, 601 bp, Human
tactgccctgctgccactacaccctccatgtccccaagcaacactaggtttcctgcccctacccccagccctaagagtctgtgccatcagcatggaccacacatgagcagatgtccaggaaacatgtcccaagttggaagcttcatgaggagctgctacacaaccccctgccccacctgtaccatcacaggcccttcagctgacatggtggcctcagaccctttctgaggcaagatcagtgtcacagagtccagcatggaacaggctctgggtcctgaggatcctgatggggctcaaggcrgcctcacgcacatcctgttctctcccaggtggtcaagcgggtgctgacccagaccagcagcgggggcttctgtgggaacgacggcttcatgcacatgaccctggccagcctgccttttggaggagtgggtaggtgcctgctaccctgcccttctgttaccatttggtcaaattgcaatagtgttacctgcatacatttctgccaaagcaccccagccccacctcaatgtagagggacaggcaaggaggcctcaccccagaacccgcatcctgctccccaccccagagggtctgagtccaa

SEQ ID NO: 19946 - DNA, 601 bp, Human
cccccagccctaagagtctgtgccatcagcatggaccacacatgagcagatgtccaggaaacatgtcccaagttggaagcttcatgaggagctgctacacaaccccctgccccacctgtaccatcacaggcccttcagctgacatggtggcctcagaccctttctgaggcaagatcagtgtcacagagtccagcatggaacaggctctgggtcctgaggatcctgatggggctcaaggcagcctcacgcacatcctgttctctcccaggtggtcaagcgggtgctgacccagaccagcagygggggcttctgtgggaacgacggcttcatgcacatgaccctggccagcctgccttttggaggagtgggtaggtgcctgctaccctgcccttctgttaccatttggtcaaattgcaatagtgttacctgcatacatttctgccaaagcaccccagccccacctcaatgtagagggacaggcaaggaggcctcaccccagaacccgcatcctgctccccaccccagagggtctgagtccaatctgggcaacacagtaagaccccatctcaaaaaaaagtctgtggtggaaccttctagacca

SEQ ID NO: 19947 - DNA, 601 bp, Human
tgcaggaagccccccagccaaccccactccacccaggctgtgctctgaacgccctggcctggggcctcgtctgcctcccaacctagacgctgaggagagttcactgcacatagcacctactgggtccaggggtctcaacatcccctcaatccccaccacaaccttaggagggaggtacccttgtcaccccacgacagaggagactgaggcacagtccaaggtgacatggattgtttgcagcagggccagagtttaacccccggcagtctgactctggaatccatgcccttgaccaccaccygcctatcttgccctggcatctggcatccccagggcttactgagctggtgccaagctcggggccaagccctttacacacagtgcctcatgatcagcccactggacagatggggaaactgaggctcagaggggagaagtagcccgcctaggccccactgtctgtgactaggagacccccagcgcctgaccacctgtgttctgtgccactgtacaggtgccagtgggatgggccggtaccatggcaagttctccttcgacaccttctcccaccatcgcgcctgcctcctgcgcagcccgggga

SEQ ID NO: 19948 - DNA, 601 bp, Human
ctccagcccatgccagaggagcttgtaactctttatcctcatggtgcccactacgagtcatactcttccccatgctgctcatcctcctgggccccatccactcagccaaagcagaatgcagggtttcctgcctgacaacccttctcacctcccaagtcccacttttgaacaagctgatgattctgaaactggcccaatttcctaacaagccggatgcttgagaaacctacatttggacaatgagaggctgctcctgcggcctgcgggccacctcctcttccttggctcctgctttcttttyagactatatcaacctacaactttagtcgggaagagggacaggggtggacctgagtttcgtctcctgtctctctggctgatgtcacctgaataaagccttcttccctggcaatacttacatctcagtgatttgctttctgtgcatctagcaacaggactctggaccaaggccctggcgttgggtaacaattctgtaatgctgcaggacttccccaatccacgcaggaatccccgcaggcatccacgcaggaatcacctgatgaagggccagggtcaggtgtgggccaccatcccaagacct

SEQ ID NO: 19949 - DNA, 601 bp, Human
gattcaattacctccccctgggtccctcccacaacacatgggaattctgggtgatacaattcaagttgagatttgggtggggacacagccaaaccatatcaataagtaaacaactcttgtccttttcatcttggtttctctcattaaacagatcccaaaccctacagttgcccagtctcacatttgcatatctaggccttttcacatatattatctcatttaacactttcaacagcagtatgaagtaggtatcattagctccattttataaaagttgacattgaagaccagaatggttcayttgatgagagtccccaaagctagtgacttaattctggtgactattaaagctagtgactatttttcctctttcacagctgtatctcaaagagaaataggctaaaacaagaacatgcaatggcaacaggacaaaagctgcatttcaatataatgtcctaacagtaatgctttctaacattacaattttttctaagataaaattagtcttctttcctcaaagattcttctctttaaatactgtaagaaaactattttatgtcaatcagccaaagctcctctttgataagaagcttatcaaagc

SEQ ID NO: 19950 - DNA, 601 bp, Human
cagggtgagaccctgtctcaaaaaaataaaaataaaaaatattgtcaattcacaggattgtcatagccagaaattcttttgtgttattgttactgtgtttaaggctgacagagttcagaacacaaattaatgtcaaaataatggatctgaaatagcctgagtaaaaatcctttcttctatacaagaaattaagtcactaaacaatacaagtggcagcccaggcccctgtccactaagacacatcctctccttaggctggggctgttaatttccacccctacctggcctaacacaaatcacmccatgtgtactccctttcccccttcatacttttacaggaaatttcacacctctgcctaataaaatctccttcccattcccaattcaggctaggtaaaatcaaaagagaagcctccaaaatatactctgggtaggaccggatttgccacatccaaatgccatgtgtgttgaccaatactggttttgtcctcaccttcatgccagtgggcacacttccagtgaaggagactttggccacatcgggatgctgacacagaaactggcctgtggcagcccctccctgcaccacattgaagagccc

SEQ ID NO: 19951 - DNA, 601 bp, Human
taggggccttatgtctacaatttactctcaaggttcagaaaaacttaatatgcctacgtatgtacaggcagataaagaagatgataaagtgaatctgttaaaatgttaatatttgagaaatctggttcaaaggtacatgggaattctttgtactatttgtgcaacttttctgtaagtctgaaagtattgtaaaacaaaaagctttaaaacacactgttggatgagggggtagagattccttttacacctcttccagggacaggtacatacctggccttgtgtgaggaagttggccatcagygccccctttacagcattgttcatatcacagtctgagaagatgatgagtggagatttgcctccaagttccaaggtaacaggtttgattcctttagctgacatctccatgatcttgcagaacaaggacaaggtattcagaactttaacacaaattatattgcatgctaagtcaactaggccctgaacctacaaaatcatcttgaactgtttgtgacctgtagccttattcttgtcaatatcctttgccttttggctattaaaatattctattccagaaaactgaagagaatccacagagttg

SEQ ID NO: 19952 - DNA, 601 bp, Human
gccgagatcgcaccactgtactccagcctgggcgacagagcaagactctgtctcaaaaaaaaaaaaaaaaaaaaaattagccagccgtggtggcacacacctgtagtcccagctatttgggaggctgaaacaggagaatcacttgaacccgaacccaggtggtggaggttgcagtgagctgagatcgtgccactgcactccagcctgggtgacagagtgagactccgtctcaataaaaaaataaaataaaggccgggtacagtggctcacacttgtaatcccagcactttgggaggccaaygtgggtggattgtgaagtcaggagtttgagaccagcctggccaacacagtgaaactctgtctctactaaaaatacaaaaattagctgggcatggtggcgggcacctgtaatcccagctactcaggaggctgaggcgggggaatcgcttaaacctgggaggcagaggatgcagtgagccgagatcgtgccactgcactaccgtctgggggacagagctagactccgtctcaaaaaataagtaagtaaataaataaaaataaaaaataaataaataatgatagtattggattataacacata

SEQ ID NO: 19953 - DNA, 601 bp, Human
atataccaaaggaaatgaaatcagtagcttaaagacatatctgcactcccatgctcagtgcagcattattcacaataaccaagataaggaaataaccccattgccagatgaacggataaattgtgatacatatttaaaatcacactgggcatggtggctcatgccaggcgtggtggctcacgcctataatcccacactttggaaggctgaggcgggtggatcgcctgagctcaggagttcaagaccagcctggccaacatggtgaaaccctgtctctactaaaaatacaaaaaaattaacygggtgtggtagcgcatgcctctagtcccagctacttgggagggtgaggcaggagaatcgcttgagctccaggggcgaaggttgcagtgaaccaagatcgtgtcactgcactccaacttgggctacagagtgagactccatctcgaaaaaataataataataaaataaattcacattacgtcacaattatttttagtgctctctctctctctctctctatatatataaagtatacatagtacagattatgtagaatattctatatatttattctatatattctatactatatgtattcttt

SEQ ID NO: 19954 - DNA, 601 bp, Human
ccaccaaaaccaagatggtgatgagtgaccgctggtcgtcattgctgctcattatatgctaattataatgcatcaacatgctaaaagacatacccatcagcaccatgacagtttacaaatgccatggcaacgtcattttaccctatatggtctaaaatgaggaggcatgaataacccaccccttgtttagcatacgatcaagaaataaccacaaaaaggggcaaccagcagcccctggggcagctctgcctacggagtagccattctttattcctttactttcttaataaacttcctttcmctaaaaaaaaaaaaaaaaaaaaaaaaagaatctaagttagtatagccatgaaggaaaacaggataggggctctttaaaaaattaaaaattggcagggaacagcggctcatgcctgcaatcccagcactttgggaggccgaggtgggcagatcacctgaggtcaggagttcgagaccagcctggccaacatggagaaaccccgtctctactaaaaatacaaaattagtcaggcgtggtggcacatgcctgtaatcccagctactcaggaggctaaggcaggaaaatcacttgaacccagga

SEQ ID NO: 19955 - DNA, 601 bp, Human
ctgcagcactgattggccaactctggatatcaccttttgtcggaactcggagttataagcgaccctcaccctgacgctttctgactgagctcctctctatcctgaatacaagagaccctaataattagacaggaatatcattgcccctattcagcatgaaaaagtttacagaagatggatctttgtccctctgcaacccttaggattaagggttcttttataaaagggagaggggaaatgtcacaggtgtttgaactagagcaacttcatcttaagtaggtgctgggtaaaataaggctgrgacgtactggactgcattcccaagaagttagacattctaagtcacaggataagataggagatcagcacaagatacaggtcataaagaccttgctgataaaacaagctgtggtaaagaagccagctaagacccaccaaaaccaagatggtgatgagtgaccgctggtcgtcattgctgctcattatatgctaattataatgcatcaacatgctaaaagacatacccatcagcaccatgacagtttacaaatgccatggcaacgtcattttaccctatatggtctaaaatgaggaggcatga

SEQ ID NO: 19956 - DNA, 601 bp, Human
cccgacccaaaagaaatagactgcagcactgattggccaactctggatatcaccttttgtcggaactcggagttataagcgaccctcaccctgacgctttctgactgagctcctctctatcctgaatacaagagaccctaataattagacaggaatatcattgcccctattcagcatgaaaaagtttacagaagatggatctttgtccctctgcaacccttaggattaagggttcttttataaaagggagaggggaaatgtcacaggtgtttgaactagagcaacttcatcttaagtaggkgctgggtaaaataaggctgagacgtactggactgcattcccaagaagttagacattctaagtcacaggataagataggagatcagcacaagatacaggtcataaagaccttgctgataaaacaagctgtggtaaagaagccagctaagacccaccaaaaccaagatggtgatgagtgaccgctggtcgtcattgctgctcattatatgctaattataatgcatcaacatgctaaaagacatacccatcagcaccatgacagtttacaaatgccatggcaacgtcattttaccctatatgg

SEQ ID NO: 19957 - DNA, 601 bp, Human
ttaccatacacacaaaaaaatcatcacaatatataaggaactcacactattcaattgcaaaaaaaaaaaaaaaaaacctctgattacgaatgggcaaaagacctggatagacatatttccagaaacatacaaatggccaacaagtttatgaaaagatgctccacatcactaatcatcaggaaaatgcaaatcaaaatcacaatgaggtatcacttcatatctgttagcatggttattatcaaaaagataaaagataacaagtgttggtgaggatgcggagaaaaggaaatcttggtatacygctggtgagaatataaattagtataggctgctctgcctatggagtagccattctttattcctttactttcttaataaacttactttcactttatggacttgtcctgaattctttcttgcacaagatccaagaaccctctcttggggtctggatcagggcccctttgcagtaacatctttctggcaaaccatggaagggacaatactgaggagatcctcccgacccaaaagaaatagactgcagcactgattggccaactctggatatcaccttttgtcggaactcggagttataagcgac

SEQ ID NO: 19958 - DNA, 601 bp, Human
gcctgtagttccagcaccttgggaggctgaagcaggagaattgcttgagctcaggagttcaagaccagcatgggcaacatggcgaaatctcatctctacaaaaaatacaaaaattagccaggcatggtgccacatgcctatagtcccagctacccaggaggctgaagtgggaatatcacttgagcttgggaggttgaggctgcagtgagctgggatgatgtcactgtactccagcctgagcaacagagtaagatcctgtctccaaaaaataaaaaaataaaaaataaaaaaaatacaaacccacacacacacacacacacacacacacacacacacacacggttaaattggtaaattttacattaggctttaccatacacacaaaaaaatcatcacaatatataaggaactcacactattcaattgcaaaaaaaaaaaaaaaaaacctctgattacgaatgggcaaaagacctggatagacatatttccagaaacatacaaatggccaacaagtttatgaaaagatgctccacatcactaatcatcaggaaaatgcaaatcaaaatcacaatgaggtatcacttcatatctgttagcatgg

SEQ ID NO: 19959 - DNA, 601 bp, Human
taaaaactggccaagaagggcctgactccttcacaaatcggtgggatcctgagagattcacatgatgctgcacaagtacgatttgtgacaggcaataaaatcttaagaattcttaagtctaagggaccgctcctaatctccctgaagatctctaccatttaattaaggcagcagttgctgttcaaaagcttcttgagaggaagagaaaggatgaggatgctaaattctgtctgattctgatagagagccggattcactgtttggctcgatattataagaccaagtgagtcctctctcccarctggaaatatgaatcatatacagcctctgccctggttgcataaatttgtctatgtacttgagcaataaaataattgcttaactaacaaacaaaaaaaaaagaatgcaacatttccttttagagagggatttggcaatatcttataaaattacatatgcagtcaatatcactaataatcagggaaatgcaaatcaaaaccacaatgagataccacttcatacccaataggatgactattatcaaaaacagagaaagcaagaaaataagaaaataacatgtgttggcaaggatgtagagaaa

SEQ ID NO: 19960 - DNA, 601 bp, Human
aggaccaggaacctgtatttccccaggtaattcagatatgcagacaggtttaggaatactggtttataaggtctgaattacgacctagctctagagacctagtttgcattcacacctcccagctcctcacctgacttcttatatccaccaaagggcaactccactgggctgacgttatagttgttaatgaagcacgtcccagcctgaagctcagctaccactctatgagcccgttggatgtccctatgaagaaaaaaaaaatgtgtgcattattgagagtttcttaggctactactttaasaggaaaagttacactgccagttctagggttctcaaatcttactaaattctcatttcttcaaaatgttttaaaatcttttatcatccaggcaaaacagatatggattgggttttatagtcccatgcacatggtatctttaaaataagtaacagcaataagggtaccaaaattcaatggaggaaaaacagtctttttaacaaatggtgctgaaacaagtggatatctacatgcaaaaaataaaggtggagccctttcttacaccatacacaaaaattaacttaaacgcatcacagacctaaa

SEQ ID NO: 19961 - DNA, 601 bp, Human
aaaggtcctgggaaaacctcactctgtcttttgttcctttccaaatcccctaagcacacagctggtcaggcctgttaggccaggtgttgctctgcacgtctggccatctttctcgctctctcattccacatagcatggtctggtccaaaggaaagggaaagttaggaggccctccaaaggcctaagctgctgattccaaacaaataattccctgcactgagggactatcagaaacttaacatgtaatgttatatgttacatgttaataagatggcaccttggttcccacctgcacttgtgyctgtgtgtacgactcctctgagtaccccaccgggacaaataagactgtcaaattaacacccaccatctcatcagtgttcatcagagtttatatatttgccaacactgtgatggctgtaaatatttgccacagaaactagaggtcagactcttagaatggtgcctcgacaaagtccaaaccaattttcactctagaagaacagcatgagaaatatgtaaatgaatatttacaggcaacaaactccaaagaaagaacctcaaggttctggctatactcctgatgcctcaaaccttctcctga

SEQ ID NO: 19962 - DNA, 601 bp, Human
cctgctttgtgcttctaacatcagccctatcctctgtcctcccataacctcaagatacgtttagtttcaaaacacgataggaaaacaattaacagtgtgatttattttaatttcaccatattacattagcatacaaataatttgtacatttaaagggtagctccactggtgtaagacagcaggctgtagttcaaggacccaagatagggagatagatttcctctatcgcagtagtgaacagagacaaagtgcttactaggcaagttcacattcacacagaatttgaccccatctattatckaatcccctccctatcccagttgtcagctttctcaatggaatgacaaggggatatagcttaaaaaaatgtcaatgagctgaaatcatctctactgattctaccaggaacctataaaggaacaaggtttttttttgttttttgttttttttcttcaagactaggcaagtgaagcagtgggaatggagaaggaacaaagaaatctacaaactggttgtgatcaattagttgtaaataccactgcacttggatcagccaggaacaagttctttgaaatacgccagagaattaacattatcagtg

SEQ ID NO: 19963 - DNA, 601 bp, Human
ggacaagcccttctacaacgacttcgagcgtggcgcggtgagcgcgggcggggcacgggtggagcgcgggctgaggtgcgtccgggacccggtttggacggcagaggcctgggcgggggcgccgagggcccgtcggggcggcccggacaggactgggggtgtccaggaccctgtcagggcgggcagaactgcggtggggcgtgccctgggctcccagtggccggtgggtaccctggtgggcaagcgtccaggacccctcgcggcggccgcgacccctgtcggaaacggagacttcccgcgkgccgcctgcaaggcgtcttccctgggaggagaaggcccaaggtttcccctccacttcaagatctgggctccgaggctccggagcccccttcactgggccgcgtttcttgtgccacctcttccttaggctccttctgcaggtcgcacagggagggagaggcagatgagtcatgctcacagaactctgagggcacctcggagcagccagctgtgagccgtggggaagggtgcacgtcagcgggtccagaggcctgagttctgtccagacatgaccaccagctcactctaccgtctgtctggg

SEQ ID NO: 19964 - DNA, 601 bp, Human
aggaccctgtcagggcgggcagaactgcggtggggcgtgccctgggctcccagtggccggtgggtaccctggtgggcaagcgtccaggacccctcgcggcggccgcgacccctgtcggaaacggagacttcccgcgtgccgcctgcaaggcgtcttccctgggaggagaaggcccaaggtttcccctccacttcaagatctgggctccgaggctccggagcccccttcactgggccgcgtttcttgtgccacctcttccttaggctccttctgcaggtcgcacagggagggagaggcagakgagtcatgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggag

SEQ ID NO: 19965 - DNA, 601 bp, Human
tccttaggctccttctgcaggtcgcacagggagggagaggcagatgagtcatgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagkccccagaggaaattaaagggaaggaacagaacccaggccaggagaggcttttcctaaatggaggggctgcactccctcccagcagaatgtacaccagggaacacttccacgctaggtgtgaggacgcgagggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaata

SEQ ID NO: 19966 - DNA, 601 bp, Human
catgctcacagaactctgagggcacctcggagcagccagctgtgagccgtggggaagggtgcacgtcagcgggtccagaggcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggagaggcytttcctaaatggaggggctgcactccctcccagcagaatgtacaccagggaacacttccacgctaggtgtgaggacgcgagggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaatagtcccagacatactgcaggtgcgcagggaatatcagttcccttccaccc

SEQ ID NO: 19967 - DNA, 601 bp, Human
gcctgagttctgtccagacatgaccaccagctcactctaccgtctgtctgggcctcagtttccccagctgaaaatggagggttggcttcagtctggtccatgagtcatgggtgagcccaggcccatctggtggctcagacggcacctgggcagcttacattctcaggacagtccccagaggaaattaaagggaaggaacagaacccaggccaggagaggcttttcctaaatggaggggctgcactccctcccagcagaatgtacaccagggaacacttccacgctaggtgtgaggacgcgrgggagccctcagcatttggaagctagttcctaatgctgatctggacctgaattccagccccacgactcttttccatgagcatgggcaggtcgcagttctcactgagcctttaatgaagtgcctaatccagtacctggcacagaggaagcgctccgtaaatgactggtaatagtcccagacatactgcaggtgcgcagggaatatcagttcccttccaccccaccccagctcctaactggaccaaaaagatttagactttaccaagctgccttctcaccatttagtttattatttgatcaa

SEQ ID NO: 19968 - DNA, 601 bp, Human
ctgccaccatgccaccctggacagcaccccctacactccacaccttttaccatcactgtggtcacccttgtgcccagaggtttctcctcctcagatattcaagctcgagcaccctcaacctcatttcactatcaaaagtctcaaaagtatcagaactttttcttggcacaaatcaatcatttgtgcttctgaacagagcaaaggcagaacttggcttgtgttttaggtatttacacaaaagcaactttgggttcctttggactaggatgtgtttgatgagagcactagcttcatagtggcyagtcatggcatgggaaggacgttaggaaggcaggaatggctggacaagaagaggtgctgaaatcaggacatggggaaccaaacttggcaaactgcccccagggactctcctccacgccctccttcttccatcctggacactccatgctgggctgaaggacctgagtgctccaggaggcttctgagccacgaagggccagctcaggtatgatgagttggtgccacagcctgacccagtgatgggcagggggcagcagttggagctgtgcccatccagggagcactcgggagaggagaccaa

SEQ ID NO: 19969 - DNA, 601 bp, Human
ctgggcattatgcagactgtcttgtgcaacatcagaggaggaattgcggggaatgtttctccatgatgctcgagtctgggaacataatgtcaatattttcactatcagtatcaataattacaggagctacccttgattaggggcctgtggtgggacaggcattgtgacaggtgctttacacacaaggtcatcagttgtcacccaccttgcaaaggggagaacactggagaaagaagcagaccttgtgtgagaataaaaaaggggcacgaggagaaacccaacagaatggttgattttctckttagaaatgctgctgcccatgctcctgtcgcaccctcctccccaccctcacctgcagactcagctgcctccggctgcaaggctgacctagtcttgagacagaagaagttcaaaccaactccacctggatctggtggggctcagcaacaggcgctggcccatcagcctgcctcttccccatggatccagcgtgatggggcctcctgccacccaggccctgctgcctatccccaggtgtccaggtggcctctgctgcttccagtcttttgagctcagcttaccctgaggccctagttggaga

SEQ ID NO: 19970 - DNA, 601 bp, Human
agactctgagcagccatctctgcacccagcagccaaggagtggccatcctcagcacctggcagggcatcagcctcccactgggagtcccggccacctccagggcacgtgggttatgagtcacctttcctttgagctgacccacccctcactgactagactcttaaacacacactgccccgtctaatacacaccagcatgattcttaatccccacagtcattcacgctgcccatctggcagcaccttaatgatctacagcaagcttgtggcctactaaaaacgcctccattgttttttaaartgtgcagttattttccggatcatgaatagagaaattgtatccctgttgttggtattgattcagtgttccagctcaagtttgagttcttagactttatatttggattctttggtttcaaatcacaaaaatcaactccatctggtttaatccaagaactctattggctcaggcaacagtaaaaagcaatgctaactcatttgggaccagggctcagatcatcccctgcactgtctctctctcgctccatgtctcaatcctctgcctctggtgattttttccttaggagggtttccttatgtg

SEQ ID NO: 19971 - DNA, 601 bp, Human
gacccactgcgcggctcgcagcggccgcccgcctcccacttcaccggcacgctcgttgcgtgtcgaggtgtgttgactcctacagcaaagggcacggatccgcgggtcagcaagcccgacgaatttacaccaatgacccgccgtgtcgccagtctcagaccagggcacaacacgccaaccctgcagaccacccccacctccccagccactgcagacccttccccctctgcttctgcagcacctctcccgaaacacgctcattcccgcccccgcagaccttccctacctcctggagaccccmctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtgaactgacactcgggtcggtctctcatctttcgtgccagtcaagcaggtttcagacacc

SEQ ID NO: 19972 - DNA, 601 bp, Human
tctcccgaaacacgctcattcccgcccccgcagaccttccctacctcctggagacccccctcaacccctgtagagtcccctgcccgtgcagaatcccctcccccttcccccgcagcccccctaccccacccggcggacagccccgcctcgcttcctgtctcttcctcccaagggagacccctgtcctggctctgactggggttgagttcgccagttttgacttatgtgtagagtccggcagcatcattttttggcatttaactcgtcacatctatttcacctaacctctttcttcttagtraactgacactcgggtcggtctctcatctttcgtgccagtcaagcaggtttcagacaccacaaatgccgaatgagctgctgccattccttcatcttaccccgaactgccacaacctgtgaacaccttccatgtgaatcaatcagccttggagtcagaggagagaagtacacattctgagctccgctgagtcgcaggaaagggagaggggtgcccagaggtcatcactctttccccaggcctgatttttggtccatctgctgagcctgatttggacacatctctctgcctcctgcagcaagg

SEQ ID NO: 19973 - DNA, 601 bp, Human
atgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtratgcccctaaaggaagaaaacagctaggagcctgctgttccccaggacacgcggctggggcatgggcctgacacacgggcctcgctggccagccagtagagttggaaaaggcaaatgagttcatggtgatcctcggctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcaga

SEQ ID NO: 19974 - DNA, 601 bp, Human
ctgctgtgcaccccattttcaaggtacagccagctaccgccccacctgctatgggagggcatctgagatgtggagtgggagggatcactgacatcccacagggggacctgtggctgggagtgggtggcagaaagggagccctggagagatgttctcagagtcagtaatgcccctaaaggaagaaaacagctaggagcctgctgttccccaggacacgcggctggggcatgggcctgacacacgggcctcgctggccagccagtagagttggaaaaggcaaatgagttcatggtgatcctcrgctgatgctgatggccgcccctgccatcactctccgtccctgttctcgaatcctacaagcattggctgctggggtgactgcatgctaaaagtacccatgtgcctcagtttcctcaccagtaaaacaggtcaaatagtacagctgccttacagaatgatggtcagattaagacagtgaactcagggagcaaagaggtaagcattgtacaagtgctggccaggaccctctgaatcattatcatgcttagtaagcatcagaggggtgcaggcctccagcacttattcagcagaaagatcagca

SEQ ID NO: 19975 - DNA, 601 bp, Human
tcccctctcccagcctctgggacctgggtgtagacccccctctggaacacactccttatggccccctgacctcctacgcaccaggaacctgtgtctgcctcttaatctgccacacccctgccaccctgacctggacctccccagcactctgcttcccgggtcccaaccctcccaacccactgtctcctgcatcggggactccaggccctgcccagccctcgcatccctcaggtagcaccccacctcgttttgagccctctgtagccttaccaagcttggactctcacatgggcccttgccycaaccttcctcctttccccagcccattagtgaccaggccagatgaccactgaagttgagacactgtttgggctgcaaatgacaaaacccaactcaaaccagctgcagctggacaagacatgccttatctcaaatacctggacacaatagagggtcgggggcctcagccagaaatggatccagggactcaagcaatgccccagggtgcatgcacactggctccctctttctgtctctttcacctgtgttggcatcacactctcctgctgcagacaggcccccatgggagagggcacaggag

SEQ ID NO: 19976 - DNA, 601 bp, Human
cagacaggcccccatgggagagggcacaggagctcatcatagtagctccacctcaggttctcatgtggccattatctcccagccgcatctaaacagaaagtgctggggggcagctctggttggtcctgcttgggctgaatgcccaccgtggaccaatctctggcaccccagcacccaagtccttcttcaaaacctctgtggcaccgacagcccagccccctgggtgtatttgcatgtgtgtgtgtgcacgtggacacacatatgtgccagtgagcttgtgagtgtgtctgcatcactcagmagccgggatcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggct

SEQ ID NO: 19977 - DNA, 601 bp, Human
acgtggacacacatatgtgccagtgagcttgtgagtgtgtctgcatcactcagaagccgggatcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcytgtactctgcagccccacggttcagtcccttgcattggattgggcgggaggctcctccctagcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaag

SEQ ID NO: 19978 - DNA, 601 bp, Human
tcgggatcaggaccaggatccctccttgtgggtctctccagccctcacctgagcacacaacaggccctcaacagagttgcatgggtcctggaaactgagggtcactgagagcaatgactgagggtcgtgtgctcagcactagagcagacttcacagcccaggcccgctggtgctggggtcccccacacacctgcccacgcctgctgccctcctgtggctgggagcgcacccttccctcttgtactctgcagccccacggttcagtcccttgcattggattgggcgggaggctcctccctakcacctctccacccggctgcccttgtcattctctgcgttaaacatccctcccccatctcacaggacaagggcttgcacctctgcctgcctggcctcctcgcctcccctggcacatttcctcagggatgggtctggacagctgtgggaggagccacccgctcagggcactctacctcccactccaggccaacgccacagggggcggtgggcacgtgcagatggtgcagagggccatgaaggacctgacctatgcctccctgtgctttcccgaggccatcaaggcccggggcatggagagcaa

SEQ ID NO: 19979 - DNA, 601 bp, Human
cccaccccggctgcgccccctgagccaggttcacggccgaggtggtagacatctactacgagggcgaccaggtggtggaggaggacccggagctgcaggacttcgtgaacgatgtctacgtgtacggcatgcggggccgcaagtcctcaggtagggcctccgggacgtctccggacccggctcccccgcagtcggcagcgctggcccctccgccacccctccggggtgtcctgcccagggtgccctccggccttggggcagggaatccgggcacggggtgggcgccgggccctggggtccycagggactgggcctcagcccgccggtggttccaccctaggcttccccaagtcggtcaagagccgggagcagctgtcggagtacctgaccgtggtgatcttcaccgcctccgcccagcacgccgcggtcaacttcggccaggtaggcagggccgggcccgctgggcagggctcccttctcaaggccgctgcctcctcccccgccccggttctgcacgcgtactgcaccctcggacagcctcggggcctggcacgggacttgcaggatggattctgcccgctcagccaagggcgctggccgc

SEQ ID NO: 19980 - DNA, 601 bp, Human
gcagggcttcgggggtgcccacgcttgctggcggtcgtctccgcagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgaggtgaagctgggcagggcggggcacagccccaggtcaccccaggttaagcggttcctcagcctcagggctttgtgactcgggccycaaggctcacttggagcaaaggaatcctgacttccaaggctggaagggcccagaaggctgcagccgccaccaggtcccccggcctcagcctggacagagctcagggtgtgcagggcaggagagcacacagcccaggctttgctcactgtcaccagagggtcgtgtgtgacgccccctccccccagctattgacaaagttcttgcacatgtgttttaccctggtactccagagggaatgaccaagagtttcctgggttccttccggacacgtgcatctcatttaacctaacaactgaatcc

SEQ ID NO: 19981 - DNA, 601 bp, Human
agaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcaygaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaatgggtcttgttccatgtgttatattccaatcaccccaaacagctcactgccatctcccacaccaagagaaaaaaaaagccatagtcaccgtgattttatcaaggcaaaagcctccccacccaagtctggatagaaggtgc

SEQ ID NO: 19982 - DNA, 601 bp, Human
gttgactgaggccttctttctgagcaaatggctttttaattaggcagatgattcattggtctgggtaaagtaaagcatttcctttccccagaagtgtgtttggaactgtcaggggccttagaacagttcctaactataggaaggggtgtgaatgtaggaattccctccaccaggcccagaaggatggaggggccacaccaaaaagggaggatgttggcagccagctagaaagtggagctgaaatccccttataatttgaggatctagctcggcagctatttgcatgccctctgtctttagytggctattttctgtgctaatggacaggagttaaaatgaggtaactgtctagaaagattttggagagagcagccaaatgctagggtaggatttgaggggttctcatgtgctttttcattttgcagcagatgtcccttctctagagtgagttatggtgtctctcacatagctggggttgtgtgtgtgcattttcttttgaagttctctagtctgagaacgaggagggagctcggtaagccagcatgtggcccagtggcattgctagattcatgacaatggctgtaccttgccaggaagacct

SEQ ID NO: 19983 - DNA, 601 bp, Human
gccagttttgacaatgtctcttaataacaccagaatgtttaggtaagtatctcttgaaggctgatctcaaagtgattcttccagacagaccaccaagattgagaaatgttaaagcctactttgaacgtgtctggtgctgatttcttatggctttttaatttaatttgtttacaaattgagcacagtaacagcatattataaactgagctccagtccggctctaatctgaaacagttatagccatcgattcctctagcagagaaagcagaggcgggagctgaagcctggctcgctgctgatyacatctgaggtattggaatatgccatgagaaagttataggtagaatgagaaggtcctggtggcttggcctggcccagtccagacaggcgatttaggctgaccctgccaagaatagcccctgagaaaatggctctaacacatggaggcaaggatctgcggaagacatttatcccatgatgatttctctgtgtctaccacagccgggaacttagtaaggctcttgtcacttttaaacctgtaagaagcagaaacctagttcacacagtgccctaattggatgtacttttaggttttaatatg

SEQ ID NO: 19984 - DNA, 601 bp, Human
aacaccagaatgtttaggtaagtatctcttgaaggctgatctcaaagtgattcttccagacagaccaccaagattgagaaatgttaaagcctactttgaacgtgtctggtgctgatttcttatggctttttaatttaatttgtttacaaattgagcacagtaacagcatattataaactgagctccagtccggctctaatctgaaacagttatagccatcgattcctctagcagagaaagcagaggcgggagctgaagcctggctcgctgctgatcacatctgaggtattggaatatgccwtgagaaagttataggtagaatgagaaggtcctggtggcttggcctggcccagtccagacaggcgatttaggctgaccctgccaagaatagcccctgagaaaatggctctaacacatggaggcaaggatctgcggaagacatttatcccatgatgatttctctgtgtctaccacagccgggaacttagtaaggctcttgtcacttttaaacctgtaagaagcagaaacctagttcacacagtgccctaattggatgtacttttaggttttaatatgcagtgtgcagccgaagaatgagtgt

SEQ ID NO: 19985 - DNA, 601 bp, Human
tgaactcctaatatgagaggctttacctaacacggtcttggatctccagaaatagaccaaccctgttggtgattagagtcaaatgagtagagcttttaatacttagtgccaatgttaagttaaaaaaagtaaaaagtaataaaaccttcatagcagtaaggtactctgctatttaacatcccttgagcaaagctattaattttctttttttttttttttttttttgctgacttgcgggagaaactctggcatactactgttccattttaaataatgaaacaagtgtctggataatgtcacrtatctggcataaaatgaaataagctagaaaatgcagagaagcaggtgttccaccaaaatcctgttgcaggaagaagacatcagtagttttagtgaaaggagaatgttaaaataaaaaatagtggcctgtgttattttagtccttccacacctggaaatgttgccaggaagagaaaaatgaatccatgttacaggaatgctgggtctttggaccaaatacccatgtaggaagataagatatatcctttttcccagtcttagttatgctagctgtaaagtgagttgctcctcaaattatgtt

SEQ ID NO: 19986 - DNA, 601 bp, Human
aatatttaaatatttactatttggccttttacagaaaaagtttgccaattgctgctctagagtacagagactacctgaaatccttgcttacaatgtttgaaaagaagtctgaaaagaagcaaactaggctgggcatggtggctcatgcctataatcccagcactttgggaggccgaggtgggtggatcacctgaggtcgggagttcaagaccagcatggccaacatggtgaaaccccctgtctactaaaaatgcaaatattatctgggtgtggtggcgcatgcctgtaatcccggctacaygggaggctgaggcaagagaatcgcttgaacctgggaggcaggggttgcagtgagccaaaaccatgccactgcactccaacctgggtgacagagtgagactccatttcaaaaaaaaaagcaaactgatatgctaactgaactgcctgccagaacataactcaacattctttaaaggaagacaacaaaatccagacactgaacatatgaagaaatgtgacccataaccaggaggaaactccgtcagtagaaacagatcctgaaatgacagagatgatggaattagagaaggacttcacaaag

SEQ ID NO: 19987 - DNA, 601 bp, Human
catagtattccttggtgtatgtgtatcacattttctttatccaatctgtattgatgggcatgtaggttgattccatgtctttgctattgtgaatagtgccacagtgaacattaacatgcatgtgtctttatggtagaatggtttatttttctctgggtgtgtacccagtaatgggatttctgggtcaagtggtagttctgttgttagctctttgaggaattgatacactgctttccacaatggatgaactagttcacactcccaccaacagtgtataagcattcccttttctctgcaaccycgtcagcatctgttattttttgactttttaagagtagccattttaactggtgtgaaatggtatctcgtggttttgatttgcacttctctaacgatcagtaatatgaactttttaaaatatgcttcttgaccacatgtatgtcttttgaatagtatctcttcatgtcctttgctgactttttaatgggatttttctttttttcttgagaagttgtttgagttccttatagatgttggatattagacctttgtctctcattctgtaggttgtctttttaccctgtttcttttgttgtgcaga

SEQ ID NO: 19988 - DNA, 601 bp, Human
gcaaaaggggcacaagagaatcatttaaaatgttgaaaccttccctatcttgatcatggtgtttgttgcttaggcttatgcatttttcaaaacccattgtacactttaaatgagtgtgttttattatagataaattaaactgcaatataaagtgatttaaaatgcaaaaaaaaggaaactgaagtagaactggactctaagaaaaacttcagaacatcagattattttttatctaaaatatgtatgaaattggagtcaaagaacagaagaaaggttttaaaaaagaaaaggaagaattatratgtcttcatttgaatcaaattcctactcactacagtttccaactacagtctgtatctcaatccactggatttttccattccaacagtgacctattgcttttgtcaagattcccaatagtcaagacattaagaaagtaattgatatttctaaaatgttaactgttaatgtgaccacaagaggactcagtgtgtctgccagagctgaagttattcctttagagaaaagtttgatctaagccaactcttatcccatgcctccaaatttcaataaagatatatttcaagcattcaggctctat

SEQ ID NO: 19989 - DNA, 601 bp, Human
ctgaagagagagaagcctgtcataaatttgatctatttcctcagtcataactagggagagctcaccatctgaagctttgtaaaggtagagaccgggcttgttttccctcctggctgggttcgttgctaattgctgtactgttattaaaacaaagggctgatctataaatgccccagaactacacaactatacccaatcagggctgtaatcagaccacccgatgttttatggactcggtgtcttggcaatccagaggcacgccagtgggggcagtttctgctttgtctgctcattaaacttyggacaccttttctttgttgctgggccagtcattcccacaatctgattggccagagttgatgctgtttgaaatgggcaaattttatacttactctgaaaaacgagcaataattccaaagagtatttgtttaaaagagcaaaagtcactgttaaatgagcagattgcctgaaaatagatttatctgaacgttctgagactaggaaaaaatttattgtggctgccaggtacaatattattcacatttcaagagagagaatgatgatattaataccttaccttaggtaactgcctttagccttt

SEQ ID NO: 19990 - DNA, 601 bp, Human
ttttaaactgtatttcttcctttccccaacagacatcactgtttgaaatttgatagggagatttgtatgtaactctcccccaggtcagcagggaaaaatgtgagtctgagtcttgtatgaggacttttgagcttatatttttaaccacctaggtagggaacatcccagtctctcatcaaactcaaataggcttttgaagaaaaggatcagaggttgtcggatgtgctgtttctagtgctggttggcagccgtggcctgctgatttcttctctagtacttgaagttgttaaaaatgtccagsaatgtttgactgtttacacttatcttggaattgtttagtccctgctaaagagaatccagactgttctgtaagacataattttgtgtgcatgtgtgtatggaaatatatattcattcagtgaaaggtaaatttatttcacaaggtggtgaatcaggcatttgtggagttcttaagcacccacattaagagactgagggagaatgggcaggaaccgagaacccaccctggagaccaggccttctgacccctgtgttgacgtcccccattctctccacagccccgcgacctcagcactactgt

SEQ ID NO: 19991 - DNA, 601 bp, Human
gatctccacatttctgacccggtgttcttcccacttctgcctccttgactagagtcccatgagatccactgagatctaccgtacatgttgattatgtacaaaggagcggaatgcaataaagtatacatgttcacagtcggatacaactttatcatctcataaatgtgacaaatctgaaatacagtagttactctaaatgtaaaaaatattcacaaagcttactgccatggaatttagaagagctaactgctgggggttagttttgcatggcccattggtgtctcaagaaaaccaaaacaaygatagaaacctggccatggggattggaacgggtgtcgtcttttcctttccatgtgttccttgtaggaggtaaaaatattgaaaatcatcctaattgatcatttttgaaaaaaccatgtggacatttacatatccaaagatgtagcacccagagttttagttgtaatagaggttgtagcaaggcagggtcgtgctgagtctgaaatcctcttactgctcttccctcaccatcctctcccctgcctcctcctgtgctgcttatcacggtaaagatttgtcattattgctaagtcttctcttt

SEQ ID NO: 19992 - DNA, 601 bp, Human
ggtagccttacccacactctggcactgagtatgactccatgggtagcttctattaggttggtgtgaacgtaattgcggtttttgccattgaaagtaatgggtctgagtctgaggatttcagactcagcaagaccctgtcttcctaagacctccatggcagcaaaagttttaaatgtaggaaataatcgtctctctctctctctctctcttttttttggagacgaagtcttgctctgtcacccagactggagttgcaacctccacctcccaggttcaagtgattcccccacctcagtctccygagtagctgggactacaggcgcacaccgccacacccaactaatttttgtatttttggtagagatggggtttcatcatgttggccaggctggtctcgaactcctgacctcaagtgatccatctgcctcggcctcccaaagtgctgggattacaggcgtgagctacctcacaagggcagaagtaatcatttctcatgtgcctgtctctcaagaccacatttcagcttcaggacacgtctaccttaatgttacataataccaacatcatacttaacaaggctcaagtcagtctcaacctcccc

SEQ ID NO: 19993 - DNA, 601 bp, Human
actaatttttgtatttttggtagagatggggtttcatcatgttggccaggctggtctcgaactcctgacctcaagtgatccatctgcctcggcctcccaaagtgctgggattacaggcgtgagctacctcacaagggcagaagtaatcatttctcatgtgcctgtctctcaagaccacatttcagcttcaggacacgtctaccttaatgttacataataccaacatcatacttaacaaggctcaagtcagtctcaacctcccccttcccctcccacctccctcattcctggagaacctccytttggaatgcttagttttgttggggacactgggattttgcctcaagaccctggctcaaataactggtgtgctccataggtaccttcctctcattctgactcagttgctgagttctggtctcatcctgatcttcaccctcacctaccccagcattcttgaactacctctctgtgtgtctggcctgctgctgtcctgttggtctttctaaagcagctgccttttgctagtgatctaaagtttggcttcatgacctggattcaacacccacaaccctggctgcaatctacttttctttcgtga

SEQ ID NO: 19994 - DNA, 601 bp, Human
acctcaatgagcacggtgccagggagtgattgccctcagcaaacctggcggtaggcacagtcgtgagtttgcccacatcctgcattcatgataaacagtttgctgtttgatcatatagcctccagtggaatgctgagttggtcacaatccctttggccttttcaactcccaacacctattaattttaactattgggatatttatatagcatctatgtgctaccccagggtagagttatttgtgtttaattctatgtctcctagaatataattttttgagggaaaacattttacataaaccrtcttcatattgctccaaagcaccaaaccttatgatttccacatggtagatgtttaagagattttgtcagatggatgaagaaatgcataaatgaatgatgaactttgacattgggcagtcccctccctaggccttagtttttccctctgtctagtgagggagtttgactagatgatccttaaggttccttttcagtctatctcacatccaggcttaatattaatgaaaagctttgaaatacctctttgaattttattactatgtgttctaagtaaaggaggcatggttaggaattatatat

SEQ ID NO: 19995 - DNA, 601 bp, Human
atgagaattcagtctccctttccaccccgatttcctgtgtaatgtgtcctggcaaacaagataagagacctccaaagtaaaaacatgaggcaaaccaacagcattgtgctatctaagcctaaggaggatgctgtaagcgcaggtgcagaggaaaagaaccatggatgctgacaagaggaaatggcagattccgctaaggagggagcatttgaagggaaccttgaaggacaagcaggatcctgaggcaacgcagatggggcggtagggtgtcccgggctctggcaagggttctcaccttccrctggcttggatttcctgatgtttctgtcctgagcggtacagcctgtttgctctgtttgcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagacgtgctctactgggtaagtaccctggggagagagtttatggagtgttctttgctt

SEQ ID NO: 19996 - DNA, 601 bp, Human
ataaatagaaaaagcatcatcaaaatagcccaaactgatacttcccctccccaaacagtacataaaacaacattttgatttttttaaaaatcaaaatctgtgactcttctcagctttgtttttctctctattgacatggtgaattgtcagctgcagagccaacatgccttgactgatgaaaaattttatactttatgttatattccttcacatcgattctcagaattttcctgttgccaagcaagtgtaaaacctgggagtagatgattaaaggagagggaacttcaggctcctagaagcraaagtttccgcttactttcctgagaaggtttaaatatcatctaggatgatataattattatttttattattaatatgacaatcacgtggttaatactttgacagtataattgcactctccataaattacacagcatctttattctggtggggatctcaagccattcataaactttatcccagtctgtatccctttatagaaggtctgggatcttgaagatggagacagtggcgtagagaccatggaacattccccgagttctacagcaaatggttgtggtccttgatctagaacagtggt

SEQ ID NO: 19997 - DNA, 601 bp, Human
agctaaaaagaaaattatttcctgggcaccagatgacaccccttgatgactttgatataagttttttaaaaattagtctaaattgaagtccttcagtggaagccagtttcttcattgttgataaagaccatacaggcaaaatcccaagcagtctctattttcacgtgggtatttttgggaacagcttgcatgttctgatttttcttttgtatatggtaagatccaagaaatgcttggctctgaaaagggacttggattgagaagggttcaatgggagcaagaccgttctcagagccgaagyttgtctctcttgccccaccttctgacttagagatttggaatctccagtggactgtattcatctccagccttcccctccaggcctcaactgtcattccaagtgatacttctgatttgagcaaatgtgaatctgatgaacacctactcccaagaaattaaaagggttttaaattttttaaaggaaaattttccctcccaagtagagaagacagctgttactagagccattctctggaacaccagactgaggcctgaaggagggttggtgaagcagatggctcagcagatgacggttgctagg

SEQ ID NO: 19998 - DNA, 601 bp, Human
gtggactgtattcatctccagccttcccctccaggcctcaactgtcattccaagtgatacttctgatttgagcaaatgtgaatctgatgaacacctactcccaagaaattaaaagggttttaaattttttaaaggaaaattttccctcccaagtagagaagacagctgttactagagccattctctggaacaccagactgaggcctgaaggagggttggtgaagcagatggctcagcagatgacggttgctagggtcatggaagagtgaggtttcctgatgggagccctggacctgtctgycctcccgtcaccttgttgggcaccttctcccctgctgcatgcacctctgttccaacacagagggaaacaagcccaggtggggctctgtctcaggtgctgacccaggccaggcacaggccaccacaccaggcagccagttccttcttcatatatgggtttttcagtaagtttagtggtatagttgctctggatgaattaccctctgccttcctgctgaaattagtttatccaacttaattagatcaacaattgcagccacagcccaggctcattcattactctaattgccaatgtaagatg

SEQ ID NO: 19999 - DNA, 601 bp, Human
aggcaagagcgatggctctatccagactgtttgcagttctcattggctgaaaattctgggtgttgtggcagggtcataccttgggccatccattctgtcccctgactggttcttaacacctccttcctgggaaaggtgttttgctgaatttaacattgacctgtgctgctggaaagttccatccagctgtgatccttaaagccctgtttgctctagcttcctttggccaggtctgccagggagactgtgtctgaatgtgcagcatgagcttgtccgggaataggggaatggggttcctcargccacaccctttcacctctaaacccagtcagctcacagctggagccagtctcccaggggggtcatctagatcaaagctaagtgtggagaataagggctgcttctcctttctgtgggtgcagctaagaaaaagcccattccccaaagagcccgtggcttgtgtcagctagttgaccttgaaaaaatttctttttcacattcattttgctgcattcattttgtttgcactcacaggttgcagataatccagatctaaggtgggtttggtttccttgggtaggttggtttccagtagaagatt

SEQ ID NO: 20000 - DNA, 601 bp, Human
gtgggtttggtttccttgggtaggttggtttccagtagaagattattttaggagtttttaaaaagagtttatagagtcagatggtacaagtttgtctctataattaagacttttccaccatcacaaactttaaacacaaagtctaaaatcttgggcagcatagaaaataggttctagctaagcaggagttttgtcctctaccaagacctttcctgaaaatcacttatcaagacagtttcctgtaagaaaaagccatatcccagctgattttccttcctggggccaaaatctgctattattyggcctgaaagccttgatgactctgtgtgtgtgtgtgtgtgtgtgtgtgtgtgtgtgtgtgtgtgtgtgtgtgtatggatgcttgtgtgtgtgtatggggaatatgtgattaatgtgtgttggctgctgttgtctctgatttggctactgttgtttctgatttaaatctaagtaaatgtttaattaaatgtatagaatgctgtctctaatgtgaccctctctccttattaaatcctcttattaacccactcctatgagaccatcttatttcttgcagatgaatgatgctatgggatttgaa

SEQ ID NO: 20001 - DNA, 601 bp, Human
cggcggtgggggtaaaggcctgattctccttccagcctgggtttggcatttgtgcttttgaagaagagcttctgtggcagagttgctgactagaatgtgctacgtatttaagttttcctttgctcatgggaccttcctaacctcaggcctggcggttggatgacgaggccctgccttcttggtgcctggcactttttccctggagccctgcaccagcctctcctcatgatggaaggcaccattgcattaacactcactggcttttttctagatgatttgggctgtggcagctggcgggggrgctgggggggaccagcagtgcagaatgtgctgggcactgtctgccgtgggggagccctgtgcggtttggttttgtttgcttcttgctggtatccttcaggtcttatctctgtaaagtgcaggtgtcatttttaagagaactcaatcttactcttggcagagtttcataaaaatgatgtgttatgggcagaatatgcaaccatttgtgaagtgattttgcctccattctcttgctctgccctctctgagacatcatgaagcagacagagaatgggtttgtcatccccactttacagatgag

SEQ ID NO: 20002 - DNA, 601 bp, Human
ccatagaaagggagttcaagaagtcttccaaggtactagcatttcttgatgtgcatgcgggttacgtgttcagttggtaaaactcattgaaccatatacctatgattagtgtactttttcatctgagtgtcatttttcaacaaaaacattttcctactatatataaacactaacttaaaataggcaaagacctaaatataaaatataaaatcatgaacattccagaaagaaaacaggagaaagtctttgtgatcttgagttatgcaaaggtttcttaagatacaacacccagtatactttytgtaacagaaaacaaacagataaattggtctttgtcaaaattaaacttctgttcttcaaaagaaaagaaaaaggttagcttcagacttggagaaaaatatttgcaaagcatatttgataaaggactggtatcccatatatataaagattaatgcataaaggagagtgtcaataatagaaaaacccaataaaaaatgggcaaaatttttaataggcatttcaccagagaagagatgtggatggcagataagcacatgaaatgaccatcagttgttacaaaaatgcacattaaaatcacagt

SEQ ID NO: 20003 - DNA, 601 bp, Human
tatttttatgaaaacacgattcaatattggctcttctcctaaaggtatattttgagcatcactagttagaaagggcacctgatgactcagtatgaagattcatgtcctactcagctttgacaactctgccaggctctggaggaacctcagagatttaagaaaggattgaaaaggttccctttaaaaaaaaaaaaactagctttgtagcactttgctgcctggtaaattctgtatggtgattgagatgctgcaagagatgtgtataataagcgaagtggctctctgcactgattgcatgagsagatccacgtcccatatggtggatataggaactgcatatgtgtgcaagtgtagttttgcatctgcacgtgaatctatgaatatctagattttctaacccacttaagggctgcatatgacagattctggagttatctataagccataaggaaggactgatagcatgatcaagtcaagattatacttttaaaagtcgcattttaagaccaacataatttttatgatgaagtctgttaatttctgtgccatttgtgctcatctttctttcctgcactcccaccccaatctagacctccagagt

SEQ ID NO: 20004 - DNA, 601 bp, Human
ccaggtgagtcctccctccattccccgaaaagcacttcgtgagcagcagctaaaactcctctgccttcttgtctgctcacactcaggaagacaaaaggactccatttttgttcatctctgccctaatcatagcctggtaaattttgtgccatttaagttattcgttctgcatcatcctccagctgtctatcttaagtgatgtaatttttttaaagacttctagctacattacaaaataataaaccaaaaaaaccgtttttcacactcaagctcttccaagaaaactttttgattgattttmtgaggtttctttgaaatagactctaaaattcttttctctttggtactttttgatggcaggccagttcataatcctagttataatagatttacacaagaagtgaattctcatgcctccatgctttggtgtgtagttggaggaatcagagtggtaggaactgtggcagccattggtcccttctgtcctcctcctgggatgcagtgaggacacaaagattctgagggtgcctgtcctgtggggcctctgcaggcagtagctgagaagggagcggtggttgcagagaggcaccgatggctctgc

SEQ ID NO: 20005 - DNA, 601 bp, Human
ctgactctacgctgaggtgctcaaaaccctcctccttggacagggtctgatggagaagtttaaaagacccacctgtcctcattgcttttcctgtgtgatgtgagctgcagagccctgccagagaggaaaggcagcagacagctgggtcctgtggtggccctttccatgcccagctctctgctgtggatgagtcacttacccatttctgaagaaatccagagaccaaagggaatgatctggacaattctctcccacttggtcattttcaggtatatataatctgctgtaagccatagtattkttgtttgaattatacttaaattttggctgctgatcagtgattcttttttaaaaaaaaatttctttcagagaaactggtgtctttttttttttttttggtaatgcatgcatatggcacaaaattctaatgttacaaatgaataataattctcccagccagccacaaatttcctcttctaggaagcaaccaccattaaacagtttcttgtgaattcttagatctgcattttctgatagctacaactcagttaagctacctataggagactttccacagacaggagctcactgtacgtgctgt

SEQ ID NO: 20006 - DNA, 601 bp, Human
taataattctcccagccagccacaaatttcctcttctaggaagcaaccaccattaaacagtttcttgtgaattcttagatctgcattttctgatagctacaactcagttaagctacctataggagactttccacagacaggagctcactgtacgtgctgttttgcatcttgcttttatcactttgagtgtcctcaagagccttcctgcttggtccataaaaggctgcccctcctttgaaacgctgcgtccatgcggtggtagatgtgccgttgttcatatgaccagtcccttgctgacaarcattgagttctgtctggtcttagcccacatacacagggctccagtaggtgaccctgaacacgcatcagagggcacatgtgttggctgtagatctgtgggataaactcccagagatggaattgctgctttagagggtgtgtccattttaaatgttgacacacgtgcccaagtgctctccttatggttgtattagctcattgtcttcacactgcccattgcctcactgcctctcccctcagtggagagcatgctttgggatgcccatcagttaggtgaaaatggcatttcattgtactttta

SEQ ID NO: 20007 - DNA, 601 bp, Human
cacagggctccagtaggtgaccctgaacacgcatcagagggcacatgtgttggctgtagatctgtgggataaactcccagagatggaattgctgctttagagggtgtgtccattttaaatgttgacacacgtgcccaagtgctctccttatggttgtattagctcattgtcttcacactgcccattgcctcactgcctctcccctcagtggagagcatgctttgggatgcccatcagttaggtgaaaatggcatttcattgtacttttaaaagatactgttcttatcaggagtgaggttgracgtcttttcctatgactcagagccatcagtagtgccttttctgtgaattactttatcttttcaaatcatttgcccatttttgtttggttgtgatccataacagtttaaattttaaaaatatctagttcagattgaagataaaggagctctgtctgtcgtcggaagatagcatttttttcattactgttcttattcatctgattctatttcatcatggattgaattatcaagtatgatcagtagagaagattaaatttcaggtcattggtgatatctactcttgaggtagttttgtaaat

SEQ ID NO: 20008 - DNA, 601 bp, Human
taaatcttggctgggtgaggtggctcatgcctgtaatcccagcactttgggaggctgaagtgggcggaacacttgaggtcaggagttcgagaccagcctggccaacgtgctgtaacactctctctactaaaaatataaaaattagccgagtgtggtggtggtcacctgtaatcccagctacttgaaaggctgaggcaggagagttgcttgaaccggggaggtggaggttgcagtgagctgagatcaagccactgcactccagcctggcaatagagcgagactccatctcaaaaacaaacaracacttaagtcttaataataaggttattttttttcactcaaagaattatctatttgtgtaattaaaaaacagtgttttagaaattccatgggataacagatggatttgttcagtgcaaactggactgtgaaaggcagcttaaaccagatctaggcagccaccgaggggctctaagagagcggctgcaatttgtgaatccacctgctggctgataccagtttggcttctcagatcctgacaggcgaagactggaatgctgtgatgtacgatggcatcatggcttacgggggcccatcctct

SEQ ID NO: 20009 - DNA, 601 bp, Human
gccttggcctcccaaagtgctgggattacaggtgtgagccactgcgcccggcctgtctactggaattttgagtgggcattcctccatctccctaactagatggataagcttcttgagtcaggaatctttttgtattcacatctctcaatagagtacaggatcttgcacatagttggcccttggtaaatgaaaggtcattattttctttttctgctgtcctatggttgactctttaggccacagcaacatcctggacttgaatctgcagagaagtattccctggtgcttgtctgtggttgcmtgttgttttctttatagcacatgccactgtatcagaggtgcttagggagctgcttatgctctgtcttccccaactagagtagacattccagtgtgtggtgtttcttcctgtgccctcagcacccacaacagtgcctgacacattggaggtacttggtagatctttctggatgaattccagagcatgccactctttaggagggtctgagtaatgcctctcaatacagatgatggattttgctctggaaagttgttacaagcttgtaagatcttcctgtggctcatcactctggatttgctt

SEQ ID NO: 20010 - DNA, 601 bp, Human
accagatagccaacagtgacaacaaggtatgtattctaagatgcttctcccctttttgtttcaaaatgatcctgttgatctccatacatgtaccatttacactgtggaagtgtcttgtgtatcattcttgtaatattttggtgtgaagaatatggcacaccatatagaccctggcttcccaggggggattctggttgaatttaggcagttagttgtgtttactgatatttcaccagaaaaccaatatgataaagaattgactagtttgaccacttatgttttctttattggaattgtgcartcagccctgacccgtggtcaggatcacgttagcatcttctgagtgggtatgaaaatcgcggatttttaatagatgtctgtttccagaggtaatcccaggatcaggtggcctcagggctatactgtaaaactgaatcccatttatgacagccctggttgttttgttctttctctgttcatcgagttgataaatgcttactgagtggctatcatgtgtcagacactgaggattcaggaatgaagaagacaggtccctgccttcatggggctcacagtctggcaggaagacaggagtatgaga

SEQ ID NO: 20011 - DNA, 601 bp, Human
aagtgtcttgtgtatcattcttgtaatattttggtgtgaagaatatggcacaccatatagaccctggcttcccaggggggattctggttgaatttaggcagttagttgtgtttactgatatttcaccagaaaaccaatatgataaagaattgactagtttgaccacttatgttttctttattggaattgtgcaatcagccctgacccgtggtcaggatcacgttagcatcttctgagtgggtatgaaaatcgcggatttttaatagatgtctgtttccagaggtaatcccaggatcaggtggcctcagggctatactgtaaaactgaatcccatttatgacagccctggttgttttgttctttctctgttcatcgagttgataaatgcttactgagtggctatcatgtgtcagacactgaggattcaggaatgaagaagacaggtccctgccttcatggggctcacagtctggcaggaagacaggagtatgagatgcattatcacatggtatgagtgaatgtgctggcacagggcaaggacagagccctgaatggtgctggctaaccacgactgggtcagggttcagccttcttctcacct

SEQ ID NO: 20012 - DNA, 601 bp, Human
tgcacactcaaatacagatgcagctttggggaggaatccatgccctatgctggaccaccagggtgacttttcctctctgaagtgattttaagtcagtctcccctcctcccaagacgtctttgtcatcctaggttacaattgatgactatagagaagaggatgaagacaaggacccctatccgccttgcgatgtgccaggtatggtggcggaggccggagacgctggctttgctgtgtgtctttgctactgctctgtgaccacctgccgagtctgcggccagccagcccagcagcgtgcacwtgagctgctgaggccaccaaggccgtgggaccagttagctcgcctttttcccatggtcacaggcagaatgtgtcactcaaattccaggtgatggggagggaaagtgcaggtgggtcagggcagtcccagcttctgctgggagactggtccaggaggccccccggtgttagcgctcacctgacacttttatatttgactggcacatttattggctgatgtgggtgggactgtggagttgggagcctaggagctgattgagactgaaagtcccacacagtttctcaggctagtctgagcgag

SEQ ID NO: 20013 - DNA, 601 bp, Human
ctctctgaagtgattttaagtcagtctcccctcctcccaagacgtctttgtcatcctaggttacaattgatgactatagagaagaggatgaagacaaggacccctatccgccttgcgatgtgccaggtatggtggcggaggccggagacgctggctttgctgtgtgtctttgctactgctctgtgaccacctgccgagtctgcggccagccagcccagcagcgtgcacatgagctgctgaggccaccaaggccgtgggaccagttagctcgcctttttcccatggtcacaggcagaatgtrtcactcaaattccaggtgatggggagggaaagtgcaggtgggtcagggcagtcccagcttctgctgggagactggtccaggaggccccccggtgttagcgctcacctgacacttttatatttgactggcacatttattggctgatgtgggtgggactgtggagttgggagcctaggagctgattgagactgaaagtcccacacagtttctcaggctagtctgagcgaggaggttactggggaaacagccaggtgttgggaggttggcagtgagaatctcagcactgccacctttcatctg

SEQ ID NO: 20014 - DNA, 601 bp, Human
taggatgccttgtgggatgagaatttttgtgaccaaggtccgcatagcatcctcatcctcatagatcccccacttgattgatcagttttcccaattgagttttatctttgtaaagtcatattgcacagtgatattttatgggttgtaagtattcagttcagctctatgatagtctacttaaaatagcatttctcatgttaaaatgataaggtgctcacaaggaacagggtaatgactcacaagtactataagaggaagacgtttatttactagctagtttctaggttttaaatcatctggsactgagtggaatgccaggggaaataaatggctcctggaaaggtttctagaattgcagaagtagttcttggctgtcagagaacaactctttataattcattggccctagggagacacaggtgggaagcaaggcctgctggcatcctcagagatatgaagatgtgatggtagcttttacagctcaccactgtttgggtgttctttaaaaaaaaaaggttattaaactgatattgctgacacctacagccctttgtgtgtgtgtgtgtgtttgtgtgtgtgtgtgtgtgtgtgtatgtatgta

SEQ ID NO: 20015 - DNA, 601 bp, Human
atcatgctgagcagcgctgccctggccgcagaggaccccatccgcagccactccttccggaacacggtaagtccccagggtggggctcgctctgggatagccctggcctctctcgggcagaggccactgtagagatgggagctgtggaggccctcaaggtgacagctagagtaggtctttccttcagctggggacgttggctgtttccggtttgtaagtgccagagagcttgtgttttagctgggtaaatctgaatggaatcattaacttagaacttcatcttaaatactctgcaggaacrgtcagtgaattcagggagcctgcttctccgcctctttgctccctgctgctgatatttaggtcctcctttccctccctgctcaggtttacactcacccctgttttgagattcatgcctcgtggaagcacacagcagggaggaagcagaattcaaaccaggcacaccacatgcccaggctgtcttgttcagggttggaggcaagatgcctatgtcgtgtagacttaaatacaccaagctgctaggctccacgactcaggagaaatacaagttagggagatgataggatgtcaagttgaggtg

SEQ ID NO: 20016 - DNA, 601 bp, Human
ttggaggcaagatgcctatgtcgtgtagacttaaatacaccaagctgctaggctccacgactcaggagaaatacaagttagggagatgataggatgtcaagttgaggtgttcagtggagaagaacattaggccaggtgcactggctcacacctgtaattccagtgctttgggggatagagggggaggatcactgaaggacaggagttcaagactagcctgggcaacataatgagacctaatctgtacaaaaaataaaaaaaattagctgagcgtggtgtcacatacctgcagtcccagctrctcaggagactgagggaggaggatcgcttgggcccaggaggtcaaagctgcagcaagcaatgtttgcaccactgcactccagcctcagtgatacagtgagaccttgtctcaaagaaaaaaaaaagaatatataatgaatgttaaaaaatttcttctctgggaagatttattataaaatatgtgattatgttatatatttcacaagtatctccaaagaaagtgctgaccttggccccagatagccaatattaagtttgagtaacttcatgaagcagagtgcaccaggcagagccacttgga

SEQ ID NO: 20017 - DNA, 601 bp, Human
ggcccaggaggtcaaagctgcagcaagcaatgtttgcaccactgcactccagcctcagtgatacagtgagaccttgtctcaaagaaaaaaaaaagaatatataatgaatgttaaaaaatttcttctctgggaagatttattataaaatatgtgattatgttatatatttcacaagtatctccaaagaaagtgctgaccttggccccagatagccaatattaagtttgagtaacttcatgaagcagagtgcaccaggcagagccacttggacccttaagcatgttaacttagcggtttacartattacttttcattggtagaattaggaatatacaaagagttattaattggctgggcgtggtggcttatacgtataatcccagcattttgggaggccaagacagtagaatcgcttgagcccaggagttcaagactagtctaggcaacatagtgagaccccatctatataaaaatttaaaaattagccacacgtattggcacatgcctgtcccagctacttgggaggctgaggtgggaggattgcctgagcacaggaggctgagcctgaagtcagctgtgttcacaccactgtattccagcc

SEQ ID NO: 20018 - DNA, 601 bp, Human
ccaagacaggcagatcacttgaggtcaggagttcaagacctgcctggccaacatggcgaaaccccatctctactaaaaatacaaaaattagctgggtgtggtggtctgcacctgtaatcccagctatgcaggaggctgaggcaggagaatcgcttgaacccaggaggcggaggttgcagtgaactgagatcatgccattgcattccagcctctgcgacaagagcaaaactctgtctcaaaaaaacatacaaacaaaaatacaagcaagtcaagggttttctattagttagttttgtaactyagagatggtgcccgctgactgtgtctgtgttgtaaggaaacttgcacctaaattggctcttgcctcagcagccccaccttagctgtgcagcttactcggcactgaggaccattcaaaggcaagacggctagaagcagcagcctgttgactctcaggcctagatattatcgtgcagtttcaggttattaccaagaaacccgaccagcagagggaggctggcgagtgtgcaagcatcaggtgtccctggcttgctggtgggcacctttttctgagcaccaggttgttagagattttagggtt

SEQ ID NO: 20019 - DNA, 601 bp, Human
ccttctagctctggtctcttcagttctttcaaaaccatagatcatagttgtcatgaagatcagtggccaagaccaactcgcctttgcagataagggtgctacggtcagaagctcccggtgagcagctttcctggtggtcagacttcttgctgctggcccacttgcctccacggctccgaggagaagcagggaccccagaaagggctagcaggactctgctgatgggataatagatggtattgtcaccaatgaggatagagttgcctggactgaaaattcaaagaccaggtcagtctgttawttgagtgggcccagcaaggttttttaaaaaaaaccctgagtttagagagagcagtgtgagatgcagaacaacgggcaggagtgctggagaccaccaatgcaggagtctgtaaaaccatcccttgcagacttagccagcccagcgcatgagcagggaagggtgctgacgccctgattacacaggctggaatgcgagggggcatatggaagctactggctccgacagatgccgctgccatcttcatttatgcttctccaccaatctgatgctcagatggagggcaacatacttcattcagcc

SEQ ID NO: 20020 - DNA, 601 bp, Human
gggagcccattccttatgtgcttagagtgctggagaccacagcagagctccaagaacctatccaaaactggccaagaaccacagggcgtgggtcattgtggttctgggagaacgtggcccatcagaactgtcagggcaaccatctcctagcaggaagacaagctgggaaatgaagacttttaaccatggttttctttaagccattggggaatttttgtgtgtgcaattcaggcaaaatgtattttgcatcggactactgtggaacttgggctctttacaaaatcttatataaaatgaaacytcaattaatatggtcagggaatgaggtggttagttttttgaggttggtttttttatttttttattttttggttcatgaaacagcataaagccaaccaacaactgtttacccctttcttaaaagtcttctaaaaatgtgagttcattttcctgcctttaagccgatgaatttggttgacacttctcctaagtcagaggtgtgcagtgggatggtgaccagctcttgttgatgaggcctctgtgggagggcctgtggatgcagaatgcacagtggtgggggtcggagggatgccgccagaac

SEQ ID NO: 20021 - DNA, 601 bp, Human
tgatgaggcctctgtgggagggcctgtggatgcagaatgcacagtggtgggggtcggagggatgccgccagaacactcaccggctcagcttctgcctcagcttcttggttttagaatttgacttcttttcaaagtgaatggggagctgttctacttagtctgttagcctggttaattgaggttttattttactctccacattttttagttgttaaatgaatatagttacccttgggctttggggaaaattagacacaggattatttaaaaggaaaaaaatgattgttactttttaatttckgtagaattgcttcaccgacttaaatcttctgagtcattcttcattttgaaggtattttagagaatggaaaataagctaaaacaagaaggattcagaaaatggagactcaccaagaagtgtctaatatctgagacgatggttcctggtggccttggggacatttggaaggctgtttggttatttgcttaagccctatgaaattgccatttttgtaggtcaaaaagggttgaacactggcgatttcataaggttcaatgtaatatttcccacctctacctctcttatactgtacttacctga

SEQ ID NO: 20022 - DNA, 601 bp, Human
tcactgaagcacccataataggtgctccaggtacatgtggcaggtgagcacagagccgttgagactggctcaggtgagatgccacctggcttcctagccatgcctggcacgtgtcatcagacttggaggaattgcttaagatggatgcgtcattaaagaccattaggaacaataaggggcctctgtggaaaagtgacgtaggtccatagagcctgggagccctgaattcaagcccccactggaaaggcttaattgaaacaaggtaggctctaccagggcctcagaggggccagaaccagcrctttgtggggaagtgggctctccggacagcacttaccttttgacgaatgtagtcctgtggagcctctcttagacaggctctttggacatgccaacagtgtattcatacttgaaacctgtgatcactgtaataaagcctaaattggtttcttcttttaaaatgtatccaaaataagctggccctttttgattttggtttgaagaaattatcctgtggctcaaccccgttggtttacatttctgacttcttaatgcacacttgttaatgaagttatactttcctcaagattttgcaaagagc

SEQ ID NO: 20023 - DNA, 601 bp, Human
tgaagaaattatcctgtggctcaaccccgttggtttacatttctgacttcttaatgcacacttgttaatgaagttatactttcctcaagattttgcaaagagcccaggtttcttttcctctggagacaaaaaatggtaaatcatccatgattctgcttctagatgacaacttttggagctttcctccacaaaggggccttctgcaggaactacttcaatttgctggatatgctggtggttggggtgtctctggtgtcatttgggattcagtaagtattctggggtgtgtgcccagaattgytgggctgaatggtttatgtaagggattttaacataattgataaaggctgggcatcattttcatgattatatttagttatataggtttatttaatttgctcccattccagaaagatttaaacaattcatgttttcttgtgtgtgtgtgtttttttctttttgtgcctgctgctaagttgagcttattactgtctgtgaaatttgctttcaactgaggtgaaagaagtgttgactaggagggagggaatctaggttctagtcctggttcctccaaaggctgattccagggccttgagggcat

SEQ ID NO: 20024 - DNA, 601 bp, Human
tgccacactgggttgggattgcccatctctccaccagactgtgagctccttgaaggccagagaagccctggtaccaaagtgctacagcagacctccaaccttaaacaaaaacaaatgatatatgaagcctaaaagccagctactacctagtatttacagtgagtggaaagaacaaagagagttcgtgagttgtgtctctgccaaggttagctgtgcacctgtcagcctctgtgagtgccatgggctgggcttgggaggtgctgcctcgtgtgggcggggaggagaagtcgcctctgagtcrtgaagagagatcagctcagcaccacatggatcccacgctaactgtgcagggatactaaagtgaagatccagtgaaagggtgaatctcaaagcatcctgtccatttataacacgctctgcctgccgtctttctgctccttccctagatccagtgccatctccgttgtgaagattctgagggtcttaagggtcctgcgtcccctcagggccatcaacagagcaaaaggacttaaggttttgattcctctcctccctgctgggctggcttgggttggggttggctgtaattactggctcttct

SEQ ID NO: 20025 - DNA, 601 bp, Human
gaggtgctgcctcgtgtgggcggggaggagaagtcgcctctgagtcgtgaagagagatcagctcagcaccacatggatcccacgctaactgtgcagggatactaaagtgaagatccagtgaaagggtgaatctcaaagcatcctgtccatttataacacgctctgcctgccgtctttctgctccttccctagatccagtgccatctccgttgtgaagattctgagggtcttaagggtcctgcgtcccctcagggccatcaacagagcaaaaggacttaaggttttgattcctctcctccckgctgggctggcttgggttggggttggctgtaattactggctcttctgggcagagctgagctgaggcctgatggatttttaaagtgagttataaggacctttctaaccaattcagccacctgtgccaagtgctaatggcattttaaaaattattatttattgtctttatttttggtaattgaagatatttttctttgtaattattgttcatttattacctttttattagtagttctttgtgtttattttagtcttttatttagtttatttagtctttcagttttcatgtagactgtataaa

SEQ ID NO: 20026 - DNA, 601 bp, Human
ggacctttctaaccaattcagccacctgtgccaagtgctaatggcattttaaaaattattatttattgtctttatttttggtaattgaagatatttttctttgtaattattgttcatttattacctttttattagtagttctttgtgtttattttagtcttttatttagtttatttagtctttcagttttcatgtagactgtataaaaggctactgggtttctgttttcctgagtcatttatggggtggggaccctttgggcccatgtgccaggcagcactgcacctgtagcatttcttctttttttttttttctttgaaacggagtcttgctctgttgcccaggctagagtgcagtggtgtgatctcggctcactacaacctctgcctcctggggtcaagcaattcccctgcctcagcctcctcagtagctgggattacaggtgcacaccaccacgcccagctaatttttgtatttttagtacagatggggtttcaccatgttggccaggctggtctcaaactcctgacctcaagtgatctgcccacttctgcctcccaaagtgctgggattagaggtgtgagccactgtgcctggccaa

SEQ ID NO: 20027 - DNA, 601 bp, Human
tggctgtgtttctgcacctccagaggcaccgttcacacaccgttcatggcgtccctggaggtgagcagcctggcattggcgtgaggacactgtttcttccctcttgaagcctctgtgtcttcatttgtaaaataaagatattgcgctttatctcttgggttccttccagaaatgaagttctgggagaaataatttgccagaaataatgcaattctttcggaaagaaaattgggaatgtcattagtaagaagagaaagggatttgattaaaactaaaatgcaggaagagtatacgtgggttygtttcctagagcctacagagttctctatggctgagctttgatccttcagagcgcgcctcaagcccattgtgtaagagatgcactcaccatgctgtggtttttatcggccaacgacatatgcccggtgtctgggtggctgctctggagaatacacgttgcactggtagttattcaatggttatttgagccgcgaagtagattaaatggagggcgaggagaggagaaacggcgccggtgttatgctcagctgtgtgacaggcgggcggactgagtgtgacctgcctggaggttggattgggg

SEQ ID NO: 20028 - DNA, 601 bp, Human
gaggacactgtttcttccctcttgaagcctctgtgtcttcatttgtaaaataaagatattgcgctttatctcttgggttccttccagaaatgaagttctgggagaaataatttgccagaaataatgcaattctttcggaaagaaaattgggaatgtcattagtaagaagagaaagggatttgattaaaactaaaatgcaggaagagtatacgtgggtttgtttcctagagcctacagagttctctatggctgagctttgatccttcagagcgcgcctcaagcccattgtgtaagagatgcwctcaccatgctgtggtttttatcggccaacgacatatgcccggtgtctgggtggctgctctggagaatacacgttgcactggtagttattcaatggttatttgagccgcgaagtagattaaatggagggcgaggagaggagaaacggcgccggtgttatgctcagctgtgtgacaggcgggcggactgagtgtgacctgcctggaggttggattggggcagtgtgtccaactttacgctgcttccacctgtcatgtgtgaagccagacgacccacacctgttttcctctccaggggactt

SEQ ID NO: 20029 - DNA, 601 bp, Human
gtcttcatttgtaaaataaagatattgcgctttatctcttgggttccttccagaaatgaagttctgggagaaataatttgccagaaataatgcaattctttcggaaagaaaattgggaatgtcattagtaagaagagaaagggatttgattaaaactaaaatgcaggaagagtatacgtgggtttgtttcctagagcctacagagttctctatggctgagctttgatccttcagagcgcgcctcaagcccattgtgtaagagatgcactcaccatgctgtggtttttatcggccaacgacrtatgcccggtgtctgggtggctgctctggagaatacacgttgcactggtagttattcaatggttatttgagccgcgaagtagattaaatggagggcgaggagaggagaaacggcgccggtgttatgctcagctgtgtgacaggcgggcggactgagtgtgacctgcctggaggttggattggggcagtgtgtccaactttacgctgcttccacctgtcatgtgtgaagccagacgacccacacctgttttcctctccaggggacttttcatcctctacaaggatggggatgttgacagtc

SEQ ID NO: 20030 - DNA, 601 bp, Human
ttacatgaaattctaattccaaactgttcctttctttaatttgaattaatctctatgcaatctttatcagatctttgtggaccaaaaagaaaggacatttgtaagtgattaattggggtgattgcagtggggtcaaatttggcacctaatgcatggccagatgttattatctactgtgacttgtccatatctacatacataaacatttcctccttttccaaattcatcttaatttcctttgagattttggtttgcttccctctcacctttacttctttgaacaatatttgtctggactgayggaaaaggttgcaaagtaagaacatcgaaggtacttgagaaatgcaacatggaacctctctgtggaacatttcccagatacctgggccatgtcttcccttgccagatgattaagctctgaagtttttgaaagcttgctctaggctgaagagaaagcacactcacccatggtgtgtatgtgtgtgtgtcagtgtgtgtgtgtgcacatgcgtgtgtgttcatgtgtgtgcttgctcccttcagccggccagtgcattgacagcccagtagtgcactgcccagtaggctgacagttgcccag

SEQ ID NO: 20031 - DNA, 601 bp, Human
gtccatatctacatacataaacatttcctccttttccaaattcatcttaatttcctttgagattttggtttgcttccctctcacctttacttctttgaacaatatttgtctggactgatggaaaaggttgcaaagtaagaacatcgaaggtacttgagaaatgcaacatggaacctctctgtggaacatttcccagatacctgggccatgtcttcccttgccagatgattaagctctgaagtttttgaaagcttgctctaggctgaagagaaagcacactcacccatggtgtgtatgtgtktgtgtcagtgtgtgtgtgtgcacatgcgtgtgtgttcatgtgtgtgcttgctcccttcagccggccagtgcattgacagcccagtagtgcactgcccagtaggctgacagttgcccagaagatctccaaacctgggaggagagttcagtagcgcgtgaacagataggcgataccaaagggaagtgagtagctaagctataatcagtactgatagatcggagtttttaaatggttgatttctgctggaaattgtactgcttgtagtttcactcagcaagatatcttcatagcattagacaa

SEQ ID NO: 20032 - DNA, 601 bp, Human
tgtctggactgatggaaaaggttgcaaagtaagaacatcgaaggtacttgagaaatgcaacatggaacctctctgtggaacatttcccagatacctgggccatgtcttcccttgccagatgattaagctctgaagtttttgaaagcttgctctaggctgaagagaaagcacactcacccatggtgtgtatgtgtgtgtgtcagtgtgtgtgtgtgcacatgcgtgtgtgttcatgtgtgtgcttgctcccttcagccggccagtgcattgacagcccagtagtgcactgcccagtaggctracagttgcccagaagatctccaaacctgggaggagagttcagtagcgcgtgaacagataggcgataccaaagggaagtgagtagctaagctataatcagtactgatagatcggagtttttaaatggttgatttctgctggaaattgtactgcttgtagtttcactcagcaagatatcttcatagcattagacaacctcacgttacaattgggagaacttttaagacagtagcagcagcatctccacacttgaagagcactgtcactgcgttccccccggccaggggaggttgagtttata

SEQ ID NO: 20033 - DNA, 601 bp, Human
ttgccagatgattaagctctgaagtttttgaaagcttgctctaggctgaagagaaagcacactcacccatggtgtgtatgtgtgtgtgtcagtgtgtgtgtgtgcacatgcgtgtgtgttcatgtgtgtgcttgctcccttcagccggccagtgcattgacagcccagtagtgcactgcccagtaggctgacagttgcccagaagatctccaaacctgggaggagagttcagtagcgcgtgaacagataggcgataccaaagggaagtgagtagctaagctataatcagtactgatagatyggagtttttaaatggttgatttctgctggaaattgtactgcttgtagtttcactcagcaagatatcttcatagcattagacaacctcacgttacaattgggagaacttttaagacagtagcagcagcatctccacacttgaagagcactgtcactgcgttccccccggccaggggaggttgagtttatatcgtgtgccgggatgagtgggagagtatcggttcaccaagaagcaatgccctccttaaaatttttcctgccctttttttcttgctcttctctttggtgttcacaagcccag

SEQ ID NO: 20034 - DNA, 601 bp, Human
gtgcttgctcccttcagccggccagtgcattgacagcccagtagtgcactgcccagtaggctgacagttgcccagaagatctccaaacctgggaggagagttcagtagcgcgtgaacagataggcgataccaaagggaagtgagtagctaagctataatcagtactgatagatcggagtttttaaatggttgatttctgctggaaattgtactgcttgtagtttcactcagcaagatatcttcatagcattagacaacctcacgttacaattgggagaacttttaagacagtagcagcagsatctccacacttgaagagcactgtcactgcgttccccccggccaggggaggttgagtttatatcgtgtgccgggatgagtgggagagtatcggttcaccaagaagcaatgccctccttaaaatttttcctgccctttttttcttgctcttctctttggtgttcacaagcccagcccgagcaagtggtctttcacaaagaagccagggaggcctcctccctcctggtcggtggggtagtcgggctgaagaacaaggttgtcaaggctgcagaaggaggaatattctgaggagatggccaca

SEQ ID NO: 20035 - DNA, 601 bp, Human
aatattctgaggagatggccacatgggacctcagcctcctctcaggagagcctttgtctcatgggaggagctttgtaacagggtccctcatggcagagttctccactgagtcaggtacaccttctagcaggactcgtcagtatctctgttaggggacacaggctggcagagtttcagttgcttcataaaataagtatagaaagtgaggtaagacaaaattcttactggtaggtgagaaggcatttcaagagggaacggttaaagaaagttgagaaatctgaccttaaggacttattttatrtaagggagcttgatggagaaactgggcctcctaagagagtatatttagagggaaatggcccaaggtcatgggagatgagatgacccagcctctgccaacccagagggaggtgggaagtagacagagggagaaaactccgagctggaagcctccatgatggaagaggccatctcacctcaggggaggaggcattttggagcactggtcaggcaagagtggaaggtagttaggagccgaagcgcaaaagcatccgggaaaagcaagcaggtgatttagccgattgtgggttcccgaagggaa

SEQ ID NO: 20036 - DNA, 601 bp, Human
tagggttttcaaaagcaggccctagtttaggtgacacaagccccattctccaagcctttccctccagctgctagaattctccaacaagttctcttgctccaaggaggaagattgattaagaagggcctttttcaaagtgctggctgcagcaggtatagagagcacttctgtggagtaagaagagcctggtctgtctgggattctctttgtgggatgttacccatctggcgttttgtccaggctgcattctaggccatgttgtttgctgcggttactggccttctccagtgagccatacttygttcccatcttagtcctttaaagtgttttgatcttgattctaccctgaaaatatactaatttatactcctagctacttgggctggaaaaagtaaggagaaattaggtttggggaaagaagaaagtgttttggtgctgtcctcatgctgctgtgcagagctgatgcagaatgggcactgagtcctcatctgccttcaagggctctgttcgctgctccagggtcccttgcaagagtagagcttcttcatgatcttcctagagtaccttttccacctgctggagagaaaatttgacactgttt

SEQ ID NO: 20037 - DNA, 601 bp, Human
ttcgttcccatcttagtcctttaaagtgttttgatcttgattctaccctgaaaatatactaatttatactcctagctacttgggctggaaaaagtaaggagaaattaggtttggggaaagaagaaagtgttttggtgctgtcctcatgctgctgtgcagagctgatgcagaatgggcactgagtcctcatctgccttcaagggctctgttcgctgctccagggtcccttgcaagagtagagcttcttcatgatcttcctagagtaccttttccacctgctggagagaaaatttgacactgtttttttttcagttcttcatgaccccatctgttctagatttacttttaatggcaaataatacttgaaaccaagtattactgtccttagaactttacattgggcttcttgttgggctccatcctgtccttttgacattgaggtttcccagagccctctcctggtccccttcttgcctggtaagatgcatacatgccagagcgtcagtggccgcctctgtggcatgcagacctgcactgcccttctctctcctgagcttctatgcctccctgccttcaaaatgatctccctgcctctggcctc

SEQ ID NO: 20038 - DNA, 601 bp, Human
cgctgctccagggtcccttgcaagagtagagcttcttcatgatcttcctagagtaccttttccacctgctggagagaaaatttgacactgtttttttttcagttcttcatgaccccatctgttctagatttacttttaatggcaaataatacttgaaaccaagtattactgtccttagaactttacattgggcttcttgttgggctccatcctgtccttttgacattgaggtttcccagagccctctcctggtccccttcttgcctggtaagatgcatacatgccagagcgtcagtggccrcctctgtggcatgcagacctgcactgcccttctctctcctgagcttctatgcctccctgccttcaaaatgatctccctgcctctggcctcagcccttctacctactccctttgtaagcccaaagctgaccagaccactcttgcagtgatattttggcactggccacctattgcttgagaaagcatatacaattttcttagtcgaatattcaaagtcctccatgaagcactggcccctgtatatttctgcctcatttcctgccattccctccctgctatttcttcgtccccaccccatccc

SEQ ID NO: 20039 - DNA, 601 bp, Human
tcctggaagtgcagcctctgggcatgagacgatacctgcttttctgtcgcagggtatctgggtagagcagagtggagcacatcttcccttaattccccgcttacctttggaaaggcttttgctagttagaaagctgtcaggcatagtttctaccaaaagttggcactttgggttatcacttgggtcaaatgctacccaaataatccctgccagcatgggtaagagatctggctgccatgatcaatgacaaaaggcacattatttatataggcttctaccgatctgcagatgggagtgaatscaggcagcaaaaggaatctgaacttgggtcacttttcttgtttcccatttgcaaccgttccacaaacattgcccccttaccatgtgcaacgcctgtgccatatcctggcaagagggccaggaataagagatgtgccttccaggagcccactgtccagcaggagacaaacattgatggatggtgacaatagggttcttagacatagtggtgcttcctgaccctgaggcccacattagtctggtttatgattttaaatttccagagtcagaaatgtttctgcgcaatacatattgcatgtgg

SEQ ID NO: 20040 - DNA, 601 bp, Human
tggtgacaatagggttcttagacatagtggtgcttcctgaccctgaggcccacattagtctggtttatgattttaaatttccagagtcagaaatgtttctgcgcaatacatattgcatgtggctgacttgtttggtcttttcagacaggtagagctggacacaaaaataatatagatttgactgctggttccacttgagaggttctggcctcagaattcagttgtaggagaacacatcatcataggccaagaggagagagcagggagaggggccctctgttaggagccgtgtcatttcttrtatcttatcttctggttacaaaggcaatatggtgcctttggtgggagaagggtgggggaactgagtcatgccacttgacggtgattttattaaacaagaggctactaaatagggaaacagtatgtgggaagaatgggagggctgacattttctccctcccctggactcctgtcagagccacctggtcagagcctgtgatttcagccacctgccttctgcttcctagattaagggtgtcaaccttcagtccatcaatcattccaatttgggcacagttttatgagtgtgaggggtttctgg

SEQ ID NO: 20041 - DNA, 601 bp, Human
tcagaagtgatacccacagtggcgtatctataacatgtttattttagggggatgtttcaagtcgccgtgtggcgcgatgctagaatgttccccttttgtaacactgtccttttcttcttttttcctgtggtgcttcctctcctctgtggcttctgaatgcttgccctaacagcactatttcactgatgcatggaacacttttgatgccttaattgttgttggtagcgtcgttgatattgctataactgaagtgaatgtaagtagcaaactttgtgtcctatatcatggttgttttcattamgtctgacatagaagagactagaggccctgcccttaaatctccacacactttagaaatccagacacaaatttattttgaaagactaaggataatttgtagtttcctctatctcaccccatctctatctccttcccctgaaaaagagtggggaagtctatgtagaattgccttttggaactagaatagtatttcaaaagatctaattaaagttataagggctgggagttaattgtgtgtccgtgtgaatgttgtcactcaccagtcgtgtgaccgtggaagtcatccgagtgctatgtgcct

SEQ ID NO: 20042 - DNA, 601 bp, Human
ccagcctggggccatcttggtcagtcacacttggctctgtgacttgccaacatagtcttccagaatgaatgatctggctgagaaatgattgaattcagcctgcgtttgtattctttgcaaaaacgttttgggtagtcctttgcatggtcctgcctgcgcacgcaccagcctgcttcatcctactgtccccctcccatgtccccacaccccgctcagttcctggtttggcagcactcatggacttatctccatcacatttggtcctaacctcaccaggctgctaaaatgacacactgtgacygctgggctccctcttgctccgtccctctttgatgcctgtttgttccttgaatgatgaaatgacccagcaacatactgtccctaacccatggatggctgtcactgacatttgtctcttctcattatcattagtgtctgggaggcaaaacacttgtttagaagctgtatctgccttattattacttactttgaaggagcaggtaaaaagtcattagggagctcactctcagagatccaggaatggtccctgccttttaaggtatgctgtttggaccaggtggctgacagtctcactcatctt

SEQ ID NO: 20043 - DNA, 601 bp, Human
tgtccccctcccatgtccccacaccccgctcagttcctggtttggcagcactcatggacttatctccatcacatttggtcctaacctcaccaggctgctaaaatgacacactgtgactgctgggctccctcttgctccgtccctctttgatgcctgtttgttccttgaatgatgaaatgacccagcaacatactgtccctaacccatggatggctgtcactgacatttgtctcttctcattatcattagtgtctgggaggcaaaacacttgtttagaagctgtatctgccttattattacytactttgaaggagcaggtaaaaagtcattagggagctcactctcagagatccaggaatggtccctgccttttaaggtatgctgtttggaccaggtggctgacagtctcactcatcttctttttctgaccccacagtaaggttgtgtagtcccccatttcatatgtgaaccctttcccaggagccagctcagctgggcactgggttgtggacacagacccagcaaccccaaataaagaagccctcctcccagaggtgttacctgtgagctcagaaatagtcagagggaagactggcttctc

SEQ ID NO: 20044 - DNA, 601 bp, Human
tcagctcttccaagcacagatagaaattaaaacagaaaatgaaatggactgatttcattgatttcacttgggaacctcagggtctttttgacttccacggttgcagggggctgccccagagcctatgtggtaagagcctgcttgagagccctgtgggaagaggctcgagggaacatcagcagagccccaggaatctaaggagctttctggaccctgacatgtagtccggcctcctgaggctaaggggctgtctcctgtagggttcccagctgaagaatgtgacatcttagggtgggaaggractgccaagtttgtcttgtccaagccctgaggtgacactggaattccgcttattgaaaactgattagtagccccttgtggccatgtttggaaagctacctagtgaagagtccttccccagtctggtgtcctctaggggtgtccagcatagcgtagcccacttgcgttccagctccaccagttcccttcatgttgaaacctcctccatcccttgtaggggagatggggatggagtctaatcgctctctcttcatccgtgtactgttccctcgtcaacccagaaagaacccactgttcagcc

SEQ ID NO: 20045 - DNA, 601 bp, Human
aaaattcccaacatggaggtctggcgcagtggctcatgcctgtaatcccagcactttgggaggccgagataggcagatcacctgaggtcaggagttggagaccagtctggccaacatggtgaaacctcatctctactgaaaatacaaaaaattcggcaggcatggtggcgggcgcctgttatcccagctactcaggaggctgaggcagaagaattgctgatatcctgtaggcagaggttgcagtgagccaagatcatgccactgcactccagcctgggtgacagagggagactctatctcaaaaaaaaaaaaaaaacaacaaaataaaattcccaacatgcagatacgccccagatccattaagtaagaatccctggggtgggacctgggcttcagagattttgttaaagatccccaggtggttttagtgttcaggctagtatgagagctggcctccccttttcattgggctgacatttgtcatttgggaaaagccatcctcagggttctttaaatttgtaagatattttggcaacttgcactgtccccccggggctgccagtcacatcctcccctgaagcagccccccatgcccagtggt

SEQ ID NO: 20046 - DNA, 601 bp, Human
tctccctttacaaatgctgtctcctcttcccttttgttcttttaaacagaatattcatggtttgaagttcatagtccataggttgtcagtttcaaagatatcagttgaagagatgtacacttcgaaattcagttcggttgctgactttcacaaactctaaggaagggggccgtggatggcgtatcagacttgaagcagaatagggagaggcccgcaggagggtcttaggccagactgtggccaggagtgtcttccctgaccaacaggccccttactgtcttgcaggtctgatacataagtygtgcacatttcagaaggataactgtagagccgtctctctcgtgcacactgcctggtcccctgaacacaggcaagcagaggtgcacatgcgggcacacttagcatgcacactcacaccccacactccagccagagagggaagagtggaaccttcctgtgcacagccttagtgagaatgatgtggaaaatgatgagaactttaaaaaattagttccttcatttgttaaggtcttaagttgaaaaacattgtctgtccctttaaggagctgatatttcttttgagacgaactaatagaagagg

SEQ ID NO: 20047 - DNA, 601 bp, Human
ttcaaagatatcagttgaagagatgtacacttcgaaattcagttcggttgctgactttcacaaactctaaggaagggggccgtggatggcgtatcagacttgaagcagaatagggagaggcccgcaggagggtcttaggccagactgtggccaggagtgtcttccctgaccaacaggccccttactgtcttgcaggtctgatacataagttgtgcacatttcagaaggataactgtagagccgtctctctcgtgcacactgcctggtcccctgaacacaggcaagcagaggtgcacatgcrggcacacttagcatgcacactcacaccccacactccagccagagagggaagagtggaaccttcctgtgcacagccttagtgagaatgatgtggaaaatgatgagaactttaaaaaattagttccttcatttgttaaggtcttaagttgaaaaacattgtctgtccctttaaggagctgatatttcttttgagacgaactaatagaagagggaaataaaaatagcaatcctgggtttttgataaacctgtggcagagttcccattctgagcatcccaggagaagcaaggaccccttttaaa

SEQ ID NO: 20048 - DNA, 601 bp, Human
cctgtgcacagccttagtgagaatgatgtggaaaatgatgagaactttaaaaaattagttccttcatttgttaaggtcttaagttgaaaaacattgtctgtccctttaaggagctgatatttcttttgagacgaactaatagaagagggaaataaaaatagcaatcctgggtttttgataaacctgtggcagagttcccattctgagcatcccaggagaagcaaggaccccttttaaactctgtcagaacctgttcctcttgggttcattgtcacattactgaatttcagtttttctgtgrtatgctgaaaccccttattttctgtgaactttgtagaatttccctttggtctcaggaggtagcccttgatgctagagaggcttcagaactgagctctacctttccccagatccccagggaggaggccctcgagaagtgagcacatccagacgtgcacacatgtcccttaactttgcagacacactgtacagaaagcgtccttgaagcccctaaccggaagagcctcatttctctctgtcggctcctggtgacaccactgaggggaaaagagaggctggcacatgctggctctggttccgc

SEQ ID NO: 20049 - DNA, 601 bp, Human
cggaagagcctcatttctctctgtcggctcctggtgacaccactgaggggaaaagagaggctggcacatgctggctctggttccgctgactgttgctgtttaatgtaaagatgcctcctggtgctggctggagtttgcttccaactcctctgtgttctctcagacactttctgaacactcaggtagtgctaggcaccatgctgggcacggagtggagtgaggcaaggcccctgccctccctggggtgggggttggggggcaggtaagcaccagtcattacagattctgcatcctggggccragggacaggagcacagccagaccctggaggaggtggagctgctgaaccacaggggagctggtcctccactgtttcttccaaagactcatacggacctgcactccctcttatgtgaaagctgtctgagctgtggggcaggcagcgagggtttctgtagggaagcctgcctctctcctcctcgccctgactcagtctgtccagcttttcagcagccctgcctaagaggctgttgtcagacatacaccacccaggcgtttagtctcataggaacagagtgtggtccaagggggtttgtggccc

SEQ ID NO: 20050 - DNA, 601 bp, Human
agtgatgcgattggtgaagcttctcagcaggggggaaggcatccggacattgctgtggacttttattaagtcctttcaggtaagagccatgccaaggacttctctctttgtctttgaagatcatatgtaagtcagtgattgtccccatcctagaggacccaggctccccctgtgtggccactctgtggacctaaatcaatagaaaacatggaatgctggagagacccaaatcagcatttcttgggtcaatcacatgggattacttgcctaaaggaaacagaagagaaagcaggaaggatcygtagctgagagatctgtagcatttccaagactgagagaggtgtggggcctgcagccctgcagtgcccccgggatgcctggtggtggtggtgagtgccaggtcccagcagactgcctggaagcccaacagcctctctctgacaccttttcctcataaggctacaacagtgctgtgtctgttggctagtctagatacaaatcagaaaccaccacctgggccagtgcactatcactgggttatcctgcacctggaagggtcacagagttcgggatgtttgggcatacaccatgtctcatttgt

SEQ ID NO: 20051 - DNA, 601 bp, Human
gacccaaatcagcatttcttgggtcaatcacatgggattacttgcctaaaggaaacagaagagaaagcaggaaggatccgtagctgagagatctgtagcatttccaagactgagagaggtgtggggcctgcagccctgcagtgcccccgggatgcctggtggtggtggtgagtgccaggtcccagcagactgcctggaagcccaacagcctctctctgacaccttttcctcataaggctacaacagtgctgtgtctgttggctagtctagatacaaatcagaaaccaccacctgggccagygcactatcactgggttatcctgcacctggaagggtcacagagttcgggatgtttgggcatacaccatgtctcatttgtcacctctgattctccaggctggcacagctcggttctagactttcccaagtagaaccagcttttcccgtacctgccagtaccctgccccagacattctagccttctggactgattccatttggaagagaaggtgtgggaaatatagattcttagtaaaaggtggacccatgtagggaatttgtggatatctacaagcattagaaagtgaatcctgcatcttca

SEQ ID NO: 20052 - DNA, 601 bp, Human
tctgattctccaggctggcacagctcggttctagactttcccaagtagaaccagcttttcccgtacctgccagtaccctgccccagacattctagccttctggactgattccatttggaagagaaggtgtgggaaatatagattcttagtaaaaggtggacccatgtagggaatttgtggatatctacaagcattagaaagtgaatcctgcatcttcattttttaaattatttgactatttttcattcaaaagttataaatgtttacaataacaaatgaagctgtccaaaggtatataaasagaaatttcaaacttggccctcacccacccctggggtaaccagtgttaccctcccagtaagcatttgtccctagtagatgggattttcacaggtaaaagggagaagggacagcaagcggggtggtgcaggcactcacaagggaagtcacagatcctgctggggagaatgaggttggaggaaggtaaagtgggggcctcaggcaggtgagccttgaacttgctaaggcacagaatcctcgacagttattattcatttaaagtaccaaaacttgggaacaaactgctataaaaatagataat

SEQ ID NO: 20053 - DNA, 601 bp, Human
cctcccagtaagcatttgtccctagtagatgggattttcacaggtaaaagggagaagggacagcaagcggggtggtgcaggcactcacaagggaagtcacagatcctgctggggagaatgaggttggaggaaggtaaagtgggggcctcaggcaggtgagccttgaacttgctaaggcacagaatcctcgacagttattattcatttaaagtaccaaaacttgggaacaaactgctataaaaatagataattcagaggtaatgttatctcactttttaaagaaattcttaaagattcaatytgccacagataagaaagtcatgttccagagcagcagttcataaaagcagagaaactgtgcaaacaaaaatcgtaaacatttggcaatctaggaagaaaatgcacgtaggtatgttgaggaaagcctgaaacgaactctgtgggaccctgctgagcagtccagctgcagggagggccaggctggcaggcacaggtcaacagctggcacaggtctgaaggtggctgagcacctgtgagccactgactttctgacaagctctctcggatagtagagaaagcgggtgctttaagcatgtgttcc

SEQ ID NO: 20054 - DNA, 601 bp, Human
ctcactttttaaagaaattcttaaagattcaatttgccacagataagaaagtcatgttccagagcagcagttcataaaagcagagaaactgtgcaaacaaaaatcgtaaacatttggcaatctaggaagaaaatgcacgtaggtatgttgaggaaagcctgaaacgaactctgtgggaccctgctgagcagtccagctgcagggagggccaggctggcaggcacaggtcaacagctggcacaggtctgaaggtggctgagcacctgtgagccactgactttctgacaagctctctcggatrgtagagaaagcgggtgctttaagcatgtgttcccagaattaagcctaacactctgggcaccctgtgcaggtagacgtgttggtcacatgtgatgaggtaagacagcagttgacattcagtgaaaggacgggggatctgtcagacactcgtacttgtatttggtgtttatgaagggagccacacttggcgaccccccagctcactccttttcttccctggcccagccccccaacttagcagttctttcagaaggtgtacatcttaagagaggtattttgcatcctacagccacagccagaa

SEQ ID NO: 20055 - DNA, 601 bp, Human
gaatggtttgatcaattataatttcaccccaaaaatccagtaatgaatttaaggattatgagagttacgtgtctgtgttgaaaatgtttagggttaggctacagggttaatgaccgtggaaagcacatcctgcctgtaatattgtaacactgggcgtgcatgtggatggtgtcttcaggactaaagtagttgggcagggctgggatttaaacggttcttcctcactgtcgatattctttcacggtaacacgtggaatagaaaggaagcatgtggccactcatgggtcttctcaggctgtgscgggccgtcacggggacagccggctggtgctgagccaagtgccttttctctcccaggcgctcccgtatgtggccctcctcatagccatgctgttcttcatctatgcggtcattggcatgcaggtaagctccagccatctcgccctcaggggccctttcactgggtagccccaaatctgtggcaagatgtaccctgaccaagtgaagtagaagcattgtgatttttcagccaaatgcctctgctgaagcctaggaagatgagaaagacaaagctgcttagtagagagctccaggggaggcc

SEQ ID NO: 20056 - DNA, 601 bp, Human
attataatttcaccccaaaaatccagtaatgaatttaaggattatgagagttacgtgtctgtgttgaaaatgtttagggttaggctacagggttaatgaccgtggaaagcacatcctgcctgtaatattgtaacactgggcgtgcatgtggatggtgtcttcaggactaaagtagttgggcagggctgggatttaaacggttcttcctcactgtcgatattctttcacggtaacacgtggaatagaaaggaagcatgtggccactcatgggtcttctcaggctgtggcgggccgtcacggrgacagccggctggtgctgagccaagtgccttttctctcccaggcgctcccgtatgtggccctcctcatagccatgctgttcttcatctatgcggtcattggcatgcaggtaagctccagccatctcgccctcaggggccctttcactgggtagccccaaatctgtggcaagatgtaccctgaccaagtgaagtagaagcattgtgatttttcagccaaatgcctctgctgaagcctaggaagatgagaaagacaaagctgcttagtagagagctccaggggaggcccaggctcagatgaa

SEQ ID NO: 20057 - DNA, 601 bp, Human
tttctctcccaggcgctcccgtatgtggccctcctcatagccatgctgttcttcatctatgcggtcattggcatgcaggtaagctccagccatctcgccctcaggggccctttcactgggtagccccaaatctgtggcaagatgtaccctgaccaagtgaagtagaagcattgtgatttttcagccaaatgcctctgctgaagcctaggaagatgagaaagacaaagctgcttagtagagagctccaggggaggcccaggctcagatgaatgtggagaggttagaatgcaccaggaaaaaytgcatgtcatggcagaagaattatgctttatcataacaaagtgaaattcacttgaaactaactatttccagatgccaagactgaagagagaagcaagtagcccctcgtgggtcttttcagtctgtgccgagccgtcgcgggaacagaaggctggtgctgagccaagtgccttttgtgaccattgttgtgctttagtagctcacctttaaaaagaggcatgaaactgggctcttctgtgacccaagcagaggggctgcaccctgtttcccagttcctcctgggcatgggaaagggactggg

SEQ ID NO: 20058 - DNA, 601 bp, Human
gctgcaccctgtttcccagttcctcctgggcatgggaaagggactgggcctgcctaacagaggagccctaacatcaagtgggcagtgggatgggttgtgggtggagggaggcagcctagtctaagaatggaggcagtcgaagagcccaggtggctgtagatctctgctggcaggctccttgcagattctccacgtgtgcaggtgctgtctttcaggtaaaggagggatgtaagtcagaaagaagtaaagtgattctatgatttttggggcagagaaatggtagtgcttttttcttttttcttttttttttttaaaatcctgaaagcatagaagcatttgcagatctctgggaatcttaccaggagttatgaaacaaaagtcagcatacttgagcctctgtgattcagcagcacgtggtgctatgtgccctggaaggtcttttatcacatatgttctcataaaaaaaagccatctcagaactgcaagctgcatggcacacacaaccccagattcacccagcaggcgtttgtaagcatctgcaggtttctctagaatgtcagtctgctccctaaatctcacaagtaaaactctttagtacctt

SEQ ID NO: 20059 - DNA, 601 bp, Human
tgggcggtgctcctgggcaggggggtccgctaggcgtgggtccagagggacggaggacacaggttattaaagcagtgtgcctttctcagttgattgtgatggctttttgtttttgtttgttctgtattcttaaacacagaccctagcatttcaaacacaggaattttgctggattgttaaaactgctgtggtaatcccgattgtggctggcataaggtttattcatttgggagttagtagggctacttaggccacctgaaaaattgtaggatgtacgtttatgcatggaggcatgcacttraacacgaccaggaagacagaaacttagcaaaaacgtcaaggccttttgcacagccagtggggaacatcctaagatgtatgatttcaaattttttgggattgcttttaacgtcagttaattaactttgtaaaacaagctgccctcatagtgagaaaactttctagagatcatgaagtatttctaatgactctagtgactgacaagtcatttgcaagttaggtggtttccagctctgccttcaacaaaattgaacagagacttaagttgttaagtattttggtcattaaaaataatcaatag

SEQ ID NO: 20060 - DNA, 601 bp, Human
cattgggcatgtcatctgcatttacaggttgaagtgactggggtccagagagggtgtacctcacccaaaccccctccaactctcattgctggtgttaaagggatcaggatatagaagaggagtggggagcatggatcctgctctgaaagaccaaagcctgggagaagccacataggctcatgcaaaatgccacaagatgtacatgatggtctaactaggcaaggtctgaaggacattccctgagttgggaatagtaatggatcccgtcggttgagaacctaagtcccaggccctgtgcctrgcccattgtcttttacttcctttaaccctcacaacagctttaaaaacatgcttggagccgggcacggtggctcacacctgtaatcccaacattttgggaggccaaagcaggaggatcccttgaggccagaagttcaagaccaacctgggcaacaaagcgagacctcatctctaaaaaaacataacaaaacaaaaacaatgtgcctggaatggaggtctgaccctaagatctccattgagattagtgaaaaaaaggagaagactgtttgaacagtgaagtttcacggtttaaaaaacaaaa

SEQ ID NO: 20061 - DNA, 601 bp, Human
ttgggaatagtaatggatcccgtcggttgagaacctaagtcccaggccctgtgcctggcccattgtcttttacttcctttaaccctcacaacagctttaaaaacatgcttggagccgggcacggtggctcacacctgtaatcccaacattttgggaggccaaagcaggaggatcccttgaggccagaagttcaagaccaacctgggcaacaaagcgagacctcatctctaaaaaaacataacaaaacaaaaacaatgtgcctggaatggaggtctgaccctaagatctccattgagattartgaaaaaaaggagaagactgtttgaacagtgaagtttcacggtttaaaaaacaaaacatcatctgcgtgttaacatttatatttcatgactaaacctttgatctttgtcatcccagagtcccctaagtggtaggttgtattaatcagggttctccagagaaacagagccaataggatggatatggaggtgtatatgtatgtatgtgtgtgtgtgtgtgtgtatttgtgtgtatatatgtgtatatgtatatacacacacacagaggtttatcatggggaattggctcacgtgatcatgga

SEQ ID NO: 20062 - DNA, 601 bp, Human
attaaccatcatatgcgtacccccaaatggctgttgaatggaattgagggttgactagaaaagagatgagtgataaacggaaaataaacatccaaaaggatatggtcgtggtcactcatttgcattctacaaagaaaccttcctttctgtttacagagattagttgccatgaacatgcctctcaacagtgacgggacagtcatgtttaatgcaaccctgtttgctttggttcgaacggctcttaagatcaagaccgaaggtgagcattccctgccagcaagacaagatggcaggaaaggaragagacatcacatcccatcttgccttcctcatctgggccttttcttggccaaggggaggccctggggaaggggctggcaagtagaatgaagatgtccatgctgggcttgccggctggcccctgcctcctgtttcctcatcctttatctccttcctttatgcttcactttgtcccagaatgttttgagttgactcatactactgcttactacatagcaagggaaacaggcagggtatcggagcagagacgaagccatcacaaatgaactcactccaaccatccctaactagttgtatgacc

SEQ ID NO: 20063 - DNA, 601 bp, Human
tcactcatttgcattctacaaagaaaccttcctttctgtttacagagattagttgccatgaacatgcctctcaacagtgacgggacagtcatgtttaatgcaaccctgtttgctttggttcgaacggctcttaagatcaagaccgaaggtgagcattccctgccagcaagacaagatggcaggaaaggagagagacatcacatcccatcttgccttcctcatctgggccttttcttggccaaggggaggccctggggaaggggctggcaagtagaatgaagatgtccatgctgggcttgcyggctggcccctgcctcctgtttcctcatcctttatctccttcctttatgcttcactttgtcccagaatgttttgagttgactcatactactgcttactacatagcaagggaaacaggcagggtatcggagcagagacgaagccatcacaaatgaactcactccaaccatccctaactagttgtatgacctgcagtgagggatttcactggtctgagctgtagtttctttccctatgaaaaggaaatacggggatgtctaggaggtcctgaggatgaaatgaggtgatgtctgcaaaagct

SEQ ID NO: 20064 - DNA, 601 bp, Human
tttgctttggttcgaacggctcttaagatcaagaccgaaggtgagcattccctgccagcaagacaagatggcaggaaaggagagagacatcacatcccatcttgccttcctcatctgggccttttcttggccaaggggaggccctggggaaggggctggcaagtagaatgaagatgtccatgctgggcttgccggctggcccctgcctcctgtttcctcatcctttatctccttcctttatgcttcactttgtcccagaatgttttgagttgactcatactactgcttactacatagcaarggaaacaggcagggtatcggagcagagacgaagccatcacaaatgaactcactccaaccatccctaactagttgtatgacctgcagtgagggatttcactggtctgagctgtagtttctttccctatgaaaaggaaatacggggatgtctaggaggtcctgaggatgaaatgaggtgatgtctgcaaaagctcctttgcagtgcctagcacacagtcagcacttgagaaatatagtgggatcagcatcttcccagctgagagaccaaaccagaatggccttcacagccatgctcagccct

SEQ ID NO: 20065 - DNA, 601 bp, Human
cttttccccttttgttttttgaatccagggaacctggagcaagctaatgaagaacttcgggctgtgataaagaaaatttggaagaaaaccagcatgaaattacttgaccaagttgtccctccagctggtggtcagtgcagtctatttcctaagtagtccttggccagtgctttggttttaatgctagtgtctccagaaagtccagagagtgtttgcaaaatgctttatgtatcatttagagcattaaggccaactgataaagaaagccctttggccatttggtgtgattattttgggggtratatgaagaacattccagacaaaggagaggcttcagtgaaaaaccaaaactcacatggctggagcagggattttctttttggtggaggaattaatgtttgaggacaagattgtgatctcaaagtgaaaagcctatattttttgtccaaaatgaaatattcaaaactagtttccaattacccttcagtatattgttgaaaatgtcccatgaaaaatagacagctttcaggaaattgtatttttgaaatgttcttatcaagactgaatttactaccgtaattaccaaaaatgtccttttaac

SEQ ID NO: 20066 - DNA, 601 bp, Human
ctccttggttttcattcttttctttttagctgcacacctaagagcttgcatggcttacatgaaatgctttggaaaaattgtaacaatgtgcttgagcttttcctgcagcctccattcctttcacctctcagtctttcagaatattctgaagcaattctgttttagggtggtggcatggaatcagagttatctcttgccaactgtattcccctacgttgtttctttaaatacagatgcatgcttcagaatagtgggctatgtctgtctatgtaaaccttccccctgcgagctgaggaccccrctcctccctcgctccacctcacatctctcttggaacgccaccttcatcacaaccagccagactcccacattgatgcccatcctcgtgaaatgccctcggagggtgtcatttgcattagtgtgaaacttcatttcttttcattttaccaaaagaaaagtccagaatttagctcgccatcgaagctcccttcctttgaaaagctgatcaacttttagctttatcagacttctagtagagtagaaatcttcttctttcttggtccaataactggacctcgccttttctctctatttcttaaaa

SEQ ID NO: 20067 - DNA, 601 bp, Human
catggaatcagagttatctcttgccaactgtattcccctacgttgtttctttaaatacagatgcatgcttcagaatagtgggctatgtctgtctatgtaaaccttccccctgcgagctgaggaccccgctcctccctcgctccacctcacatctctcttggaacgccaccttcatcacaaccagccagactcccacattgatgcccatcctcgtgaaatgccctcggagggtgtcatttgcattagtgtgaaacttcatttcttttcattttaccaaaagaaaagtccagaatttagctckccatcgaagctcccttcctttgaaaagctgatcaacttttagctttatcagacttctagtagagtagaaatcttcttctttcttggtccaataactggacctcgccttttctctctatttcttaaaatggattggagtttaggatgacaggttttaatctattccacaacggcagcgagaggcagtgtgaggcacaagaagagagaagtggggccttaggagggatgcaaggctttgcaagctccctgcctgtgttgagtgatgtgcccagtgcagggcttatccgggctgaatctcatg

SEQ ID NO: 20068 - DNA, 601 bp, Human
tttgcaagctccctgcctgtgttgagtgatgtgcccagtgcagggcttatccgggctgaatctcatgtgagtgctgtggccacgaaggaagttccgaaggcagtggccatcaggctttggtgcatagactctggaagagttgccggacagggcttggttctccacattcatcatttgtctgtctttcctcttttatccttcagtaggcccatgtccccaacctttcctgcatcacagcatacttagaaaaggatatttgcatacccctctgggaacagatgtggagttcttgaggctgagkgcctcagcatcccctacaccatcacctggtcaagaagcaggagactgagtaaggccagcctccactccaagtggctgggactggcagatgtggggtgctcaggaagccccttttagccctggtgatagaactgagtcagatgcttgtcttgggtggcttcgctagtgtgctgtgaggtgtggcctggctcctcatgagcctgatgatgagatcaggaatgagctgtggatctgtggatacatgtcaggcttgcttcactcccagtggcccgggggtctccgctgccccctcaccatcagt

SEQ ID NO: 20069 - DNA, 601 bp, Human
tccacattcatcatttgtctgtctttcctcttttatccttcagtaggcccatgtccccaacctttcctgcatcacagcatacttagaaaaggatatttgcatacccctctgggaacagatgtggagttcttgaggctgagggcctcagcatcccctacaccatcacctggtcaagaagcaggagactgagtaaggccagcctccactccaagtggctgggactggcagatgtggggtgctcaggaagccccttttagccctggtgatagaactgagtcagatgcttgtcttgggtggcttygctagtgtgctgtgaggtgtggcctggctcctcatgagcctgatgatgagatcaggaatgagctgtggatctgtggatacatgtcaggcttgcttcactcccagtggcccgggggtctccgctgccccctcaccatcagtgctgagccgcctcatctctgcctctcagctcaggttctcacctctgctcttcagccttcccgtgccatcttgtgggtcctttcccttcatttcagaagctctctctcctccccaggactctcctccatccatgacctggatcctttgctcctttgccctg

SEQ ID NO: 20070 - DNA, 601 bp, Human
agctttgacttttcttgttcttaggaactcttccttgggcccagtctcctaattagcacagtgtctcaatggagaagacgaagtgacccttgagttctctcctgcagagctctgggtgggtctgcctctactctggaggctgaagggagatcagagttaggcctgtatttgctagaagcatcagggtggaatggggtgtgggtcttcttcaggtagagccagggcgttttctgggccccacagagaagacacagagccctggaatatagaggaaggctgtggcatggcaggccaccagagrctctccctggggtccctggagtcattagccagacaacagcgtgtccactttttgtgtgcagcctgggaaagggatacacttgcatggtgtgagaggcagctctgaagaagcccagcagccagtgtggctggagacggccatctctggagaggtggtatgaaggataggatcccagactcaaggagcacactgtcctgtggtaaggtcccggcttgactgagctgggcaagtcatttagccctctccatctgttggagggggtggtggtgagcagatccaccatgtcagagttgtgaagag

SEQ ID NO: 20071 - DNA, 601 bp, Human
tccccactttacagatgagaatacaagctcagagaggttgagccccttgcccccacatcagcatgtagatcttgcaagggtggcctggcctaaaagccagctgctctgtagcctttggaccagcaaccattcctccttccagcctctgcaagttgtggtcagtggcccccagggccccacatggccccacacacatgggacggagtactaaagtggtcacaagctttacccccaagagacacagcacactgaagatttggtagcaagcagccgtgggagagccatggggcacatttacacrtccaaagtggtttaccatgagacagccagagcctctattctgcctcatgcatcacctttaaagtcatcagcagagttctgattccccaaccatacacgttggaggttgtttctgaacaaagcaaaaataagcccagctcaactatgaggttggttggagctgtcactacagtgcagaaaatgagctgttcagaattacaaaccaagaaatggtatatggagcttattggtggagaatagggggcggggagctcatgaaaatctgaatttgcagtcacttttctaaaccttcctctccttc

SEQ ID NO: 20072 - DNA, 601 bp, Human
atgggctggctcctgcaggcctcgcgatggcactaggagcatccattgtgcatttacaggggcctcagcctgtgtggctggcagctccggctgctctctggggtcaagcttcttgtgggtgctttgcagcatgacccaaacctcctgaaggtcaggaatgggatcttgtcattttccctgtagccctcaagatatgtgtagtatattccactccacatgtattgacctgagttgaattgtgggcggaatgcccattttgttgggggccaagggaggatgggtcttcctgtgtcatgttatsaagtgaagtcgggagccatgtgggcccaagttgggtgcaagaaagtggagaagtcagaggaagtgccatccttcctttggagagaggattgacatcaccacgtccttctctgaggactgaggccaggatgagccgggtttcagggagacttaccacattcctggggcagggcagcctttggaaacatggtggacatgttctgtgacagtttcccctgtggcactgtatccagaactcactcgaccttcctgatttgatacagcaggaggtcagtggccaggaagctcctttgttccaggt

SEQ ID NO: 20073 - DNA, 601 bp, Human
cttcactctggggccaggaaacccatcccacctagaggggctggggctggggctggctgcttccacctgctttccctctgcagcggtgggtggcaggagctggcggatctgggtcatcctgagcaaggaactccagctgggggaagaggtgcagccctggccccttccagcccttggctgaacagtttcattttggacatgtgggcattttgctgatggttaaggactatccatttctggaatttctgaggaatgaagcatatttttgaacaggactctaatcagtaaccaaaaatagccrtgacacatcggcttctgagtctgccaactgcatatactataaagagcaccactgggaggtgcccagggccctctgcctcactccaactgtcacagccccactggggagtgtgaccagacccatttccatggttaatatttaattcctcagccctgaacacatgcagctaaatgaagtcactcctttcccataaatactagatgaagcagatgcaggtgaggccgggtgatggccctcgcccttgtgagttccactgccttcctcgggcctcggcctttgtctactgcctacttggccaag

SEQ ID NO: 20074 - DNA, 601 bp, Human
tcctttcccataaatactagatgaagcagatgcaggtgaggccgggtgatggccctcgcccttgtgagttccactgccttcctcgggcctcggcctttgtctactgcctacttggccaagcaagcaagcacatgaatcccaccagccacagtgccagagaggagctgagtgggcaggagtggctgtgctcttgattcataaggtggttttgctttgctgccccgcagctcagaccttggacaggaagaacatttccctcctccacctgtgttctcagctgcagggggattccctcctcctycagagagtgttgtgcagagcacatgagatggtggggatccctggagcattttagaaatggaaaagcaccacatacaggagagggaccgctgctctcctttcccagcccccagcccggccattcgatctggaaacctatgctccacagcacagttggcccctgggtggtgcgtggagggaaggctttctgatgaggcagccgtgtgtgtcccatgtaggcaactgaaccaggaggccccacagtgcgcactgggcacgagagaccaggactggctgtctcgttcctctctgctgggcagtg

SEQ ID NO: 20075 - DNA, 601 bp, Human
ccaccagccacagtgccagagaggagctgagtgggcaggagtggctgtgctcttgattcataaggtggttttgctttgctgccccgcagctcagaccttggacaggaagaacatttccctcctccacctgtgttctcagctgcagggggattccctcctcctccagagagtgttgtgcagagcacatgagatggtggggatccctggagcattttagaaatggaaaagcaccacatacaggagagggaccgctgctctcctttcccagcccccagcccggccattcgatctggaaacctatgctccacagcacagttggcccctgggtggtgcgtggagggaaggctttctgatgaggcagccgtgtgtgtcccatgtaggcaactgaaccaggaggccccacagtgcgcactgggcacgagagaccaggactggctgtctcgttcctctctgctgggcagtgcctagccaaggactcagcccggtctcttgtgtgcagccccagtgtgcctgggagtcctcccctggctaggccctgggctttccaatagcggaatgaggggcatgtggagttttgccagggctgagaaaggaggccctg

SEQ ID NO: 20076 - DNA, 601 bp, Human
agcacatgagatggtggggatccctggagcattttagaaatggaaaagcaccacatacaggagagggaccgctgctctcctttcccagcccccagcccggccattcgatctggaaacctatgctccacagcacagttggcccctgggtggtgcgtggagggaaggctttctgatgaggcagccgtgtgtgtcccatgtaggcaactgaaccaggaggccccacagtgcgcactgggcacgagagaccaggactggctgtctcgttcctctctgctgggcagtgcctagccaaggactcagyccggtctcttgtgtgcagccccagtgtgcctgggagtcctcccctggctaggccctgggctttccaatagcggaatgaggggcatgtggagttttgccagggctgagaaaggaggccctgtgatccgagaaaagcagcggtcaagataggagccatagaaatgccttgtaaacgataggtgtgctctcgacagaggcccctgcaaggggtaggaggtttctgggaggaggctgctggctgtgtcttagggccccagaattcagactgatctcccgggcctggtgccctgtgaagctggga

SEQ ID NO: 20077 - DNA, 601 bp, Human
ggactggctgtctcgttcctctctgctgggcagtgcctagccaaggactcagcccggtctcttgtgtgcagccccagtgtgcctgggagtcctcccctggctaggccctgggctttccaatagcggaatgaggggcatgtggagttttgccagggctgagaaaggaggccctgtgatccgagaaaagcagcggtcaagataggagccatagaaatgccttgtaaacgataggtgtgctctcgacagaggcccctgcaaggggtaggaggtttctgggaggaggctgctggctgtgtcttarggccccagaattcagactgatctcccgggcctggtgccctgtgaagctgggagctgtggattgtcttgttaacctctgtgtgagcctctgttggaagagctgttagcaggacaagcattttcttaaaattagaggtgtcctttgtttgtattcagtgctagagaagctgaatctttcccaacaaaaataatttgcttattacctggtcaagctgatcagtgcaggtaaagtccctccctttaaaacaggtgtaaacacaggagccccagcaagatatgtcagctgctggggacacttagg

SEQ ID NO: 20078 - DNA, 601 bp, Human
ggaagagctgttagcaggacaagcattttcttaaaattagaggtgtcctttgtttgtattcagtgctagagaagctgaatctttcccaacaaaaataatttgcttattacctggtcaagctgatcagtgcaggtaaagtccctccctttaaaacaggtgtaaacacaggagccccagcaagatatgtcagctgctggggacacttagggtatctggaaggtgacagtgggaagtgtcgtggggttctggcaggacttgtgttcttgcactgaagtgctgtgcgctccccacagtatgcagsgccagggcttctgactcggatcagttgccctatgggctgccttcactcctcctcctgagaacaggcgaacgtttaaaagtagtaagttctctttgggaggctgaggcgggtggatcacgaggtcaggagatcgagaccatcctggctaacacggtgaaaccctgtctctactgaaaatacaaaatagtagccgggcgtggtggcgggcgcctgtagtcccagctactcgggaggctgaggcaggagaatggcgtgaacccgggaggtggagcttgcagtgagctgagattgcgccactgc

SEQ ID NO: 20079 - DNA, 601 bp, Human
agatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcrgtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagttt

SEQ ID NO: 20080 - DNA, 601 bp, Human
gggggcaagagggatcaagcttctaccctgtggcccccagctgccactgcccatgccccatgcccatggtacccatcaggctacgtcaatctaaatgtccctcggccccgcaccacatgagcctaggacacagccccacagatctctagggggtaagctggctcagtctcagagaccgggtggaggaaataccgcctgaccattcaggaagccacacgttcaggttaagggcgtcaggtatttccagtcctcttgtaagaagagctgcttctggccctccccagcttgtacccacacacayttggcctcagcccagttcagaatggggagagtgagtgagggctcagacttccaagtccccgcccttggtctccatcctagactttctttggccaaagaacctggaggggccatgaccagactgggggctttggctgctgggatcagggtacaagaaagaggatggaaaatgggagaggagggcccctggggacctttccaagatcctcccctccccgcccttctctcaaaccagacatataccccaactcaagttgtgatgctccctacaaacctaggaggatcacccagtgaatcccag

SEQ ID NO: 20081 - DNA, 601 bp, Human
cacctccctcctctccgcccagcctccccattacctggcggacaaagctgttggatgtggtatccgaggacgtgctcccatctgaccgtttgaatcgccctttcctcttgctgtatttgccctgaagaggccaggaaaggaacaagagtagaatcagaagggccctttcccaaccctcatcttgccagccccagagctacagccaagcttgggaacagcactcccagccccacctccacccccctgcacattcctcctgaggtggtacgacccaaggggagggagggtctcccatcctcayggagagggcccagagcacagccaggagtggggaccagtgcaagagagccccagaagacccacacggaaaccaccaaaccaagccagagaggctgggaaggggggaggcgcggagaagctggaggctcattaggcagcagagctaattaagatgctgggcaggctgcagaggcctccgaggaagggagaggcagccggcagtgctgggtgttgggtggggagagcgggaaagtcacccccactccccctccgcaggagcagagcagggctgtttgtgttggtggcccccagagaggaggaa

SEQ ID NO: 20082 - DNA, 601 bp, Human
ttacaggcgtgagccaccgcacccagccagccctgtcggtttttaaaaaataaaaggggcagctgggcacagtggcttacgcctgtaatcctagcactttgggaggccgaggcaggcagatcaccaggtcaggagttctgagaccagcctggccaacatggtgaaaccccatctctactaaaaatacaaaaaaaaattagccaggcatggtggcgggcgcctataatcccagctacttgggaggctgaggcaaggagaatcgcttgaacctggaaggcggaggctgcagtgagccgagatygcaccactgtaccccagcctgggcggcagtgcaagactccatctcaaaaataaataaataaataaaaggggctgggcacagtggcccatgcctgtaatcctagcactttgggaggccgaggcaggaggatcacttgcacccaggagttcaagaccagcctgggcaacatagcaagatcccatctctacaaaaaataaaaaatcagccaggtgtggtggtatgcctctatagttccaggtactcgggaggctgagatgggaggtcaaggctccagtgagctgtgatcacgccgctacactc

SEQ ID NO: 20083 - DNA, 601 bp, Human
atttttagtagagatggggtttcaccatgttggtcaggctggtctcaaatgcccgacctcaggtgatccacccacctcagcctcccaaagtgccgggattacaggcgtgagccaccgcacccagccagccctgtcggtttttaaaaaataaaaggggcagctgggcacagtggcttacgcctgtaatcctagcactttgggaggccgaggcaggcagatcaccaggtcaggagttctgagaccagcctggccaacatggtgaaaccccatctctactaaaaatacaaaaaaaaattagccrggcatggtggcgggcgcctataatcccagctacttgggaggctgaggcaaggagaatcgcttgaacctggaaggcggaggctgcagtgagccgagatcgcaccactgtaccccagcctgggcggcagtgcaagactccatctcaaaaataaataaataaataaaaggggctgggcacagtggcccatgcctgtaatcctagcactttgggaggccgaggcaggaggatcacttgcacccaggagttcaagaccagcctgggcaacatagcaagatcccatctctacaaaaaataaaaaat

SEQ ID NO: 20084 - DNA, 601 bp, Human
agtgcaatggcgcaatcttggctcactgcaacctctgcctccttggttcaagcaattctcctgcctcagcctcccaagtagctgggattacaggcatgcgccatcacacctggctagttttgtatttttagtagagatggggtttcaccatgttggtcaggctggtctcaaatgcccgacctcaggtgatccacccacctcagcctcccaaagtgccgggattacaggcgtgagccaccgcacccagccagccctgtcggtttttaaaaaataaaaggggcagctgggcacagtggcttaygcctgtaatcctagcactttgggaggccgaggcaggcagatcaccaggtcaggagttctgagaccagcctggccaacatggtgaaaccccatctctactaaaaatacaaaaaaaaattagccaggcatggtggcgggcgcctataatcccagctacttgggaggctgaggcaaggagaatcgcttgaacctggaaggcggaggctgcagtgagccgagatcgcaccactgtaccccagcctgggcggcagtgcaagactccatctcaaaaataaataaataaataaaaggggctgggcac

SEQ ID NO: 20085 - DNA, 601 bp, Human
aagactctgtctaaaaaaaaaaaagtctgggcgtggtggctcacgcctgtaatcccagcattttgggaggcagaggcaggtggattcatgaggtcaggagttcaagaccagcctagccaagatggtgaaaccctgtcgctactaaaaatacaaaaattagctgggcgcagtggcagatgcctgtaatcccagttacttggaaggctgaggcaggagaattacttcaaccagggcagcagagttgcagtgagccgagatcatgccactatactccagcatggatgacagagtgagactccgycaaaaaaaaaaaatgtatactgaattggcttgtgtggttttctccatgtatattaacttttacaataaaaaacaagaaagcaaaatgtggaattcagccctctcagggtagaggcggggcactcaggaatgaaaagggttgggggtggggaagcccacaatgatacccagaaaaaataataataatagcaggccgggcacggtggctcactgctgtaatcccagcactttgggagggcaaggcaggtggatcacttgaggtcaaaagttcgagaccagccatgactaacatggtgaaact

SEQ ID NO: 20086 - DNA, 601 bp, Human
aaaatgtatactgacactttgggaggccaaggcaggtggatcgtttgagaccagcctggccaacatggtgaaactctgcctctactaaaaatacaaaaaaattagctgggcatggtggcacacacctgtaatcccagctactcagggggctgaggcatgagaatcatttgaattcaggaggcagaagttgcagtgagccaagatggcaccactgcactccagcctggatgacggagcaagactctgtctaaaaaaaaaaaagtctgggcgtggtggctcacgcctgtaatcccagcatttkgggaggcagaggcaggtggattcatgaggtcaggagttcaagaccagcctagccaagatggtgaaaccctgtcgctactaaaaatacaaaaattagctgggcgcagtggcagatgcctgtaatcccagttacttggaaggctgaggcaggagaattacttcaaccagggcagcagagttgcagtgagccgagatcatgccactatactccagcatggatgacagagtgagactccgccaaaaaaaaaaaatgtatactgaattggcttgtgtggttttctccatgtatattaacttttac

SEQ ID NO: 20087 - DNA, 601 bp, Human
ctgggaggatgccttgggatcgggcccttctaggggatctctctggggtctgaagatctttctaaggcccctctgcatccactcccctctaggaagtcctacctcgtagcccttgagcgacggtcccaccaggatgatgggcctcatggaaggcaccacgtcataggggggcacatgctctgtctggggggggaagcagggaggggaaaccccagagtggagatgacattagatcctctcccccagactccaggctcccccatgcagccttcccccaccctggtcccagagcccagatgtrgggatcagggtgggggtggggagggatggccagggagaaccaggaagggtgggggaaatgggggacagatgtgggaatgggtgttagaaggtccccctagctcatcccagggagtggggaggaggacacagaaagctgtgatactcaccgacttctgcttctgtttggctgggtccagagattgccaagagagggaagggggaggagagagggaaggggacccaggcaggggcagagggcaaggcaggagccaggacaagagagggagggagagccgggcagacgaggagagataacagg

SEQ ID NO: 20088 - DNA, 601 bp, Human
gggttgtctctgaaagtctgtagccctcctgggaggatgccttgggatcgggcccttctaggggatctctctggggtctgaagatctttctaaggcccctctgcatccactcccctctaggaagtcctacctcgtagcccttgagcgacggtcccaccaggatgatgggcctcatggaaggcaccacgtcataggggggcacatgctctgtctggggggggaagcagggaggggaaaccccagagtggagatgacattagatcctctcccccagactccaggctcccccatgcagccttcycccaccctggtcccagagcccagatgtagggatcagggtgggggtggggagggatggccagggagaaccaggaagggtgggggaaatgggggacagatgtgggaatgggtgttagaaggtccccctagctcatcccagggagtggggaggaggacacagaaagctgtgatactcaccgacttctgcttctgtttggctgggtccagagattgccaagagagggaagggggaggagagagggaaggggacccaggcaggggcagagggcaaggcaggagccaggacaagagagggagggag

SEQ ID NO: 20089 - DNA, 601 bp, Human
cactacctcccacacctcccacccctcccacatccggcccagaaagggggagtgaagacagcaggagtaggctcacccaggctggagcgtgtgttggagcgctcaatgatgatgtgtttgctggggttgttgagaactgagcgcttagccagggaaatatctgccgtcacacgagtgatggagatcctggggaatggggcaagaggggagtcaggggtcagggtgggctggaatgccctgcccactccccagttccaggcccgccttctgttcctcagtccgagtcccaggattgtgattygaggcatcctgcccatccccagcagcagagagcaacggcaggtgcgaggagcagctcccaggatcttacctgccatcaaaccgatgcttcaagaagtcaaataaagctttctgcatcatgtctgtaacctgggggtgggggtttgtggggagggagggaggagaaggcaggcatttaaagccgctcagactctgagtcgctgggtatttgtaccctcacgttccactttcttctggacaggcctttacggcgggcgggggtctgagtctgaggggcctccactggggtctctggttccaa

SEQ ID NO: 20090 - DNA, 601 bp, Human
cctgacttaaaaaaaagaagaagaagaagaagaagaagaagaaaggaaagacctcccaactgccaagtagctgggtggcactggaacaaaaagcacagaattctttcagtccaagggtgggaagtcaatcagagtggagacaggggactggtctgcatgaccctaataatagtaaataatagctaacatgttgtatcagaccatttgctaagtgctatacattcatatgaggttgaaacacttgacaatacgatggagctttacagagaaggaaactaagactcaggcagattaattcacrtaattagtaagcagtggagctgggatttaaacccaagcagccctttcaaaccacgctgtcctggccagggtcaggctcctgcacccaccttgggagaggtgatcttgatgtaaacaatgatgggggccagcgaggtcttggacagctgggctgggtgattgatggtgtcagcatccagagcgaccaactgaagggtccgggccagctcgaagattcgctcgatttcactctgcacctcagctgggggcatggagtcatgtggatgggggaatgtcaggtggcctcccaggaacagcaggt

SEQ ID NO: 20091 - DNA, 601 bp, Human
ctagttcagtgtttttgcatccattatctcatttggtcctttcaactcccctcaggaagtacttaaatcccatcatcccctttatctcattagaaacagaggactcagaaaggttaagtaggctgggcgcggtggctcacgcctgtaatcccagcacttagggaggctgaggcaggagaaatcacttgaggtcaggagtttgagaccagcctggccaacatggtgaaaacctgtttctactaaaaatacaaaaattagccaggtgtggccgggcacagtggctcacacctgtaatcctagmactttgggaggccgaggccggtggatcacgaggtcaggagttcaagaccaacctgaccaacatggtaaaatcccgtctctactaaaaatataaaaattagccaggtgtggtggcatgcacctgtagtcccagctactcaggaggatgaggcagaggaatcactggaacccaggaggcggaggttgcagtgagcaagatcgcaccactacactccagcctgggtgacagagtgagactccttctcaaaaagaaaaaaaaaaaaagccaggtgtggtgtgtgcccgtaatcctaaccccagc

SEQ ID NO: 20092 - DNA, 601 bp, Human
catttatttaatcttcacaaacccagtatgcctatgctgcagatgaggaaaccaaggcatagagatgtttggccgcttgccaaaggaacacagagccagtaagtgacagccctggagtagaaggtccaggctgcctggttccagagtccctcctcttaacctcagtgggggaaatggaagcattggttactttctagttcagtgtttttgcatccattatctcatttggtcctttcaactcccctcaggaagtacttaaatcccatcatcccctttatctcattagaaacagaggactcasaaaggttaagtaggctgggcgcggtggctcacgcctgtaatcccagcacttagggaggctgaggcaggagaaatcacttgaggtcaggagtttgagaccagcctggccaacatggtgaaaacctgtttctactaaaaatacaaaaattagccaggtgtggccgggcacagtggctcacacctgtaatcctagcactttgggaggccgaggccggtggatcacgaggtcaggagttcaagaccaacctgaccaacatggtaaaatcccgtctctactaaaaatataaaaattagccaggtg

SEQ ID NO: 20093 - DNA, 601 bp, Human
gaatattcaaaaaataagatttttttgatactattcttgccacacttctgtaaatctgaaattatttgaaaatgaaaatcttcttacaaaatggaacagatatagttctgggataccaagcgtttatttttatttatttatttatttatttttgagacagagtcttgctctgtcacccaggctggagtgcagtgatgcaatctcggctcactgcaacctccgcctcctgggttcaagcaattcttgtgcctcagcctcctgagtagctggaattacaggtgcccaccaccatgcgcagctrattttttgaattttagtagaggcagggtttcatcatgttgcccaggctggtcttgaactctttagctcaggcaatccgccggcctcgggctcccaaggtgctgagattacaggtgtgagccaccgtgcctggcccaataccaagcatttttcatggttaacccatttatttaatcttcacaaacccagtatgcctatgctgcagatgaggaaaccaaggcatagagatgtttggccgcttgccaaaggaacacagagccagtaagtgacagccctggagtagaaggtccaggctgcctgg

SEQ ID NO: 20094 - DNA, 601 bp, Human
catggtgaaaccctgtctttattaaaaaataataataatacaaaaattagcttggcgtggtagcacatgcctgtagtcccagctactcacgaggctgaggcatgaaaatcacttgaacttgggaggcagaggttgaggtgagctgacatcatgccactgcactccagcctgggcgacagaacaagactctgtctaaaaaacaacaggcaacaagtgatcctgggttggttcctggattgggggaaatgttgctatgaagggcattctataccggcacagtggctcacgcctgtaatccctrcactttgggaggcaggggtggtggtggatcacctgaggtcaggagttcgagaccagccaggccaacatggcaaaaccccgtctctactgaaaatacaaaaattaactgggtatggtggcaggcgcctgtaatcccagatactcaggaggctgaggcagaactgcttgaactagggaggcagaggctgcagtcagccaagatcgcatcactgcactccagcctgggcagccagagtgagaccctagctcaaaaaaaaaaaaaaccaaatatggactatattttagaaataattcttgaatt

SEQ ID NO: 20095 - DNA, 601 bp, Human
gtgatccacttgcctcagcctctcaaagtgctgggattataggcgtgagtcactgagcccagccacaccctctatattaacaacggcaacaacaacagtcttcctttatggggcacttgctacataccagcattgttctgtgcttttcacatgatcaattgagtcctgacaacaatcctgttagatagctgctattatcattctcatctcaacaacaagaaccataattataataatgcaaaaccggaaactaatcatgaggaacaatcacacaaacgcacactgagggacagacagtctrcagaatagctgtcctgtactctgcctaaatgtcagtctctggaaaattcaagaaaggctgaggaagccttccagattaaagaaaactatactggctgggtgcggtgggtcacacctgtaatcccagcactttgggaggccaaggcgggcagatcttgaagtcaggagatcgagaccatcctggctaacatggtgaaaccccatctctactaaaaatacaaaacattagccggatgtggtggtaggcgcctgtagtctcagctactcaggaggctggggcagaagaatggaggcagagctt

SEQ ID NO: 20096 - DNA, 601 bp, Human
aaggaagaggagctagagggactcaggcaatgcacccagtcagagaggcgggtcctggttggatcagcatggagagccagtgtcaagacccttgaatgctccataactctcagccctgggcacctctgcagaaaggacctcagcagccctgtgtctaccctatgcaaagctcaggctctctcctggtgttatgccagccttccttaggggctatatgaagggcagtgattctccttctcaacttctctaacattgtttgtaggcccgcccactctcctttttttttgtttttttttttttwaattttagagactggttctcgctctgtcacccaggctgaagtgcagtggtgtgaacatagttcacctctaccctgggctcaagcgagcccccagcctagcctcctcagtaactagggctacaggcacgtgccatcataccccactaattttttttaatttttttgtagaaacagggtcttattatgttgcccaggctggtctgaaactcctggcctcaagtgatccacttgcctcagcctctcaaagtgctgggattataggcgtgagtcactgagcccagccacaccctctatattaac

SEQ ID NO: 20097 - DNA, 601 bp, Human
gtacctggtttggggagagagaaaaggaagaggagctagagggactcaggcaatgcacccagtcagagaggcgggtcctggttggatcagcatggagagccagtgtcaagacccttgaatgctccataactctcagccctgggcacctctgcagaaaggacctcagcagccctgtgtctaccctatgcaaagctcaggctctctcctggtgttatgccagccttccttaggggctatatgaagggcagtgattctccttctcaacttctctaacattgtttgtaggcccgcccactctcctttttttttgttttttttttttttaattttagagactggttctcgctctgtcacccaggctgaagtgcagtggtgtgaacatagttcacctctaccctgggctcaagcgagcccccagcctagcctcctcagtaactagggctacaggcacgtgccatcataccccactaattttttttaatttttttgtagaaacagggtcttattatgttgcccaggctggtctgaaactcctggcctcaagtgatccacttgcctcagcctctcaaagtgctgggattataggcgtgagtcactgagc

SEQ ID NO: 20098 - DNA, 601 bp, Human
gaggggccttgtggagtcagggctccagggagggagagtccaggtttaacgtaggtttccctggctctgaaggcccctgctctgttgggtctaaaaagggtgtggagtccagcgaatcagtttatcagtcttcctcgcatgtccttcctagtcccttgtcttaaaagcgctcccatcaggcctcatatccagcgggcagcagatgcgctcctatggcaccaggcccaggaagacagcaccagaagccccagacccatcaaaaaccacagacaccagaagctgccgctcatcttattttttwacaaaataaagctcttcccttcctcctccatgttccctgcactccagttccgaccccagagcaggagggaagacgggcagggcgcccactacatggcatgttcctgctcctggggcaccacactgccccgctgtgaggactccagcccgccccagaagccgaggtttctcctgagcgaggtgagcacctgtacctggaggttggagacaggggcagggctggcagccagggctgcggtagccatggtgcggttcagcagcggattgggtggcgtgctgctgggcgggtgtgtggccttcc

SEQ ID NO: 20099 - DNA, 601 bp, Human
ctaccatccagagccttctctccttgccaccctgccccgccgcactggggtatttctggctcccagaggggcagaaaaccctgaaacccgagcagaagctgtcctcggtgccacgcctggagatgggcattaatagcagcctccctcaggcccctgacgcgtctgggcagctgctcagcacgtcccgcgtccctcggccccaaggccagcccactctggctcagccaggcacactaaacttagtggccactcccagctcgacaaccactgccaccccccaagctcggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccgggggtaacgtacccaccctc

SEQ ID NO: 20100 - DNA, 601 bp, Human
cactaagctaattgaacagggatctcagtgatcacacatgacaaaaaacacatactttaccatcttagttcaaaaaagtcactaaacaaacaacgggaacaaatcttcaagaagggggaacaactgatttccagagttgccacattatattgtttaaaaaatactggctgggtgtggtggctcactcctgtattcccagcacttttggaggccaagtgagaggactgcttgaggccaggggtttgagatcaacctgggcaatatagcaagaccctgtccctaccaaaaaaaaaaaaaaaaacaaaaaaaaaaccccacaaaatatccaggagtggtggcatgtgcctgtaattctagctactcccaaggcttaggtgagggaattgtttgatcccaggagttagagactacagtgaactatgatcatgccactgcactccagcctgggtgacagagcaagactctgtctctaaataaataaatacatacataaataatacaagacacacaaagaactaaaatgataaggggcatacatggggcagggagaagtcaatagatctgtaaggaagccagatattggacttactagacaaaaact

SEQ ID NO: 20101 - DNA, 601 bp, Human
ttgaacagggatctcagtgatcacacatgacaaaaaacacatactttaccatcttagttcaaaaaagtcactaaacaaacaacgggaacaaatcttcaagaagggggaacaactgatttccagagttgccacattatattgtttaaaaaatactggctgggtgtggtggctcactcctgtattcccagcacttttggaggccaagtgagaggactgcttgaggccaggggtttgagatcaacctgggcaatatagcaagaccctgtccctaccaaaaaaaaaaaaaaaaacaaaaaaaaaaccccacaaaatatccaggagtggtggcatgtgcctgtaattctagctactcccaaggcttaggtgagggaattgtttgatcccaggagttagagactacagtgaactatgatcatgccactgcactccagcctgggtgacagagcaagactctgtctctaaataaataaatacatacataaataatacaagacacacaaagaactaaaatgataaggggcatacatggggcagggagaagtcaatagatctgtaaggaagccagatattggacttactagacaaaaactttaaatcagct

SEQ ID NO: 20102 - DNA, 601 bp, Human
tttgacaaggtaacacaggtgatgagcagagcagccaggactcacactcagaccctaacattcaccgttttagtcaatacattaactactttacaacaacccagtgagtgggttcttattctacaggtggttcttattctacaggtgggtctcattctacaggtggttctcattctacaggtggttcctattctacaggtggttctcattctacaggtgggtctcattctacaggtaggaacagggaggctgagcatagccttccccaggctaaccagctaacaaatagaggttctccacycaagtcttgaatccagagcctcctttccctccagttccttctcacaccctctattgtgcatgaaaacacagctcctaaaagctctgacccaagtgaacacaaggagtccagcttttgacatggcatagtttgagggcagctggaccagaagctggtgcagtggagcagacttctcaaggtcccacttagtcttaaaatgttggaggctcagtgggcaagagttgtctaatttttccaaattagacagtcttagactccaaacagtcttagaaggacttccatgtacaagatcaacatcca

SEQ ID NO: 20103 - DNA, 601 bp, Human
ctcttgagtaacatgggcagatgcctggcctgatttgtcctaaatgaggcctgggtctgacgtgcccccacccctacaggggccattagagaccatgaaagggtttatggtctccaatgggcagccacatagcccaggagtggatgtttctctcaggttcagggcaggagacaccggtctttttcacatgctaagcccaagaaaggggagaggtcagcccatcagtcctcaggcccccagttcagccatgtaagagtgaagctgaggcttcctgttaccctgagaaggaatcctacccacyggaggccccctccctccatttgaggacacttaatggagaagagggaggaggaacactgtacctggaccaccaaaagaaaagcatccccccagaagctcacaacctggctcctgcagacacgtagcctacccctgtgtctgagttaagatcatttctatccaagcagccagcagccaggcggagcctggcgtttatctggtggggatttggtgagccaaatgctacctgtgtgagagtcacctcagcaacccaccaggtgcaaacagctgtgcccccagcaaggcactccatggccctcat

SEQ ID NO: 20104 - DNA, 601 bp, Human
cgcggttcaaaaggaaagtgatttaaatatagaagcacacagagaaggctgtttatgccaggaatgggtactgctgctaaaccagatcccatctccaggggtcatttgcttcctcaacctcaggagaggcagcagccctggctctggggggaaggaggggcatggtatgagaccacaggcttaaggtgcaagaagaatgatttaggtccggttaaagaaagtcttcatcccaaagaaaagccttggtatcactgcaggtacatttccagaaagaactaggcatcaaccgccttatgagcayctaaatgaagcctggaagtgaagaaatgaattggcaaactagacaccatctcaactagagaaagagatgtttttctatttaagggtcactgatccacaggaaaagaaatcaatgaagggcctccacaaataaaaagcaaactaatttagttttggaaggaaacataatataaaataacccattcatccacttcctaaatcaagagcaaagaagataaaccgtatttagcaagaaataagactgtgctttttttttttttgagacagagtcccactctgtcacccaggctggagtgcagtg

SEQ ID NO: 20105 - DNA, 601 bp, Human
accgtatttagcaagaaataagactgtgctttttttttttttgagacagagtcccactctgtcacccaggctggagtgcagtgacacgacctcagctcactgcaacctctgcctcctgggttgaagcaattctcctgcctcagccttctaaagtgctgggattacaggtgtgagccaccacgcccggcctgtgctttgattttatagtatacctagctatgagagagagactgaaagagaaaaatggaaatgaaattatattttaaatcagcatgaatttccttgtgctgagcccctcccytctccctcatcaaattcagatttgcgttcctactgcccacagactttccatagcttttatgacaattatcaggtgggccaagcggctttgtgggggcaggtctcatctgggctgtctcgcaaagaccagggacccagtgaaaccacatgatggtcacattcagccctcgtaggggttccatctgcatccaggccatcccaatggccactcggaaaaagccctttgcagggcattttaaggggcctggagcagggttcccatcctggctgcacatcaggctctcccagaaagcttttgaaa

SEQ ID NO: 20106 - DNA, 601 bp, Human
cagagccccctgcatgccgagcagaatgacaccacgctctctgccaggcctctgtccttgctacgggttgctcccctcaactcacagtctgtctcctcctttgcagagaagaactgttcctacttcaggcattttaaccccggcgagagctcggagatcttcgaattcaccactcagaagggtgagcctgggtggaaaggggtctggggtgacaagaggggacttctgtgttgtgcaccactgggccagaaagtcattggcaaaagcactgacttcctcacgcctgatgagaagaagcccrtggtgcatttgaacaacagccttgtcagctccccgctccggaggccccaggcagccgccttccatctccagggcccggagcttccacacctcggggccagggagcgtttgcagaagcagcacctcctggtaggcccctacacaagggcagctgttgtgacgggaggtgtggatgtggaacaaatgctcagaagccccgtggtggctcttggtggcatgtgatagttagagtctgcagggacagtctgagtccctccctggcctagaaatccctccctgagtaccaggagggtgcggtggg

SEQ ID NO: 20107 - DNA, 601 bp, Human
tcttggtggcatgtgatagttagagtctgcagggacagtctgagtccctccctggcctagaaatccctccctgagtaccaggagggtgcggtgggctctgggagcttttcaggatccgcagagctcagacgcacacccattgtcgggagtacagacccgtgcctgcctgcgcccagacagctgcacacagggtgagtgggcagacacacagacacacactgacacacacagacacacacaacacagatacacacacacgacacacacaagacacagacgcacagagacactgacacacacrcatgacacacaaaatgacacacagtgacagacacacactgatacacatgcatgatgacacacaaaatgacacacagtgacacacacagacacacactgacacacacgtacaatgacacagacacagagacacacactgacacacacgtacaatgacagacacagagacacacactgacacatatgcatgacacacaatgacacacacagacactgacacacacacagatacacacatacaatgacacacacaagacagacacagagacacacacttgacacacacacatgacacacacag

SEQ ID NO: 20108 - DNA, 601 bp, Human
gtctcgccctcctgctgttctccctgcctcgaatgccccggaacccatgggagtcctgcatggatgctgagcccgagcactaaccctcctgcggccctagcgaccctcaggcttcttccccaggaagcggggtcttggcctggaaccttccagagaggaggcgggagcaattttagccccaccctgctcccatctgcccccctgcaacagtcgcaggctgcttcctctctctgagttcctctgggctgccgcaggctcccctgggaatagagcaagacgtgagtcctaacctggccacagytgggggaggcagagccagcaggtggacaggtgtttgcaggggcccaacttcccctggagctcagaggtgtccccactgtaccagcctctgataagctgcctccagttgtcctttatgaacattgcagggacaacctgtgtttgccagctgggtgttccgtgtaaatagccagcctgtctctttctcggtgataaaacacaccctctctggtgagcccagcgtcccctccttggcttccaggagccctgggaagcatttttaactgggtagaatctgactgtggcttgaaataaaaagctc

SEQ ID NO: 20109 - DNA, 601 bp, Human
ttcatcacgctggcccaggacccgctggagtttattcttcccgggctagcgccctcgcgcgtgcgcagaggtataaggttcttggtctgcgcccccggggacatgagtattctctaggatcccttcctccggggactctgaggacaatccagggtggatggcggctggtcaagatcccgcctcctatcttgacccccggagcagtgtactgtacgtgcatcactcgcccagccctcagccatcgcccggctgccccggtgcccaggaagcctcgcgttcgcttagtgtcctgagcatctgwgggaagctgacacagcctcactcctgcttcacttcatgccgcttcaggcgggagaaactgcaatgtcttacagatctagagcattggaaacaaccttagaaatcatctagggcagcattttcaaacttaaaacaagaaactcagtaagatttggtttttcaaataaaatattatgccaaagtccaaaattcaaacaagaaatgggttgagaagcactgaagtgatgactgggactggattctcccctttactcctaaattcttccaatctctgcccacaccatgaccagccccacgaaga

SEQ ID NO: 20110 - DNA, 601 bp, Human
gacttacgttatagagctggttctggccctgctggtacgcgggggcgtctgcgctcctgctgaactgcaacacagaaagcaaagcgcgttactgctccgcgagggcgcgcaggggagccggggtgccagggcgcgcggcgacccgagggacagccctactccgctccttggcaactaacaatgctgccctgcctcctggggctgagcccttgcaggggccggggcgtggcagcccctttttctgagcccagttgtcctttttcctcccgcctgtgacacgtgcattcatcacgctggcccrggacccgctggagtttattcttcccgggctagcgccctcgcgcgtgcgcagaggtataaggttcttggtctgcgcccccggggacatgagtattctctaggatcccttcctccggggactctgaggacaatccagggtggatggcggctggtcaagatcccgcctcctatcttgacccccggagcagtgtactgtacgtgcatcactcgcccagccctcagccatcgcccggctgccccggtgcccaggaagcctcgcgttcgcttagtgtcctgagcatctgtgggaagctgacacagc

SEQ ID NO: 20111 - DNA, 601 bp, Human
gcgttccctaggtccgaggaggaggctgcccttcctttccggagggtctacggcgaggctgacttacgttatagagctggttctggccctgctggtacgcgggggcgtctgcgctcctgctgaactgcaacacagaaagcaaagcgcgttactgctccgcgagggcgcgcaggggagccggggtgccagggcgcgcggcgacccgagggacagccctactccgctccttggcaactaacaatgctgccctgcctcctggggctgagcccttgcaggggccggggcgtggcagccccttttkctgagcccagttgtcctttttcctcccgcctgtgacacgtgcattcatcacgctggcccaggacccgctggagtttattcttcccgggctagcgccctcgcgcgtgcgcagaggtataaggttcttggtctgcgcccccggggacatgagtattctctaggatcccttcctccggggactctgaggacaatccagggtggatggcggctggtcaagatcccgcctcctatcttgacccccggagcagtgtactgtacgtgcatcactcgcccagccctcagccatcgcccggctgccccg

SEQ ID NO: 20112 - DNA, 601 bp, Human
cattccttctccacccccctctagcctttgcaaattgctgatggcttgggggctcactagtggcaggcactagactaagctcgttccatgcatcaagacattaaagcatgtaatctttatggcgccctttgagacaggtacaattactacacctgttttgtgggttagaaaactgaggttaaacaagttgcagccgggtcgcagaggtgatagctagggaccaaacctaaacccaagactctggcgggcgcgttccctaggtccgaggaggaggctgcccttcctttccggagggtctackgcgaggctgacttacgttatagagctggttctggccctgctggtacgcgggggcgtctgcgctcctgctgaactgcaacacagaaagcaaagcgcgttactgctccgcgagggcgcgcaggggagccggggtgccagggcgcgcggcgacccgagggacagccctactccgctccttggcaactaacaatgctgccctgcctcctggggctgagcccttgcaggggccggggcgtggcagcccctttttctgagcccagttgtcctttttcctcccgcctgtgacacgtgcattcatcac

SEQ ID NO: 20113 - DNA, 601 bp, Human
agcaaatagagaagtgggggctcagaggtggtagtcaatttcaccacagtcccattgcacagggagtgtgaaatcgctttcccctcctctgggaagattctaatacattccttctccacccccctctagcctttgcaaattgctgatggcttgggggctcactagtggcaggcactagactaagctcgttccatgcatcaagacattaaagcatgtaatctttatggcgccctttgagacaggtacaattactacacctgttttgtgggttagaaaactgaggttaaacaagttgcagccrggtcgcagaggtgatagctagggaccaaacctaaacccaagactctggcgggcgcgttccctaggtccgaggaggaggctgcccttcctttccggagggtctacggcgaggctgacttacgttatagagctggttctggccctgctggtacgcgggggcgtctgcgctcctgctgaactgcaacacagaaagcaaagcgcgttactgctccgcgagggcgcgcaggggagccggggtgccagggcgcgcggcgacccgagggacagccctactccgctccttggcaactaacaatgctgc

SEQ ID NO: 20114 - DNA, 601 bp, Human
gcaggaacacacaggaaggtagaggaacccctaccggctttccccccatctcagggtcccggccacgtctcttgtccaaaacatcgtactcctctcttcgtcctagattgagctcctataacagataagaaagtgtcagacacaggacggaggaacctcagaaggatggagccagctggactggggagtgtggtttccctctctggggtggctcataaaaagaggggcaggggctggggaggggatggtaactggtccatctggagaccatcatcccagaggacatctcagagaacacgcmttaacatgacagtggatgggatccccaaaggtcaccaagtactataggctgatcagtccaacgggataaggatcaacattctcatgagcaaatagagaagtgggggctcagaggtggtagtcaatttcaccacagtcccattgcacagggagtgtgaaatcgctttcccctcctctgggaagattctaatacattccttctccacccccctctagcctttgcaaattgctgatggcttgggggctcactagtggcaggcactagactaagctcgttccatgcatcaagacattaaagcat

SEQ ID NO: 20115 - DNA, 601 bp, Human
ctacaaagccaagaggtcaaaccccccagggaccataccccgaccatatgtgggttatccaggggtcttgggcccttcctgtatggacctcttcaccaggtctgtcctcttggggcagatggcgtcaccgtgtgtgcatctcaggatggccaaggagcagtttgaggggaagtgggtagagcttagacatgagcagtggggtgccacgtccgggggtgaggccccttgagatgcagaatggagccaaggaggaaggaagagggtgcggcagcaagtgggtctccatctcttctcttgtccygggcccacacatgtgagggtcgagtctggttgcagagtgagctgaggagccctcccccacagcctgggctgagccccaccacacatgcaggaacacacaggaaggtagaggaacccctaccggctttccccccatctcagggtcccggccacgtctcttgtccaaaacatcgtactcctctcttcgtcctagattgagctcctataacagataagaaagtgtcagacacaggacggaggaacctcagaaggatggagccagctggactggggagtgtggtttccctctctggggtggctc

SEQ ID NO: 20116 - DNA, 601 bp, Human
aatatgtagaactataatttgtcaatataaaataaataaagacagaggaaggaaggaaggaaggaaggaaggaaatcagaatgaaggggaaaaaacaaagaggaccctaccctactgtggtgtcatccagctgctcccctacccacaggtatacccacaggtatagtgtctacaaagccaagaggtcaaaccccccagggaccataccccgaccatatgtgggttatccaggggtcttgggcccttcctgtatggacctcttcaccaggtctgtcctcttggggcagatggcgtcaccgtrtgtgcatctcaggatggccaaggagcagtttgaggggaagtgggtagagcttagacatgagcagtggggtgccacgtccgggggtgaggccccttgagatgcagaatggagccaaggaggaaggaagagggtgcggcagcaagtgggtctccatctcttctcttgtcccgggcccacacatgtgagggtcgagtctggttgcagagtgagctgaggagccctcccccacagcctgggctgagccccaccacacatgcaggaacacacaggaaggtagaggaacccctaccggctttcccc

SEQ ID NO: 20117 - DNA, 601 bp, Human
ttaaagatttgaagtgataaatatgttaattagcttaatttaatcatttcatattatattcaaaaatcataacaatactttgtaccccataaatatgtagaactataatttgtcaatataaaataaataaagacagaggaaggaaggaaggaaggaaggaaggaaatcagaatgaaggggaaaaaacaaagaggaccctaccctactgtggtgtcatccagctgctcccctacccacaggtatacccacaggtatagtgtctacaaagccaagaggtcaaaccccccagggaccatacccygaccatatgtgggttatccaggggtcttgggcccttcctgtatggacctcttcaccaggtctgtcctcttggggcagatggcgtcaccgtgtgtgcatctcaggatggccaaggagcagtttgaggggaagtgggtagagcttagacatgagcagtggggtgccacgtccgggggtgaggccccttgagatgcagaatggagccaaggaggaaggaagagggtgcggcagcaagtgggtctccatctcttctcttgtcccgggcccacacatgtgagggtcgagtctggttgcagagtga

SEQ ID NO: 20118 - DNA, 601 bp, Human
gtacaaagcctcaattagataggaagagtaatttatttttagatcaacagcacaacatgctgaatatagttaatatgtgagtactatacattttaatatctctaagagtaagttgctaatgttctcatcacaaaaaagttaaagatttgaagtgataaatatgttaattagcttaatttaatcatttcatattatattcaaaaatcataacaatactttgtaccccataaatatgtagaactataatttgtcaatataaaataaataaagacagaggaaggaaggaaggaaggaaggaagaaaatcagaatgaaggggaaaaaacaaagaggaccctaccctactgtggtgtcatccagctgctcccctacccacaggtatacccacaggtatagtgtctacaaagccaagaggtcaaaccccccagggaccataccccgaccatatgtgggttatccaggggtcttgggcccttcctgtatggacctcttcaccaggtctgtcctcttggggcagatggcgtcaccgtgtgtgcatctcaggatggccaaggagcagtttgaggggaagtgggtagagcttagacatgagcagtggggtg

SEQ ID NO: 20119 - DNA, 601 bp, Human
gtatttacccaaaagatttgaagtctgcttgttgaagaaatgtctatactcccatgttgattgtagcactattaacaataaccacggctgggcgcgggggcttacacctgtgattccagattgtagtcctattaacaataaccaaggctgggtgtggtggctcacgcctggaatcgcagcactttggttggctgaggcgggcagatcacttgaggtcgaaagttcgagaccagcctgatcaacatggagaaaccccgtctctactaaaaaaactacaaaattagccaagcgtggtggcgcwtgcctgtaatcccagctactcgggaggctgaggcaggagaattgcttgaaccctagaggcagaggttgtggtgagccgagactgtgccgttgcaccccagcctgggcaacaaaagctaaacgctgtctcaaaaaaaaaaaagaaaacaaaacaaaagaaaccaataaccaagttatggaatcaacctaagtgtccatcaaagaatgaacagataaagagactgtggaacatacacacaatagaatactattcagcttttaaaaaggaagaaattctgttattcactctaacatggatgga

SEQ ID NO: 20120 - DNA, 601 bp, Human
tgggtatttacccaaaagatttgaagtctgcttgttgaagaaatgtctatactcccatgttgattgtagcactattaacaataaccacggctgggcgcgggggcttacacctgtgattccagattgtagtcctattaacaataaccaaggctgggtgtggtggctcacgcctggaatcgcagcactttggttggctgaggcgggcagatcacttgaggtcgaaagttcgagaccagcctgatcaacatggagaaaccccgtctctactaaaaaaactacaaaattagccaagcgtggtggygcttgcctgtaatcccagctactcgggaggctgaggcaggagaattgcttgaaccctagaggcagaggttgtggtgagccgagactgtgccgttgcaccccagcctgggcaacaaaagctaaacgctgtctcaaaaaaaaaaaagaaaacaaaacaaaagaaaccaataaccaagttatggaatcaacctaagtgtccatcaaagaatgaacagataaagagactgtggaacatacacacaatagaatactattcagcttttaaaaaggaagaaattctgttattcactctaacatggat

SEQ ID NO: 20121 - DNA, 601 bp, Human
aagaagacatataaatggctaagagacatatgaaaaaatgcttaacatcactaaccattagggagataaaaagtaaaaccacaatgagatcacctcacacttgttagggtgcgcattaccaaaaagacaaaagacaacaatagttggcaaggatggagagaaaaggaaacccttgaacactcttggtgggaatgtaaattaatacaaccattatggaaaacagtattgaggctccacaaaaaactaaaaatagaactaccatatgacccaacaatcccgcttctgggtatttacccaaaaratttgaagtctgcttgttgaagaaatgtctatactcccatgttgattgtagcactattaacaataaccacggctgggcgcgggggcttacacctgtgattccagattgtagtcctattaacaataaccaaggctgggtgtggtggctcacgcctggaatcgcagcactttggttggctgaggcgggcagatcacttgaggtcgaaagttcgagaccagcctgatcaacatggagaaaccccgtctctactaaaaaaactacaaaattagccaagcgtggtggcgcttgcctgtaatccca

SEQ ID NO: 20122 - DNA, 601 bp, Human
aaggatggttcaacaaacgaaatcaataaacatgatacaccacattaacagaatgaagaacaaaaatcatgatcatctcactagatgcaggaaaagcatttgacaaaatttaacatcctttcatgctaaaaactctcaacaaattaggtatagaaggaatgtgcctccacacaataaaggccacatatgaccaatccacagctaacaccacactcagcagggaaaagctgaagcctttcctccctttcttctaagatctgaaacaagacaaagatgcccacactcactacttctattcaayatagtaacataggtcccagccgagcaattagcaaaaggtgccaagaatatacaatgggaaatgaatggtctcttcaataaacggtgttggaaaacctggatatccacaagcaaaataatgaaattggaccttatctcacaccgtatacaaaaatcaactgaaaatggattaaagacttaaacataaggcctgaaactgtaaaacttccataataaatcatagatgaatagatatttctcaaaagaagacatataaatggctaagagacatatgaaaaaatgcttaacatcactaaccatt

SEQ ID NO: 20123 - DNA, 601 bp, Human
tgggggtgaggagtggtcaatgaaatcgacagcctctctactgcccattcactctagcaacaacacaaccagcacagggatcagcctggacaggggctggatggacaggcgtgaccactggcagcatctggcagcactgcccttacaccaggacagccctggcctttgtcctgagccctgtgcttaaaaggaccctaacaagtcaaatttaacaacacattaaaaggatcattcagtgtgatcaagtgggattaatccctgggatgcaaggatggttcaacaaacgaaatcaataaacatkatacaccacattaacagaatgaagaacaaaaatcatgatcatctcactagatgcaggaaaagcatttgacaaaatttaacatcctttcatgctaaaaactctcaacaaattaggtatagaaggaatgtgcctccacacaataaaggccacatatgaccaatccacagctaacaccacactcagcagggaaaagctgaagcctttcctccctttcttctaagatctgaaacaagacaaagatgcccacactcactacttctattcaacatagtaacataggtcccagccgagcaattagca

SEQ ID NO: 20124 - DNA, 601 bp, Human
gggccctcatggcactacatggctcatacttggttacctgcaactggatacacacttcgctcttccagaggggcccacccaagcccagcattgcccagggcaggccatcgggacgcccacacacatcacaagctgacaagtgggacttttggctgaagacaaaaggagtcacataccatcatttggagcagggccagccactggtagtgagtgcctactgaaaggtgccctccccacaccctcctagtcctgacaagaggagaggaggcaagataaacttggatggtgggggtgaggagtrgtcaatgaaatcgacagcctctctactgcccattcactctagcaacaacacaaccagcacagggatcagcctggacaggggctggatggacaggcgtgaccactggcagcatctggcagcactgcccttacaccaggacagccctggcctttgtcctgagccctgtgcttaaaaggaccctaacaagtcaaatttaacaacacattaaaaggatcattcagtgtgatcaagtgggattaatccctgggatgcaaggatggttcaacaaacgaaatcaataaacatgatacaccacattaa

SEQ ID NO: 20125 - DNA, 601 bp, Human
acagccaaacgggctgtagatcaaccctccctccccacaggaggggcggggaggcatctccttcacagaaggctgccacctgcaagggtctcctgcatggcaacccagatcgacaatcagggttcagggtcacacccaggagggtgaggttgaccttcctatagcgggggacactcagaagacttcagcacccaggacaggagcccctcgaaggggccagccacctcgtccttgcctagcttgaccttgctgtgtccccctacaccccaggctgatcaacctgggaactccagcagcagggtttggggagggaagggagattactcggcacttttcagctaaggagactttctagaagcaggtgctgctgcaggccgcaagcaggtgagacattactcaatccaagaagggaaggtctggacagacaaagaccacagagtgaggagcaaccgccttcctctggagccctcctccagcccttcctccagcccttcctccggagccctcctccagcccttcctccagccctcctccggagccctcctccagcccttcctccagcccttcctccggagccctcctccagcccttcctccagccc

SEQ ID NO: 20126 - DNA, 601 bp, Human
ctgagctgaggggctcaagttaggctcaaaaagataggaggtggagttctagacaaagacacggagactgggcaaagcaagggctcacctggagccccagaatcatttatctgagcaagttgtctctttacacagccaaacgggctgtagatcaaccctccctccccacaggaggggcggggaggcatctccttcacagaaggctgccacctgcaagggtctcctgcatggcaacccagatcgacaatcagggttcagggtcacacccaggagggtgaggttgaccttcctatagcggggkacactcagaagacttcagcacccaggacaggagcccctcgaaggggccagccacctcgtccttgcctagcttgaccttgctgtgtccccctacaccccaggctgatcaacctgggaactccagcagcagggtttggggagggaagggagattactcggcacttttcagctaaggagactttctagaagcaggtgctgctgcaggccgcaagcaggtgagacattactcaatccaagaagggaaggtctggacagacaaagaccacagagtgaggagcaaccgccttcctctggagccctc

SEQ ID NO: 20127 - DNA, 601 bp, Human
ttgcactgagctgaggggctcaagttaggctcaaaaagataggaggtggagttctagacaaagacacggagactgggcaaagcaagggctcacctggagccccagaatcatttatctgagcaagttgtctctttacacagccaaacgggctgtagatcaaccctccctccccacaggaggggcggggaggcatctccttcacagaaggctgccacctgcaagggtctcctgcatggcaacccagatcgacaatcagggttcagggtcacacccaggagggtgaggttgaccttcctatagsgggggacactcagaagacttcagcacccaggacaggagcccctcgaaggggccagccacctcgtccttgcctagcttgaccttgctgtgtccccctacaccccaggctgatcaacctgggaactccagcagcagggtttggggagggaagggagattactcggcacttttcagctaaggagactttctagaagcaggtgctgctgcaggccgcaagcaggtgagacattactcaatccaagaagggaaggtctggacagacaaagaccacagagtgaggagcaaccgccttcctctggag

SEQ ID NO: 20128 - DNA, 601 bp, Human
gtggcagacagggagggctcccacaatcaaggctccaaaccttatgcacacaaacttctctgcccacaaccagctccagcccacccccctcgtcctcagccctttggagtctcctccgagctgccagctctttgcactgagctgaggggctcaagttaggctcaaaaagataggaggtggagttctagacaaagacacggagactgggcaaagcaagggctcacctggagccccagaatcatttatctgagcaagttgtctctttacacagccaaacgggctgtagatcaaccctccctcyccacaggaggggcggggaggcatctccttcacagaaggctgccacctgcaagggtctcctgcatggcaacccagatcgacaatcagggttcagggtcacacccaggagggtgaggttgaccttcctatagcgggggacactcagaagacttcagcacccaggacaggagcccctcgaaggggccagccacctcgtccttgcctagcttgaccttgctgtgtccccctacaccccaggctgatcaacctgggaactccagcagcagggtttggggagggaagggagattactcggcacttt

SEQ ID NO: 20129 - DNA, 601 bp, Human
ggcgtggaacactgatttttaccaactaatgcagaaagcagcaggttcccctacaacaggaagcttcttgatccccaagttggcagcagtggcagacagggagggctcccacaatcaaggctccaaaccttatgcacacaaacttctctgcccacaaccagctccagcccacccccctcgtcctcagccctttggagtctcctccgagctgccagctctttgcactgagctgaggggctcaagttaggctcaaaaagataggaggtggagttctagacaaagacacggagactgggcaaarcaagggctcacctggagccccagaatcatttatctgagcaagttgtctctttacacagccaaacgggctgtagatcaaccctccctccccacaggaggggcggggaggcatctccttcacagaaggctgccacctgcaagggtctcctgcatggcaacccagatcgacaatcagggttcagggtcacacccaggagggtgaggttgaccttcctatagcgggggacactcagaagacttcagcacccaggacaggagcccctcgaaggggccagccacctcgtccttgcctagcttgacc

SEQ ID NO: 20130 - DNA, 601 bp, Human
ctcaggcccctggtcagaccttcatctctgcagagtaaggtgaggcctggccatgatggggcttgggtttgctccaccccactcagatcctcacagacatcagattcctaaggtctagggcccgcaggacctatattgcctactgcttagataaatgggcttcccttcagctcttaaagttcttggctagtcatttttgctcactgacaaccagctgttttgagcagttacgagctctggcatagtcagttcaatcacgtgcccgtttaccagctagaagaccttgggtaagtcactcaayctccttgtgccttgcagggcacatgtttctcattgggttgttgtgggaattaaataaaactacagagaacccctgcttggaaggggtcaatgcttcactctcaccattttgaaattcttaattgttgatgaacaattaattgttgatgaacaattcttaattgttgatgaattgttttcatgttgtcctgggacctgtggtcctgagcactgaacacggcagcacatattaagcactcgatgcttcctgttattaaaacggacctgcttttgcaaagcttaggctgtcatagaatctaga

SEQ ID NO: 20131 - DNA, 601 bp, Human
ccttacagtgcttgggccccgccaacttcctgctggacctaagagaaaggagtctcccacctcccatattgggcaggaatcaggggggagggcccaggcctgctccagagaatctgctgtccctgacacctgggcccaaaggaagcctggacttgtcacagggagaagaggggctccttggcctcagccctctgtgagcctccttcccttcccaggcccagtgattctagtgttttcttggtcacgaacaggcccacaaggctggccccaaacctgctggaatgcctgtccccctggtccrggggccaggaaggagaaggatcaacagcagccacacacaggtaagtttctggggcccttttgatatcactcaactcaggcaagctgggcatcctgacactagagtcagaagaacgagctatgaacagcccatgggagccagaaggagggaaatgacaacccgctggggatcatgttttagagaagtagtttgaccgtgcttagtttgcataattgcctgcactgatttgcaaaaaccaggcacctaactacataacattttctttttgaagctgccatttttcttagctttttttccttc

SEQ ID NO: 20132 - DNA, 601 bp, Human
tgtgccctgccgggaatggccttgcagcaactcctttccagctaaattctcacccctcttctcagctcctcaaatgctgtgccttacagtgcttgggccccgccaacttcctgctggacctaagagaaaggagtctcccacctcccatattgggcaggaatcaggggggagggcccaggcctgctccagagaatctgctgtccctgacacctgggcccaaaggaagcctggacttgtcacagggagaagaggggctccttggcctcagccctctgtgagcctccttcccttcccaggcccrgtgattctagtgttttcttggtcacgaacaggcccacaaggctggccccaaacctgctggaatgcctgtccccctggtccgggggccaggaaggagaaggatcaacagcagccacacacaggtaagtttctggggcccttttgatatcactcaactcaggcaagctgggcatcctgacactagagtcagaagaacgagctatgaacagcccatgggagccagaaggagggaaatgacaacccgctggggatcatgttttagagaagtagtttgaccgtgcttagtttgcataattgcctg

SEQ ID NO: 20133 - DNA, 601 bp, Human
gcatttattatgcaaaataggaaggctttagcatgccagtataaattaaaacagtagaaaaaaagcagagcagagagcgttttccatccatggcctgtgccctgtaatgacgcagcagtatcctagtacattgacgggtttttcctgtcctgccactgtccgctgggcagttataggtcccatgtgttgggtcttcctgcgaggccttcacaaagatgattttgtcattcgctgaaagcgtgaagtgaatcaacggcctcctcttgctccgcagcactttattcacactgtgtaaccacactgttttttatgccactttgtgcacagctcatcaaggtcagtctgttcatcttctggcccctgtagcacatggtacagttcaatggtgcggcacagaggcctgaggcagggaggctcccgctgccctcgcaggccctggctgaccctcccctgcccgcccaccttcccatgcccctgcagctccctggttgcacctggcctaggctcctttccatctgcccctctgcccggccctctcaccagggaggcacaacatggcccagtacagttaccttgaaaggaggtgaaggtgacaacagaa

SEQ ID NO: 20134 - DNA, 601 bp, Human
tttgctcccctcctcccccaagggcaacctgctgatttactgatgactaaattgccattacaagcttgactgctgaaataaagcttagagtaaagctgcattttcactgaagcatttattatgcaaaataggaaggctttagcatgccagtataaattaaaacagtagaaaaaaagcagagcagagagcgttttccatccatggcctgtgccctgtaatgacgcagcagtatcctagtacattgacgggtttttcctgtcctgccactgtccgctgggcagttataggtcccatgtgttgsgtcttcctgcgaggccttcacaaagatgattttgtcattcgctgaaagcgtgaagtgaatcaacggcctcctcttgctccgcagcactttattcacactgtgtaaccacactgttttttatgccactttgtgcacagctcatcaaggtcagtctgttcatcttctggcccctgtagcacatggtacagttcaatggtgcggcacagaggcctgaggcagggaggctcccgctgccctcgcaggccctggctgaccctcccctgcccgcccaccttcccatgcccctgcagctccctggtt

SEQ ID NO: 20135 - DNA, 601 bp, Human
catattgccgcattccgggccgcaggatgcacctgtgctcatgtgctcgttcccaggaactgtcctgttctctcctgagaatcagcagttttgctcccctcctcccccaagggcaacctgctgatttactgatgactaaattgccattacaagcttgactgctgaaataaagcttagagtaaagctgcattttcactgaagcatttattatgcaaaataggaaggctttagcatgccagtataaattaaaacagtagaaaaaaagcagagcagagagcgttttccatccatggcctgtgcyctgtaatgacgcagcagtatcctagtacattgacgggtttttcctgtcctgccactgtccgctgggcagttataggtcccatgtgttgggtcttcctgcgaggccttcacaaagatgattttgtcattcgctgaaagcgtgaagtgaatcaacggcctcctcttgctccgcagcactttattcacactgtgtaaccacactgttttttatgccactttgtgcacagctcatcaaggtcagtctgttcatcttctggcccctgtagcacatggtacagttcaatggtgcggcacagaggcc

SEQ ID NO: 20136 - DNA, 601 bp, Human
taatgtctacttgccctctgtctggctcctggaagccactcaaaagaacgtctttccaatgacatacagtaattcttgaggaaaatttttagatcctgacaggcactcaagcatctcagcaggagacattgggtttctggcttctgttagataacatcttaccctatgatcacagccaaattttacagacttccttctaattcaatcataagtgctgaaaagagaatgagtaaaagcctgtctcagttcttattaaggtatatgcagagactttggaatcttcctcatattctcaaatatyttactcctcaattaaagtcccccaaaattatttcattcatattacctttctctgggctttttgcaggatgtgttcagggcggttgactgtggatccgaagagggattttagcttcgtcttatgagttctcagtaactgcagttaatgaagtcctcacctgcttttataccagcagagtgtttccacctgcatctaagccctgggatcaacaggaaattccatccaatgattgaagggtacttggtgtaattaccatgacgtcaatttttaccatgacgtcaatttgatcttatcttgttt

SEQ ID NO: 20137 - DNA, 601 bp, Human
acgaaccttttataaatgatgaccactcttgtcttttttaaataattcaagaatatagcaatgtattacatgcaatttggttgaccaatattatgaataattgaattggtattaagtcaagtaattatttaaaagatattttcagaaactttaaaagattccttttctaaagcaaaatatctgacttttgactgggaaaaagattgaagagcttaagaaacaaaatatctacagagatgaaagggagcttctgcattcctaagggacccatatagtgtcagcccatagttcttcacacgtrcccatagcctattcttcaacgctaataaggagggacaaaaaaggtcttttattttctagtgtctatttcccaatcagccaccaattaatgctaatgctaagataaccaaggttagctgcaaaaaagtttccagaaactcattggaactaatcaattagacttgggcaagtgacttatcattgcaaattcatgaataatagctagagaaatactaccaactttgatttttgtagcattttattaaagaagaaaaatgaaaacaacgacattcaagaaattccatgctactattcaagtctg

SEQ ID NO: 20138 - DNA, 601 bp, Human
ctttgagttttcatgtaaatttgggtctcacattaaaaagaaatgtacactgcaactgaaaatctgctctggaacataattaattgcttttctaacatttttctcacacactacccttttcagcaggaaatggtaaggaatatgactcacttaaaatttcaatgactcttactgcaaaaaaaataataaacttaagaaaaccaaagttgaaattaacatgaaaaaccacgaaccttttataaatgatgaccactcttgtcttttttaaataattcaagaatatagcaatgtattacatgccatttggttgaccaatattatgaataattgaattggtattaagtcaagtaattatttaaaagatattttcagaaactttaaaagattccttttctaaagcaaaatatctgacttttgactgggaaaaagattgaagagcttaagaaacaaaatatctacagagatgaaagggagcttctgcattcctaagggacccatatagtgtcagcccatagttcttcacacgtgcccatagcctattcttcaacgctaataaggagggacaaaaaaggtcttttattttctagtgtctatttcccaa

SEQ ID NO: 20139 - DNA, 601 bp, Human
tttaagcaagacgtacattaccttctaagttagccatttctgttacccagctcttactttgagttttcatgtaaatttgggtctcacattaaaaagaaatgtacactgcaactgaaaatctgctctggaacataattaattgcttttctaacatttttctcacacactacccttttcagcaggaaatggtaaggaatatgactcacttaaaatttcaatgactcttactgcaaaaaaaataataaacttaagaaaaccaaagttgaaattaacatgaaaaaccacgaaccttttataaatsatgaccactcttgtcttttttaaataattcaagaatatagcaatgtattacatgcaatttggttgaccaatattatgaataattgaattggtattaagtcaagtaattatttaaaagatattttcagaaactttaaaagattccttttctaaagcaaaatatctgacttttgactgggaaaaagattgaagagcttaagaaacaaaatatctacagagatgaaagggagcttctgcattcctaagggacccatatagtgtcagcccatagttcttcacacgtgcccatagcctattcttc

SEQ ID NO: 20140 - DNA, 601 bp, Human
aaaaagagagagagagagaaagaaagaaaaagaaaagaagaggagaggagaggagaggggaagaggggagaggagaggaaaagaaagaaagagagagagaaaagaaaaaagaaaagaaaagagagcaagttcaggtattttaaactgatcaagctataaggactgtctgcagtggggaacagcaggggaacagggaaaggggaaaaagcattagctttcttttttttttttttttttttttgagacatggtctcactctgtggatcaggctggagtgtagtgccactatcacggctcattmcagtctcaacttcccaagctcaggtgatcctcccatcttagcctcccgggtaactgggacaacaggagtgtgccagcaagcccggctaatttgggagtggttttttgtgtttgtttttttgttttgttttgtttgtagagacagggtttctctatgttgcccaggctgatcttcaactcctgggctcaagtgatatccccggctctgcctcccaaagtgctagaatttcaggcgtgagcccccgtgcccagtcagcattggctttcacatacattcacttgctttattttctttacacct

SEQ ID NO: 20141 - DNA, 601 bp, Human
ctgggatcgagccactgtactccagcctgggagacagtgagaaaccctgtcttgaaaacaaaaaagagagagagagagaaagaaagaaaaagaaaagaagaggagaggagaggagaggggaagaggggagaggagaggaaaagaaagaaagagagagagaaaagaaaaaagaaaagaaaagagagcaagttcaggtattttaaactgatcaagctataaggactgtctgcagtggggaacagcaggggaacagggaaaggggaaaaagcattagctttcttttttttttttttttttttttgagacatggtctcactctgtggatcaggctggagtgtagtgccactatcacggctcattacagtctcaacttcccaagctcaggtgatcctcccatcttagcctcccgggtaactgggacaacaggagtgtgccagcaagcccggctaatttgggagtggttttttgtgtttgtttttttgttttgttttgtttgtagagacagggtttctctatgttgcccaggctgatcttcaactcctgggctcaagtgatatccccggctctgcctcccaaagtgctagaatttcaggcgtgagcc

SEQ ID NO: 20142 - DNA, 601 bp, Human
atatctttctccactgcactcacctatcacttggcttataattcttagatgatgccccacagtctaaccagttatgtacacgtctatctcttcatccacaaagaaactttctttctttttatttaaattagaaatgggatctcgagaggtggaagcggcagtgagccgagattgcgccactgcactctaccctgggcaacagagagactccgtctcaaaaagaaagaaagaaagaaaagaaaagaagtgggcatctcactatgttgtctaggcatcttactttaaaaggatttttttttttggtaataaaaacagagcagaggagctgcaaagtgaagccccttgttcattgcccctgtgtttactgctatggcagattgtactttccaaaaatggccacaaaaatacccctcagcctacatttatttgcagtgtgaccttgtcactcccacgtcaaacagtggtatgtctgtctttgtatttttatctttgtaccccatttcatctacataggcccttgactgcttagatcaggaatatagcagtagtgacactgggcaagtagtaggtatatcccttaactgacctggcagttcctgct

SEQ ID NO: 20143 - DNA, 601 bp, Human
tactaatctcagcttcttttggtatttcacatgagtattttccgaacttcaaaggccctgtacacacaacctcagactaacctgcaatacacaccaacatacccttatatcccatcacccaccacatcaagataatatgtgtccaagaaaacatgagttttctcaacttggccttctttctctcccttttcagttcatctacttcagagtcttttaaggagctgttcaacagccagattcactgtgaagttttcacccaaccccaaagacaaaataaatatctttctccactgcactcacytatcacttggcttataattcttagatgatgccccacagtctaaccagttatgtacacgtctatctcttcatccacaaagaaactttctttctttttatttaaattagaaatgggatctcgagaggtggaagcggcagtgagccgagattgcgccactgcactctaccctgggcaacagagagactccgtctcaaaaagaaagaaagaaagaaaagaaaagaagtgggcatctcactatgttgtctaggcatcttactttaaaaggatttttttttttggtaataaaaacagagcagagga

SEQ ID NO: 20144 - DNA, 601 bp, Human
caggttctgagatcagtaagtttgagaatacacaaagccataaggaaatgttcagaattaaaactagtttcctttttaaactagtatcatgtttgtgccttaatattgcagctcatatattatgaaaattcagccattatgcagtgaacaactatatcagaattaattcagagagaaacatttataataagatttgagaatgtgaaagcatgaagtcaatgcgcattttagaattgcctttataataaagtgaaaagaagattgaaaaagtgaaacaaaaatcactattgctgtagcagaactattacctttctttgcctgtattttgaaaagagatgacattaaccaagtaaaaacagaatagccttcaaattctaggtgattttgaaagcattttaataaatatttttatcatcctaatcaccctcaggtttttctgttttaaaattcaaaagaaaatattaagaatcagggggagaaattaaattctgctaggatttatgctattttgcaaaaatatgctcaatctaaagtcagatttactaatctcagcttcttttggtatttcacatgagtattttccgaacttcaaaggccctgt

SEQ ID NO: 20145 - DNA, 601 bp, Human
tgatggatttttctaaatgaataaatatttttaaactttagcataatcactaagccattaaatattaatggatataaactcatgaatagaagctctttgggctcttcaataattttttttttttttttttttttgagattgagtctccctctattgtccaggatggaatgcagtcatgcagtcttggctcactgcaacctccacctcctgggttcaagcaattctcctgcctcagcctcccgaatagctgggactacaggcacacgccaccacgcttggctaattttttttttttttttgkatttttagtagagacggggtttcagcatattggccaggctggtctcaaactcctgacctcgtgatccacctgcctcggcctcccaaagtgctgggattacaggcgtgagccaccatgaccagcctgggctcttcaataatttttaagagtgtaaacaggttctgagatcagtaagtttgagaatacacaaagccataaggaaatgttcagaattaaaactagtttcctttttaaactagtatcatgtttgtgccttaatattgcagctcatatattatgaaaattcagccattatgcagt

SEQ ID NO: 20146 - DNA, 601 bp, Human
tatgatggatttttctaaatgaataaatatttttaaactttagcataatcactaagccattaaatattaatggatataaactcatgaatagaagctctttgggctcttcaataattttttttttttttttttttttgagattgagtctccctctattgtccaggatggaatgcagtcatgcagtcttggctcactgcaacctccacctcctgggttcaagcaattctcctgcctcagcctcccgaatagctgggactacaggcacacgccaccacgcttggctaattttttttttttttttgtatttttagtagagacggggtttcagcatattggccaggctggtctcaaactcctgacctcgtgatccacctgcctcggcctcccaaagtgctgggattacaggcgtgagccaccatgaccagcctgggctcttcaataatttttaagagtgtaaacaggttctgagatcagtaagtttgagaatacacaaagccataaggaaatgttcagaattaaaactagtttcctttttaaactagtatcatgtttgtgccttaatattgcagctcatatattatgaaaattcagccattatgca

SEQ ID NO: 20147 - DNA, 601 bp, Human
acttaacagaaactttgtttatgcacaaaatatttaaaatagtatataaaattaccttcaggctatgtgtatatgaaacaaatgaattttatgtttagacatgggtctcatccccaagatatctcactatgtgtatgcaaatattccaatatccaaaaaaaattaaaatctaaaacacctttcatcctcagcatttcagataaaggatactcaacctgtatagaaattcagattgtgtaagtatgaaggctaaaacaaacctatgtcattatttctacctaatatatatatttatatgtargtaattttgagttctatttatcttcacacataattaacactgaataaatattgttctaagtcagtggttctcaaagtgtgatctgggaaccccaaagattttcagtggatctgtggggttaaaatgattttcataataatactaaaatgttgtttgtctttttttcctcttcatcctcttgggtgttcagagaaattttctagaggctacatgacatgtaattttacaacagattgaatgaaaaagcacatgagaatttagctatgttctgttaggccagacgatgaagagttttgcaaa

SEQ ID NO: 20148 - DNA, 601 bp, Human
atacacacagcagcttgaatggatctcaagagaattgtgctgaatgcaggctgaatactatatgattccatttatataacactgtggaaataacaaaattatagagatagagaatagattaatggtttcaaagagttagcactgggaaagaagtgtatgagggtgagtatggctctaaagggatagcacaagggagctgtggtgatgggacagccgcatgttgatagggatgttagtcacactaatctacacatgggataaaactgcataacagagcactagtattatgtgtgtgtgtgtttcttaaatctgaataagctgtataggcggcagcaatgtcagttctctagtattcaccttgtactatagttatacaagataattttcaatgagggaacaagctgaaggatatacaggacttctctgtacattttttgcaacttcctctaaatctgcaattattcaaaataaaagtttttttaaaaaaattcagaatgaggtttaaaggtacatatgagtcaaaacttatggttatttttcatgtagactgacataatagggctgagtttctgctagatgtttatattaacccataatactt

SEQ ID NO: 20149 - DNA, 601 bp, Human
tgttagaaagcttctggggatcttgaggttcttaccctgttatatgatttagctacacagcaagtggactctgaggtgacgttcttttggaccaacatcgtcttcttggaccttagtggagtgggatatgctctagagaagcagcagcccatgcactgaagtattggggcacccggctgggagaagaatgggttttcctgtagcgtgcattctgggcaatctatcagggaaaaaaaaaggcagagtaaaatatccaaaaaagactcaaaaagaatctatgaggccagcacagtagctcacrcctgtaatcctagcactttgggaggccttagtgggtggattgcttgagctcaggagtttgagagcagcctgggcaacatggtgaaaccctgtctctacaaaaaatacaacaacaacaaaaattagccagacgtgatggtgcacacctgtagtcccagctgcttgagggtctggggcagaagaatcgcttgaagctgggaggtcgaggctacagtgagccgagatcatgccactgcactccagcctgggtgacaaagtgagaccctgactcaaaaaaataagaaaaaatgtggtggctcac

SEQ ID NO: 20150 - DNA, 601 bp, Human
attttcttctcttgccctaataaatgtcttataagtagcccactggctgaaaggactcacacgctgctaggtgtggtaacagcaaggctctccaatgtcaggtcaccaaacacatttggccccaactcacccaatggcccactctcttccattaatgctgtccaaagcaactggctttactttgaagaaaaatgataattcagtgattgaatgatgatttaaaaggctttatttgcagtggaacaagctaaatgctgtattcattccaaatgaaaagaactagactgctgattgtactgtrggataaggaggaaggcagtaaagctgcagtatatccttgaagcgtgtcaaagtggtatggtaaggaaaaggagagttttatctcacaaagccataaacactaaacaacttaattttccattccagaaaatcagcagtcatcaagacagcacttggtaaaacatttaagatttgtgataataacaagtactgcagtggcacgccgtgtggttctccactttgaaaccccccattactgtgacctaaaggggaaggaaaaaaaaacatattatagattagatgatagatagatagatagaga

SEQ ID NO: 20151 - DNA, 601 bp, Human
aatggaaacttaaaaagttatataaaaattaatataaatagaagttcttatattttcttctcttgccctaataaatgtcttataagtagcccactggctgaaaggactcacacgctgctaggtgtggtaacagcaaggctctccaatgtcaggtcaccaaacacatttggccccaactcacccaatggcccactctcttccattaatgctgtccaaagcaactggctttactttgaagaaaaatgataattcagtgattgaatgatgatttaaaaggctttatttgcagtggaacaagctwaatgctgtattcattccaaatgaaaagaactagactgctgattgtactgtgggataaggaggaaggcagtaaagctgcagtatatccttgaagcgtgtcaaagtggtatggtaaggaaaaggagagttttatctcacaaagccataaacactaaacaacttaattttccattccagaaaatcagcagtcatcaagacagcacttggtaaaacatttaagatttgtgataataacaagtactgcagtggcacgccgtgtggttctccactttgaaaccccccattactgtgacctaaaggg

SEQ ID NO: 20152 - DNA, 601 bp, Human
ctccaactgtaagaaaaatagcacagaacattcagaagttgtctagtttcatcctttctccagtgccccgcatctcttgcaagggagtaaattaataagtcaggagttaggacccagagatatgttttagacttacacgatctgacagctgactgcaaatcaatgaagtgcactttgagaagcggcacactcggcgagaggggttgagattgttttattccactccaggtgttgctgtcctcttgggttccacttcggattttgaacccctgtattttcttttcaaaacccccttttccartggaaatgctctgttgttaaaaaggaagaaactgtctttctgaaactgacatcacgatgctcccagattttatgctggttctcatcgtccttggcatcccttcctcaggtaagcacaagtcacagtaaattaaaactacagttgcagaattatttaagcagaggaggcaaaactatggtgttgataatgttagaattacaatatgtaatgcacaagatacatttaggataacctttaaaatgtggcccaaatgagtaattctgtgagatgtgggtttttttttgctgaagaaatcatatc

SEQ ID NO: 20153 - DNA, 601 bp, Human
tacttatggggaaaaaaataaattttttaaaaagtgaaaaaaaggctgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtcyggcctgggcgacagagcgagactccgtctcaaaaaataaataaataaataaataaataaataaaaaataaaaagtgaaaaaaaggaaagtaagtatcacagaagaaaactattttggtcagattaacactaggaatagaaaattctgattcaggcaaaatacttaaaagaaatattcaattttaaataaaaaaattgtttattaaaacagttacctggcgttgtggtagaaaagtcctaaaatagggcagggtgtggtggctcatgcctgtaatcccagcactttgggaggccgaggcgg

SEQ ID NO: 20154 - DNA, 601 bp, Human
caggacctcagggcagcttccttcctgagtcccctgcccagggccccattcagtccttgtcgctgaccctccccaggcagctgggggctgaacgaggaggagcggctgatccggcacctgtttcaagagaagggctacaacaaggagctccggcccgtggcacacaaagaggagagtgtggacgttgccctggccctcacactctccaacctcatctccctggtgagaggccctccggtgctgggttgggagggagggcagggatggctttccagtaccaggatagccatggaggaagctrgaagcccccacctggcctatggccactcccttcctgggaaacgtgctgcggctgctctgtgccctgagaggctgctgtcctgcccctccagtgtcagctctgcggtgtcccccaaccacacccatagcatgccccatctgtgacacacttcagaggccactggtcctctctgctccctggcggcctacccactcctgactgcgagtgatcagggcccagatgccacggtttccctgggtgccaattgacagtgggtgaatgtaggctgggtgtggtggctcatgcctgtaatcccagcac

SEQ ID NO: 20155 - DNA, 601 bp, Human
ggaggaagctagaagcccccacctggcctatggccactcccttcctgggaaacgtgctgcggctgctctgtgccctgagaggctgctgtcctgcccctccagtgtcagctctgcggtgtcccccaaccacacccatagcatgccccatctgtgacacacttcagaggccactggtcctctctgctccctggcggcctacccactcctgactgcgagtgatcagggcccagatgccacggtttccctgggtgccaattgacagtgggtgaatgtaggctgggtgtggtggctcatgcctgtwatcccagcactttgggaggcccaggtgggtggatcacctgaggtcaggagctcgagaccagcctggccaacatagtaaaacctgatctctactaaaaatacaaaaattagccgggtgtgatggtgtgggcctataatcccagctactaggaaggctgaggcaggagaatcgcttgaacccaggaggcagaggttgcaggttgcagtgagccaagctcgtgccactgcactccatcctgggcaattgagcaagaccctggaaaaaaaaagagagagagagagagagagagagtgggtgaat

SEQ ID NO: 20156 - DNA, 601 bp, Human
cgagtgatcagggcccagatgccacggtttccctgggtgccaattgacagtgggtgaatgtaggctgggtgtggtggctcatgcctgtaatcccagcactttgggaggcccaggtgggtggatcacctgaggtcaggagctcgagaccagcctggccaacatagtaaaacctgatctctactaaaaatacaaaaattagccgggtgtgatggtgtgggcctataatcccagctactaggaaggctgaggcaggagaatcgcttgaacccaggaggcagaggttgcaggttgcagtgagccragctcgtgccactgcactccatcctgggcaattgagcaagaccctggaaaaaaaaagagagagagagagagagagagagtgggtgaatgtgtgcggataaaagaatgatatggccctgaaggatggccctaccgtctaattacagaaagaagttgaggagaccctcactaccaatgtgtggatagagcacgtaagaatgcccctcccagccgggcgcagtggctcatgcctgtaatcccagcactttggaaggccgaggggggtggatcacgaggtcaggagatcaagaccatcttggct

SEQ ID NO: 20157 - DNA, 601 bp, Human
agagcacgtaagaatgcccctcccagccgggcgcagtggctcatgcctgtaatcccagcactttggaaggccgaggggggtggatcacgaggtcaggagatcaagaccatcttggctgacacggtgaaaccccgtctctactaaaaatacaaaaaattagcttggtgtggtggtgggtacctgtagtcccagctactcgggaagctgaggcaggagaatggtgtgaacgcaggaggcggagcttgcagtgagccgagattgcgccactgcactccagcctgggcgacagaacaagactccrtctcaaaaaaaagagaatgccccgcccagagccggtggggtcggggagggaatgcagggcaccagattgcttctgcatggagatcccgtctgccttggacactgttctccaggaggggttggtgcctccctacagggaagccccaggcccaactgtccttcccccacctagtgccctcaccagccctgatgtcaccttcaagtggattaggattcacatgttggaaaattgccactttatcttgatgtttattagaaaacattctcttcctgcctgtcaaaagtccacagtacagacaca

SEQ ID NO: 20158 - DNA, 601 bp, Human
caggacatcaccttctacctcatcatccgccgcaagcccctcttctacatcatcaacatcctggtgccctgcgtgctcatctccttcatggtcaacctggtcttctacctaccggctgacagtgagcctccaggccccgtcccctgctccccctccccaagcccacctgagcacagccagccccagccctgccccctcacttcctcctgggagccacctggggtctccattcctggagctccctgcctggatccaggtgtgagggccaggtggccacccagagggagggctgtatgattcygggcaacatccccaaatggacagggcagggcatctccaagatgctacttcccacggactctcagaagaactgctaaactgtccctctgtcagggcagagaccaagtccctcacggtcaccagtgtgtgaccgtgggcctggcacacaggaggccctcaactgttgaaccagtgggtgaataacagggtctctaggacagtagggtgtgaggcagaaaacccatctatgctcacctgactctatgaggcagtggtttacaagttcagagtatttactatgagcagggcatagtgagtccca

SEQ ID NO: 20159 - DNA, 601 bp, Human
ggtggccacccagagggagggctgtatgattctgggcaacatccccaaatggacagggcagggcatctccaagatgctacttcccacggactctcagaagaactgctaaactgtccctctgtcagggcagagaccaagtccctcacggtcaccagtgtgtgaccgtgggcctggcacacaggaggccctcaactgttgaaccagtgggtgaataacagggtctctaggacagtagggtgtgaggcagaaaacccatctatgctcacctgactctatgaggcagtggtttacaagttcagartatttactatgagcagggcatagtgagtcccagggtcaaaggccacccagcccctgcccccggcaggacttgaggagggagaagtggggcaccttccatctgcagtggggttgggagggcttctagaggaggtggagtttgaatggacttgagcaggattgggtggggctaccacaggcaggaggagcaatgccaataaggagggggccaggcaggggctgaagggacctcagcaggggagccccccttcccgcccttgccatcacgtgcaggagctcaggtgggaagagcaagacagca

SEQ ID NO: 20160 - DNA, 601 bp, Human
gaccccatctctaaaaaaataaaataaaatgaaaagcagggaccgggtgtggtagctcacacctataatcccagcactttgggtggctgaggcgggtggatcacctgaggtcaagagttcgagaccaccctggccaacatggtgaaactccatctctactaaaaattcaaaaattagccaggcgtgatagtgtgcgcttgtaatcccagctactcggggggctgaggtacgagaatcgcttgaactcgggaggtggaggttgcagtgagccgagatctcaccactgcactccagcctgggygacaagagacaagagcgaaactctgtctccaaaaaaaaaaaaaaaaaaaaaaaatctggaacttgtccaaaggccatctgtagaatgggtaaagacactggacatatactcccacgggagtgccgctcagccgtgcagaagcacctgcggctgctgcagccctgcacgtgtgaacctcctggcacagtgttccgtgaaagaaaccagacgcagcagcacatgctgcaggcctcactttgtaagaagttcaagaacaggccaaatcagtgtttggtgatggaagtcagaatggtggctatc

SEQ ID NO: 20161 - DNA, 601 bp, Human
tcggggaatcaatgacagagtcagacgggggagcactttgtggcagccaggaatgaagtcacagatgttaggatgtgtaaaggtcaccccatgcttgtaaaatggcctttttggccagacacggtgcctcgcccgtaatcccagcactttgggaggccaagtcaggcagatcacgaggtcaggagagcaagaccatcctggccaaaatggtgaaaccccatctctactaaaaatacaaaaattagctgggcatggtggcgcgtgcctgtagtcccaactacttgggagactgaggcaagagatcacttgaacccgagaggtggaggttgcagtgagccgagatcgcgccactgcactccagcctggtgacagaatgagactccgtctcaaaaacaaagaacaaaaaacaacgcctttcttgtggccccttgacatggccccagctcttcctggagaccctgccggagctcctgcacatgtcccgcccagcagaggatggacccagccctggggccctggtgcggaggagcagctccctgggatacatctccaaggccgaggagtacttcctgctcaagtcccgcagtgacctcatgttcga

SEQ ID NO: 20162 - DNA, 601 bp, Human
agcttgggggtggggctttgtggcctgaggcccttctcaccccactctctctgcccctacccacaggagaaagacagctggaaccgagtggcccgcacagtggaccgcctctgcctgtttgtggtgacgcctgtcatggtggtgggcacagcctggatcttcctgcagggcgtttacaaccagccaccaccccagccttttcctggggacccctactcctacaacgtgcaggacaagcgcttcatctagggtgggcctgttggggagccaggagacagcagggtctgagagaggagccacrgtccctaatgacacccactcctagccctgaggctcgtgcccctcagactggggaagagtccaaggaagggagggagcagccactcctcaatgctcaatggctcccctgaaatcaagacaggggccacccgagatggtctgagggtggacatcggctacagtgggtgggcaggacgatttggggggaggcccgaggctggctcaggggccagggaggaggccactcagggtggcctcagggggagagctctgataggggtgagacagatagggccccttctctgcttctcctcccccaagg

SEQ ID NO: 20163 - DNA, 601 bp, Human
gccccttcttgctgtgcttgaacagggcacccgtgatgtcccggacactgttctgagggggcacaagcttaggggcacctctggcacttccaaggtcaaaggctgaacgttgctccactcccctggcctgtacctggtggctgggtacccccctatcctcccaacttggtctctaggcagggggttgcagcttgcagcaggagctggtagcagccctgggtatggcttaaagtgtcattttatgccccattgacccttcctcccaataacaccaggggtccaatttcaaagaaggaaaagrttagtgtgaacacagggaagcaacgtgacaccagagctggggattagcctctgttggggtttaggtttctgcagaatgaaagctttctcactcataggccccccacattgcaggactctgctagggccccatttccagggcttttttcttgggggctttgaggagccctgagaagggggcttcaaggatgaggaaactgaggcccagagaaggggaagagtcggctccaggtcacacagctggtctgaggtgtccagagccttcctaggccttggcaacacagcagctgtgtgggcatgc

SEQ ID NO: 20164 - DNA, 601 bp, Human
tgggtctcttcaacataaacttgagatacaggtttcagaattagctgctggaattataggggcctagacttacaggccagagaacaccttattgttcagatggggaaactgaagcctaggggaggagaaggactttgctgtttctccactgggaattggtggcatagcccaggctcaaaccctgatcccaagccagatctcagtatgttgtaccatctggtgtagggttggtgggttatttcatggactgaggggctgggcaaggctgtgggtgaacagcaggcattgttggatggagggrcaaggttctggttcctacctgctccaaagatgtcattgacaaggttgacaatcttctcctgtgggatgaggttgccgctggctctaggccccttcttgctgtgcttgaacagggcacccgtgatgtcccggacactgttctgagggggcacaagcttaggggcacctctggcacttccaaggtcaaaggctgaacgttgctccactcccctggcctgtacctggtggctgggtacccccctatcctcccaacttggtctctaggcagggggttgcagcttgcagcaggagctggtagcag

SEQ ID NO: 20165 - DNA, 601 bp, Human
gatgaaggcctccaagtagggcagctggggtctgtcagagagccggggccgccgctccctgccaatcacagtgtctgtagaacacagaggacaagcagagctcaggggctgccctaactgccccatgaattatcccctcttataccccatgtcactcttatgtaagactgtctattcacaagtctgcgaccccactaacctcccacatcttctaggcaagggcaggcactactgtgtgcccagggcttgcacacagcaggcacataacaggtgtttgtagactgaacaaacaacctgggtytcaaggcttctcctggctatagggttgggggcccccatgtacccagctccttctggatcttcctctgtatctcaggcttggtcacaaggtacatgaggctccaggagatggctgtggtgactgtgtcaaatcctgaaccgtgtagtgtaaggtgaggaaagaaggaagacagaaacaaggaaaccatcatttcccaagtatctgctatgtatgtatccagcattagctttctctggccctagcctgtgagtttcctgaagacagaggctgggtctcttcaacataaacttgagatacagg

SEQ ID NO: 20166 - DNA, 601 bp, Human
agcaattctcctgcctcagcctctggagtagctgggattataggcgcaccaccatgtccggctaatttttgttttgtatttttagtagagatagggtttcaccatgttgcccaggctggtctcaaactcctgacctcaagtgatctgcctgcctcggcctcccaaactgctgggattataggcttgagccactgcgcctggccatcctagttgattcctgtgcactaaagtttgtgaaacttttgtaaatatcgtcacttagagcagactatagcaattgaggtcccctcctttcattatrtaaacagttcctagcagggacaaacagccttcctgactgctgaacctgcacacattttttcgtgaggggtatgtactcacgggtcatggttgacctgccactggtttacgaagacacagcatttcttggggatgtagaagccattcagcgttgtgtcccttgttgtgctgaggagggaagagggcactgtgaggctcagggctggaaagctggggcatgtgttgctcctacctccaccccatccagacagcctgcccaccgccatctccatccctacactgggaggggaggggaggaaca

SEQ ID NO: 20167 - DNA, 601 bp, Human
tatggttttttttttgtttgtttgtttttttttttgagatggggtcttgctctgtcactcaggctcttggcaaattttttttttgtagagacagggtcccactatgttggccaggctgctttccaattcctgggctcaaatgatcctccaaccttggcctcctaaaatgctgggattacaggccctgcacttggctaaagctgctattttttaaaaaaagaaaggaagagaaacaagggctgagtccccgtggctggcccccactcgctccctggcctcagaatggtggtgtcttcttcarttgatggagaagcgcagccgcgcctggacatgttcacagcgggcgtgcttcatggtcagcccgtagatgggggtcaggtcgactttcacgcccggcggcacgctgaactccagttgctgtagcaggatggccaggaagaggaagatctcccacttggccaggacttccccgatacaccggcgcttgcccatgccaaacagcatcatcttctcactcaagggcttgttaatggcagtgccatcggcggtgaggaaccgctcaggccggaactcagaggggtcctcccacagctctctgcaa

SEQ ID NO: 20168 - DNA, 601 bp, Human
gaggattgcttgaacctgcgaggtggaggttgcagtgagctgagatcacgccactgcactccaacctgggtgacagactgagattctgtctcagacaaaaaaaaaaaaaaagaaggtgaattatatggcataagaattatatctccataaagctgctatatatatatgtatatatatggttttttttttgtttgtttgtttttttttttgagatggggtcttgctctgtcactcaggctcttggcaaattttttttttgtagagacagggtcccactatgttggccaggctgctttccaaytcctgggctcaaatgatcctccaaccttggcctcctaaaatgctgggattacaggccctgcacttggctaaagctgctattttttaaaaaaagaaaggaagagaaacaagggctgagtccccgtggctggcccccactcgctccctggcctcagaatggtggtgtcttcttcaattgatggagaagcgcagccgcgcctggacatgttcacagcgggcgtgcttcatggtcagcccgtagatgggggtcaggtcgactttcacgcccggcggcacgctgaactccagttgctgtagcagg

SEQ ID NO: 20169 - DNA, 601 bp, Human
cctggccaacatggtgaaaccccatctccactaaaactacaaaaatcagccaggcgtagtgactcatgcttgtaatcccaggtgcttgggaggctgaagtgggaggattgcttgaacctgcgaggtggaggttgcagtgagctgagatcacgccactgcactccaacctgggtgacagactgagattctgtctcagacaaaaaaaaaaaaaaagaaggtgaattatatggcataagaattatatctccataaagctgctatatatatatgtatatatatggttttttttttgtttgtttgtttttttttttgagatggggtcttgctctgtcactcaggctcttggcaaattttttttttgtagagacagggtcccactatgttggccaggctgctttccaattcctgggctcaaatgatcctccaaccttggcctcctaaaatgctgggattacaggccctgcacttggctaaagctgctattttttaaaaaaagaaaggaagagaaacaagggctgagtccccgtggctggcccccactcgctccctggcctcagaatggtggtgtcttcttcaattgatggagaagcgcagccgcgcc

SEQ ID NO: 20170 - DNA, 601 bp, Human
cctggccacccctgaaatgtttccaaggacgtcactagtgaagacaggtaactgttaaggtcaatgacgcagagtagagtcacccacccttggtttttctcaactcctccacaaggcagtgagcttcctcttgaacacggtcctcaatgctcctcttccccatcccaaaattccgcaaggttgtgagggagaaacgccggatctccttccatctctttccattgctggaaatgattcctaataaaaaaaggggcagaaactgggagaattcacagccaaggaagaaagtgctgcaacactyggcagccatgcagataggctaagctctgctgagaagctttttagggctctgttttccatccccctcaccccagttaccaaagctgacacagaaatatgtgcacctaccaagtcctttagtaattctttgagatattggggaattgcctcttccagaaaactcctctccattatcaatcagggcttccttcactgcctcatatccatgaaacaccactatgggattcatgccaaaatacacggtgaacacaggaccatagacttttgagaactgggaaaggaaatgcaaatagcagcaaaa

SEQ ID NO: 20171 - DNA, 601 bp, Human
ttaaaatctagttaaacaaattatttacaaattagtatttgtgtatttgctgagttatactatagattatatttacttaaaatatattaattgctacagtaagtagtggttaacaagaaataattaatcctgacagttttcaaatagtactgtgtttcccgagaaataagaactgatgaaaactgtactgagatatacctaagcaagtaaaaccatacatagtgtcattgctggccagagctgtaggcatggacctggaaggaatttccagacatgtgagtatgaccatatgaaaaaactygaattaaatgaaagcacatataacttggttcatatttcatgaagtgtgatgaggtcactttcaccatgtccactttccaagtgttctctggtgaaatgttctggtggaggtaatgcagatttatgctatgggggaaaccttctttaactcttcaaaaatgaactcaagacccttatttataatttctgatttgaaaacaaggaaacaaaattgagcagaaaataggattaaatgaccttttattcctacaccctatgaaccaacacatttatacaggcaaagcacagatacacaaaacct

SEQ ID NO: 20172 - DNA, 601 bp, Human
aagggttgtgaataaagttggaacattgaacaacaagaaacctgctgagttagctgcttctatgccagactcctttaaacattacagggctctaaagtttcagaaaaactgttgttttagccaagggggtgaaaggtaatttgggaagccttggtgagagagagagagagagagagagagagagagagagtgtgtgtgtgtgtgtgtgtgtgtgtgtgtttctcaggtacaatctgatatccaggtttttttttttttactgcatttgggagagtgaatttaaaaaggtaattttatatcycagctgataatcagattgattataacaagcacttcataggtgagtaaattggcagtgggagaaaaatgattagcacaaatttcaaagctaagaaccaatacaggggaaaaaagatgacaaaactgaaaacatagccaaattacatttaaagaagacaggataaagagtttttcataatagttaaaatctagttaaacaaattatttacaaattagtatttgtgtatttgctgagttatactatagattatatttacttaaaatatattaattgctacagtaagtagtggttaacaagaaa

SEQ ID NO: 20173 - DNA, 601 bp, Human
caagtttttagagcagaatcatgtctgtttgcaaagcctctggacaataaaacacagagataggaagagaaaagttggggacctagaaatgtcatatagctgaaagtataatgtgctgaaccaatgggaataaagttagggagattgtgggtgaattcatgtgttttagggaacaaatgtgaaaagcaagtacatccatatgatatgagaagaaaaactaatataaatgagcattaagtataacagatttgtttatctaaataagtaaaatgctaactttttatttcaaatctaaatcccwgtaaagctaaccaaaaagtaaattgataaatggaatctttttatttattttttcaatttgtaaaaaatgaatttccttcctttggaaataatgtttatcatttccaatcatcttccaaatttaattcatttgggcaaaactactcttgtggattctgggatattattcagtatagtcatcaagataagtatgttttaataaagttttaaatttgaccataagttaggccaaatctgtaattttacaggtaaagaaattattaaaaaggcttttattcggtgaaggaatctctaaaatgaa

SEQ ID NO: 20174 - DNA, 601 bp, Human
cagggagcacagcccaggatgaaagtgggatcacagggtgaagctaaagatttaaaaatttttaaaaaaattattaaaaaataaatatttaaaagatttgcatttgttaagacataaaggaaatttagaaattttaaacaatatcttacaaattccccatgtgtccaaaaaaaatcagcatggatgaaataaacacattacttttaccttaaatatgagttgagcattacaggctagctaaacaatgtcatttcgcatgtggttattcacatccactgcctttatttaaactcttttaacyccaagtgtcttttattttggaaggaaaaagaagacttttttgaaatcctaataattcaagtttttagagcagaatcatgtctgtttgcaaagcctctggacaataaaacacagagataggaagagaaaagttggggacctagaaatgtcatatagctgaaagtataatgtgctgaaccaatgggaataaagttagggagattgtgggtgaattcatgtgttttagggaacaaatgtgaaaagcaagtacatccatatgatatgagaagaaaaactaatataaatgagcattaagtataac

SEQ ID NO: 20175 - DNA, 601 bp, Human
tgaagttttcattgaatcttttcatcagggtgagaaaattctgatctttataatcaaatcgtttctggaaaacaacggagcagatcacattgcagggagcacagcccaggatgaaagtgggatcacagggtgaagctaaagatttaaaaatttttaaaaaaattattaaaaaataaatatttaaaagatttgcatttgttaagacataaaggaaatttagaaattttaaacaatatcttacaaattccccatgtgtccaaaaaaaatcagcatggatgaaataaacacattacttttaccytaaatatgagttgagcattacaggctagctaaacaatgtcatttcgcatgtggttattcacatccactgcctttatttaaactcttttaaccccaagtgtcttttattttggaaggaaaaagaagacttttttgaaatcctaataattcaagtttttagagcagaatcatgtctgtttgcaaagcctctggacaataaaacacagagataggaagagaaaagttggggacctagaaatgtcatatagctgaaagtataatgtgctgaaccaatgggaataaagttagggagattgtgggt

SEQ ID NO: 20176 - DNA, 601 bp, Human
ctcatacatcatttttattgtataaaagcattttagtatcaattttctcatttttaaaccaagtcttccctacaaccttgaataaatggtttccaaggaaaataaaatcttggccttacctggatccatggggagttcagaatcctgaagttttcattgaatcttttcatcagggtgagaaaattctgatctttataatcaaatcgtttctggaaaacaacggagcagatcacattgcagggagcacagcccaggatgaaagtgggatcacagggtgaagctaaagatttaaaaatttttwaaaaaattattaaaaaataaatatttaaaagatttgcatttgttaagacataaaggaaatttagaaattttaaacaatatcttacaaattccccatgtgtccaaaaaaaatcagcatggatgaaataaacacattacttttaccttaaatatgagttgagcattacaggctagctaaacaatgtcatttcgcatgtggttattcacatccactgcctttatttaaactcttttaaccccaagtgtcttttattttggaaggaaaaagaagacttttttgaaatcctaataattcaagttt

SEQ ID NO: 20177 - DNA, 601 bp, Human
tcgctgctgccttgcagttggatctcagactgctgtgctggcaatgagtgaggcttcgtgggcatgggaccctccaagccaggtgcaggatataatctcctggtgtgccatttactaagaccactagaaaagcacagtattagggtgggagtgacccaattttccaggtgccatctgttcacagctttgcttggctaggaaagggaattccctgaccccttgcacttctgatggggaaatttttattgtgcacatatagcaattttctgtacctaaagattggaggctgaaaattttgaayaggaaatcaaaggtggtaattattttcttcactcatacatcatttttattgtataaaagcattttagtatcaattttctcatttttaaaccaagtcttccctacaaccttgaataaatggtttccaaggaaaataaaatcttggccttacctggatccatggggagttcagaatcctgaagttttcattgaatcttttcatcagggtgagaaaattctgatctttataatcaaatcgtttctggaaaacaacggagcagatcacattgcagggagcacagcccaggatgaaagtgggatc

SEQ ID NO: 20178 - DNA, 601 bp, Human
agaggtttctgctgccttttgttcagctatgccctgccccgagaagtggattctacagaggcaggcaggcctccttgagctgcagtaggctccacccagatcgagcttcctggtggttttgtttacctactcaagcctcagcaatggtggacacccctcccccagcctcgctgctgccttgcagttggatctcagactgctgtgctggcaatgagtgaggcttcgtgggcatgggaccctccaagccaggtgcaggatataatctcctggtgtgccatttactaagaccactagaaaagcrcagtattagggtgggagtgacccaattttccaggtgccatctgttcacagctttgcttggctaggaaagggaattccctgaccccttgcacttctgatggggaaatttttattgtgcacatatagcaattttctgtacctaaagattggaggctgaaaattttgaacaggaaatcaaaggtggtaattattttcttcactcatacatcatttttattgtataaaagcattttagtatcaattttctcatttttaaaccaagtcttccctacaaccttgaataaatggtttccaaggaaaa

SEQ ID NO: 20179 - DNA, 601 bp, Human
aagtgtgcagaggtttctgctgccttttgttcagctatgccctgccccgagaagtggattctacagaggcaggcaggcctccttgagctgcagtaggctccacccagatcgagcttcctggtggttttgtttacctactcaagcctcagcaatggtggacacccctcccccagcctcgctgctgccttgcagttggatctcagactgctgtgctggcaatgagtgaggcttcgtgggcatgggaccctccaagccaggtgcaggatataatctcctggtgtgccatttactaagaccactrgaaaagcacagtattagggtgggagtgacccaattttccaggtgccatctgttcacagctttgcttggctaggaaagggaattccctgaccccttgcacttctgatggggaaatttttattgtgcacatatagcaattttctgtacctaaagattggaggctgaaaattttgaacaggaaatcaaaggtggtaattattttcttcactcatacatcatttttattgtataaaagcattttagtatcaattttctcatttttaaaccaagtcttccctacaaccttgaataaatggtttcc

SEQ ID NO: 20180 - DNA, 601 bp, Human
cgataaagtcccgaggattgttaacatccagtgatgcttggtgttcttttactttctccctaatgtaacttcgtgtaagagcaacatttttaagcactttgttgtgagttcctgggaaacaatcaatgagtagagggaaattattgcagacctaaaagagaaaagaatattaaatataaacatgtcataagatatatgtatcttacaccaagccctgattgaaattataactataaatatgaataagacatcatgtccattttgaagggaaatttttatacatatatacattttttattayactttaagttctagggtatatgtgcacaaagtgcaggtttgtcacatatgtatacatgtgccaggttggtgtactgcacccaataactcgtcatatacattaggtatatctcccaatgctatcccttccccctccccccaccacacaacagaccccagtgtgtaatgttccccttcctgtgttcaagtgttctcattgttcaattcccacctatgaatgagaatatgcagtgtttggtttttttgtccttgtgatagtatgctgagaacgatggtttctagcttcatccatgtccctaca

SEQ ID NO: 20181 - DNA, 601 bp, Human
caaaatactgatctgttgctaatatcttacctgctccattttgatcaggaagcaatcgataaagtcccgaggattgttaacatccagtgatgcttggtgttcttttactttctccctaatgtaacttcgtgtaagagcaacatttttaagcactttgttgtgagttcctgggaaacaatcaatgagtagagggaaattattgcagacctaaaagagaaaagaatattaaatataaacatgtcataagatatatgtatcttacaccaagccctgattgaaattataactataaatatgaatragacatcatgtccattttgaagggaaatttttatacatatatacattttttattatactttaagttctagggtatatgtgcacaaagtgcaggtttgtcacatatgtatacatgtgccaggttggtgtactgcacccaataactcgtcatatacattaggtatatctcccaatgctatcccttccccctccccccaccacacaacagaccccagtgtgtaatgttccccttcctgtgttcaagtgttctcattgttcaattcccacctatgaatgagaatatgcagtgtttggttttttt

SEQ ID NO: 20182 - DNA, 601 bp, Human
atgctgtgtcaattgtcagccctccattgtctctccatgttttagaaatttgccaaagacttattggctattttctattctcctctcttttcacttcagcaggataattttaatttgtaatttagttattgaaatttcagtgggatcctgacacagggaaaaaggtatgttatctgctgcaaagcaggaactatttaaatgtaaattctaaggaaatgtagagtttactctaaaggtaaattgtaaattctaaagaaaagttgtatgtgaaagatgcaattattaaacccccttccaaatrtccctatttggtcaaatagcatttttatgaaacacactcctagaataataaaattcctttaggtatggcctctgcttaaatagaaacacctttgtaagagactaacttttagattacttcccagactggaatttatgtcaggatgcctcagtacaattctagaatttccacttatgcttcaataaagattgttttcatctccccaccacagcattagagcatggaatttttaaaatgagaaatgaacctactgttcaaagtggacttttcataataaaaccaacattcaatactagggca

SEQ ID NO: 20183 - DNA, 601 bp, Human
cagtgacacagattagcttctcctcttgataaatcttcctctgctaatacttacaactccatcctctatgctgtgtcaattgtcagccctccattgtctctccatgttttagaaatttgccaaagacttattggctattttctattctcctctcttttcacttcagcaggataattttaatttgtaatttagttattgaaatttcagtgggatcctgacacagggaaaaaggtatgttatctgctgcaaagcaggaactatttaaatgtaaattctaaggaaatgtagagtttactctaarggtaaattgtaaattctaaagaaaagttgtatgtgaaagatgcaattattaaacccccttccaaatatccctatttggtcaaatagcatttttatgaaacacactcctagaataataaaattcctttaggtatggcctctgcttaaatagaaacacctttgtaagagactaacttttagattacttcccagactggaatttatgtcaggatgcctcagtacaattctagaatttccacttatgcttcaataaagattgttttcatctccccaccacagcattagagcatggaatttttaa

SEQ ID NO: 20184 - DNA, 601 bp, Human
tctaaataaccactatttctttctattttttacttaacaatttttagacaatatttaatgattttctggtatgagagatgagaattttcatctccatctctattccatatatagacacacgcccacaaagttatatgtgtacacacagacacacccacacacgtacacacacacaattctcctccttctacttaccagaatatatttagaccacaatttctggttatatcactattcattgtttacatcattctaaatatactcacagaagcacacacacacacacacacacacacatatrcacacatacacattcttccttggttctttagttaaatcacaattttctattcttcaagttagagtatttgcacatgtttgaaactcctagtaataatttcccaattatagggaaatctcagactatcaatcacatctctttgattcttgaagtctcctctacatgtattattcacctggtcccttctgaagtggttgtttcctaggagcacagcagcctctctgacactctcattctcttacatgaggtctcctgattcctggcacccattatttcttctgacttagtttcagacatgag

SEQ ID NO: 20185 - DNA, 601 bp, Human
ttatatttgtatttctaaataaccactatttctttctattttttacttaacaatttttagacaatatttaatgattttctggtatgagagatgagaattttcatctccatctctattccatatatagacacacgcccacaaagttatatgtgtacacacagacacacccacacacgtacacacacacaattctcctccttctacttaccagaatatatttagaccacaatttctggttatatcactattcattgtttacatcattctaaatatactcacagaagcacacacacacacacayacacacacatatacacacatacacattcttccttggttctttagttaaatcacaattttctattcttcaagttagagtatttgcacatgtttgaaactcctagtaataatttcccaattatagggaaatctcagactatcaatcacatctctttgattcttgaagtctcctctacatgtattattcacctggtcccttctgaagtggttgtttcctaggagcacagcagcctctctgacactctcattctcttacatgaggtctcctgattcctggcacccattatttcttctgacttag

SEQ ID NO: 20186 - DNA, 601 bp, Human
aacgaagatatatggaacatttgtcatagcaattcatggccacattaacatgatataaaaatcccagcaacattacaaacatgagttacatgtccagaagtacaaccagccatataaaaagaattaccataatatagatacataccactctcctacaaactagtcattacagtgcataagtacatttctataaattagcatatatgacaatacaaatttaagtaatacattatttaaaaaataaacagaacataataagtcaataaattacagtgcttgcaaacagaaaaacaatcaaatmtgtattatcaaaataatatatggggtataatgttaaattgtaatggttttataaatatatttgtgtgtgcggtggtggagcaggggcagtgatgcaattagcaatggtactgtcttcattcttccatttccaattgtggccactttgagcatgctagcagtttcttctgaaatttatatttgtatttctaaataaccactatttctttctattttttacttaacaatttttagacaatatttaatgattttctggtatgagagatgagaattttcatctccatctctattccatatatag

SEQ ID NO: 20187 - DNA, 601 bp, Human
tcattctcagtagtgaaatattaatattcttatactctaccccccagcagatcagaaatgaaataaggatgccctctatcaccaattctgttcaatgctaacctgaaaatcctatccagcacaataatgcaataaagataaattgaagacaaaatcattggaaaataagatataaaatacatattaacccagatagcaaaataatatacatagaaattccaagtatatctacagataaattatcagcaatgatcagtaaatttaggaaagttgttagatataaggtcatcagaatagtatmattgaatacaattacttataccaattacaaagaaataaaaaaaattaaaaaattataacacaacaaaatattaattatctaggaaaaacctaataaaagagttgtaaaccactgcactgaaaataagacattactgagaaaatagaataaagctcaataagttgggagcataaccatattcatgaattaaaaaattcaatgcatgaacatgttaagtctttccatatcgaactacacaatgaatgtcactttgataaaaatctcagaagagtgttttgggaaattgacacactgatattt

SEQ ID NO: 20188 - DNA, 601 bp, Human
ttagggaaggtacaggagtctgatcacttggaatgacatgagccttctgggggctgggattttatgaaaataccaactatctgtttcataacaaatgtagagtatcatttcaaactatattcgtgaaaattcttttataaatgaagttaaataaaagtcaattatttaaaaaaaatacttaaaacatcattctcagtagtgaaatattaatattcttatactctaccccccagcagatcagaaatgaaataaggatgccctctatcaccaattctgttcaatgctaacctgaaaatcctakccagcacaataatgcaataaagataaattgaagacaaaatcattggaaaataagatataaaatacatattaacccagatagcaaaataatatacatagaaattccaagtatatctacagataaattatcagcaatgatcagtaaatttaggaaagttgttagatataaggtcatcagaatagtataattgaatacaattacttataccaattacaaagaaataaaaaaaattaaaaaattataacacaacaaaatattaattatctaggaaaaacctaataaaagagttgtaaaccactg

SEQ ID NO: 20189 - DNA, 601 bp, Human
tagccttatttagggaaggtacaggagtctgatcacttggaatgacatgagccttctgggggctgggattttatgaaaataccaactatctgtttcataacaaatgtagagtatcatttcaaactatattcgtgaaaattcttttataaatgaagttaaataaaagtcaattatttaaaaaaaatacttaaaacatcattctcagtagtgaaatattaatattcttatactctaccccccagcagatcagaaatgaaataaggatgccctctatcaccaattctgttcaatgctaacctgraaatcctatccagcacaataatgcaataaagataaattgaagacaaaatcattggaaaataagatataaaatacatattaacccagatagcaaaataatatacatagaaattccaagtatatctacagataaattatcagcaatgatcagtaaatttaggaaagttgttagatataaggtcatcagaatagtataattgaatacaattacttataccaattacaaagaaataaaaaaaattaaaaaattataacacaacaaaatattaattatctaggaaaaacctaataaaagagttgt

SEQ ID NO: 20190 - DNA, 601 bp, Human
aaaaaaaaaatctgtgcaaaactaccaaggtgctctgggctctgctccctgccatccccagtttgctagccttatttagggaaggtacaggagtctgatcacttggaatgacatgagccttctgggggctgggattttatgaaaataccaactatctgtttcataacaaatgtagagtatcatttcaaactatattcgtgaaaattcttttataaatgaagttaaataaaagtcaattatttaaaaaaaatacttaaaacatcattctcagtagtgaaatattaatattcttatactctaycccccagcagatcagaaatgaaataaggatgccctctatcaccaattctgttcaatgctaacctgaaaatcctatccagcacaataatgcaataaagataaattgaagacaaaatcattggaaaataagatataaaatacatattaacccagatagcaaaataatatacatagaaattccaagtatatctacagataaattatcagcaatgatcagtaaatttaggaaagttgttagatataaggtcatcagaatagtataattgaatacaattacttataccaattacaaagaaataaa

SEQ ID NO: 20191 - DNA, 601 bp, Human
gaaaactgtggattgtagtcctaatccttgtaaaaaaatcagtgataattagggaaaaccccatcacatcttgataagttatcaattctgtcttctccagaggatgacattagtaattgaaaccttatcagtctcattgttttccttcatgaagatataacctttattatttttaattgaaaaataataagtggaattgtgtagtttatagcatagcaactaaaacatctggatgaatacagaaaccatgtgatagacagcattgtaaagctgcaaagaccaaaattggcctccagattayaaagacaataattggccccagtgacggaagaacttcagagaggtaagctcatacctacagtcaatttttgactgtgttcatgtcatattcaattctgaatcaggacaggaggtgttgtcattataattgcctatgagaggggaatgaatacattctggaaaaagataaatgttctctgaaattctgcattttttcatatataatatctggtactgagccataggtttttaggcatttcaaggatacaactaagcagtcacacgaagaaaagtggaaggaagggaaagcaataaaaacaga

SEQ ID NO: 20192 - DNA, 601 bp, Human
gtaaggatcatcaattaaagctagaaccgttgggtgtgtgattctggaagcaggagtttcggataatcttaatgcactcccatagatttttactagttgcatataaaaagcagaacccctacaatggtaagatctggaggatacaaccttattatgtggggaacttagcatgaccaataatgacatatgtgacatttcatgctcccacctcatcaatgtgattcagcaggatatttaaagcacctatgtagttttcttgccaaaattgtagctggaatctgcctctagaaaacagtcatasaaaaccagcctgaggaacattttaaatgactgctggtctcaaaaaggtcaactgattgaaaagaaacaaaccaggaaaggaactttccttgattacaggaggtgaaaaggtcaacataaatgaactatatgcttgttccttgcctgtatagtaaactgcaggagaaaaaagccataaaaatattctagaaaaattgtgaaaatttaaatttaggctgtattattatttgaacaatagctactgagtgtgactattattgtgtaaaagaaaaatctttgttttggggcattacatactgca

SEQ ID NO: 20193 - DNA, 601 bp, Human
atgaggaaactcaggtccagccagacacagtaatttacatggatgagcttaaggccagtggtggaagcttgctaaagagctttccaatcacatttgaagtcttacatcttggatacttgtgtgcaaccttctgaatgtgttctccagatcatcaagtttggatgcccttttctggcctcatttgccgctctatttcatcacttcaaatttgacacatcttgtattttgattatgtagattatggtttaaaatggaagtctctgttgacacttgaaatgtccagagtatctgttcatagaayttttgtaaataaacatgtaatctattttaatatgatgtcatctgggatgacaaccacaagtgcaataagaagtaaaaactattgtgtgtttattactgccatgctacagattaattttagcttaaaacactgaaaagatgatgaaattacaaagattatcactttgcaacaattcaagtcaggatcatcaggtcaggtaaggatcatcaattaaagctagaaccgttgggtgtgtgattctggaagcaggagtttcggataatcttaatgcactcccatagatttttactagttgcatat

SEQ ID NO: 20194 - DNA, 601 bp, Human
cttggagctcagcctgggaggtgacagacaccatgtagaagacactcaatgcagttgtggacttagatacatttgtcaaggcaggtaaggaaagatcagatgaattttaccttctaggaggagctcttgggtgccttagtgatgtatctagtggcagagttcagtcaaaccaagatgttcattttctcaattgggaacaacagagttaactcctgcaagccccgctatctggcccaataatgatggtgtattgtgagggtggagcacatgggtgttaagagtggtgctcttgatcatggayaaatagcaattctaccagccccagaggaggtgccatgtaaattccaactaattccaaaaagttctctctttcctttaaatacaaatggaaacgagtttctattacctgctgagaaaggcatgaagtagtcacttttcttaaagttgccattcttatctagaaagtggccagggtcaaagatatttggattaggaaattctttgtcatcatgtagcacggaagtcagtaatgccattatggttgtgccctggaagtaacaaaacagataatctgatttataaagaagtccagaagtgagga

SEQ ID NO: 20195 - DNA, 601 bp, Human
gattaatgattgggtagatgaatgaacatgtggatgaatggatggatgacatgatggattgattaatggatggtgggacaaacaaatgtacaaaaagagatatatttgctatctgtctaacatctaatctcaataggcacccttcattcaacaaatattcattgattatcagctccataacagtcatttctttatttattcccacattaaaacagctcttttgccattttgagtttccatctgtcattatggaaatacatgcacattcttgtttcctgttccaagcctgatattccatgayttttccttccacttttcacataatctgttctcagctctggtcatacactctcttcatcaatcttgaacacaccatgaagtttcaagtttcatatcctgttgttcattttggctaagatacatctttattaggctacattcaggacataggttcaatttcatttcatcttcacactctttacaatcccctcaagtaatcaaatcctatgctctctggttttcctcaacagcatactcatgctttcattaaagcacagattaccaggaatcgtaattctgtatttatttatctattgtggta

SEQ ID NO: 20196 - DNA, 601 bp, Human
tcatcaacagatttcaggttaaagttctgtaaaattgtggttagaaataaaaatagctccatgcgggcaagtccttctcctgcacaaattcgttttcctgaagataacaaagaaaggaagtagttactccttgtgtttaactgtgactgtgacaaacagtcatttgtgacttgcacaaacagaatatgcagtaaataattgattaatgattgggtagatgaatgaacatgtggatgaatggatggatgacatgatggattgattaatggatggtgggacaaacaaatgtacaaaaagagayatatttgctatctgtctaacatctaatctcaataggcacccttcattcaacaaatattcattgattatcagctccataacagtcatttctttatttattcccacattaaaacagctcttttgccattttgagtttccatctgtcattatggaaatacatgcacattcttgtttcctgttccaagcctgatattccatgatttttccttccacttttcacataatctgttctcagctctggtcatacactctcttcatcaatcttgaacacaccatgaagtttcaagtttcatatcctgtt

SEQ ID NO: 20197 - DNA, 601 bp, Human
cacattcacaaaagaaatggatctaaattatcattcattaatcacttttctgtgttttacagtgataacatattaaaaagtcagcattagaaaagtattagcatatgcagcaattaatacaagtgttacagagtatgaataattgcagatatatttgtgcagtgacctgaacaactctccttaatggagtttggatgcttatgggatattgagtgaatgggaagatttgatgagaggtcagagaagacataatagtgggaatgtccttgataaaaaaagagttgcaggtgatagcagatcrgcagccagatgggctagcattcttcagacagggatgaagcagatctggtatgagggtggcagagaaacaatccctttggtaactgcagtagtattgaggttctttaaatcatcaacagatttcaggttaaagttctgtaaaattgtggttagaaataaaaatagctccatgcgggcaagtccttctcctgcacaaattcgttttcctgaagataacaaagaaaggaagtagttactccttgtgtttaactgtgactgtgacaaacagtcatttgtgacttgcacaaacagaatatgcagt

SEQ ID NO: 20198 - DNA, 601 bp, Human
ttgattatgaggtgagatggtcacatggggatgaagtaattctttaacataacatttgtatgtagaagtacagtacatttgtatgtagaagtacagtatacggagataagaatttacaatatagtgtgtgcgtcagtaatttctaacagagccttaaaacagaaacacaatctttccataacctatgattagcaagatattaatcagcagtaacaattgcaacaaaagctggttacaaacaatccatggaaataggatgtgaagctagacaaccagttagaccagaaattctcagaagggmgtatgccttaaccctaaagaggcctagaagagccatggcaagatgagggcatttatagccctatcttatccatatggacaggtgccccccatgcgtccatttataggttctccacaaaggtcgcattccattcccagagctatgaacatctgcttttctgggataggaatcttggtgatgtgaaacctctctgactgcacgtccattcataggctctctgcagggggaagcacatcacgcgctgttggctcattctggcagtccagcctggcactgtccttacacaatcctgcatgcaat

SEQ ID NO: 20199 - DNA, 601 bp, Human
aggtcagaagatgtataagtattagggttttttctcaagtgaaagatggtttagcagtgttaatatgatatgtgaacacccctcgttgtgtaataattaccatatacagagagtaaagggctgcaattagtatattaagtcttataagcatgatggtatgattagatcaagagaatgacgctgtagttatgaagactactcctactagattgatggtagggggcagggcaaggttggcaagactagctaggagtcatcacatggctatcagggagagaagtgtttgaaggccttgtgttastagtatggtttggctgtgaactcgtttgtagtttgagtttgcaaggcagaataatagggatgaggttagtctgtgggcagttattagggaagttgcactggtaaaacttcagggggtttgaatgagaaaagctatgataacaagtgccatgtggcttatggaaaagtaatgagtgattttagatcagtttggcacagacaaaaggagcttgttatgattatttctcaaaaggatagtaagaaggaggaataagctataaactctgttagggggttaagaattaaggtgatttgtataatc

SEQ ID NO: 20200 - DNA, 601 bp, Human
taagtcttataagcatgatggtatgattagatcaagagaatgacgctgtagttatgaagactactcctactagattgatggtagggggcagggcaaggttggcaagactagctaggagtcatcacatggctatcagggagagaagtgtttgaaggccttgtgttagtagtatggtttggctgtgaactcgtttgtagtttgagtttgcaaggcagaataatagggatgaggttagtctgtgggcagttattagggaagttgcactggtaaaacttcagggggtttgaatgagaaaagctaygataacaagtgccatgtggcttatggaaaagtaatgagtgattttagatcagtttggcacagacaaaaggagcttgttatgattatttctcaaaaggatagtaagaaggaggaataagctataaactctgttagggggttaagaattaaggtgatttgtataatcctatagccatctaattttaggagtactgctgtgaggactattgacctggcaattgcggcctctatgtgggcttttgggagtcctaggtggagtccatagagagatatttttagtataaatgctatgatgcatgct

SEQ ID NO: 20201 - DNA, 601 bp, Human
caaggttggcaagactagctaggagtcatcacatggctatcagggagagaagtgtttgaaggccttgtgttagtagtatggtttggctgtgaactcgtttgtagtttgagtttgcaaggcagaataatagggatgaggttagtctgtgggcagttattagggaagttgcactggtaaaacttcagggggtttgaatgagaaaagctatgataacaagtgccatgtggcttatggaaaagtaatgagtgattttagatcagtttggcacagacaaaaggagcttgttatgattatttctcawaaggatagtaagaaggaggaataagctataaactctgttagggggttaagaattaaggtgatttgtataatcctatagccatctaattttaggagtactgctgtgaggactattgacctggcaattgcggcctctatgtgggcttttgggagtcctaggtggagtccatagagagatatttttagtataaatgctatgatgcatgctaatcataaaaggctattaaaccaggaaattgttagttcttgaagctgggtattggtcttaaggtagactcgaaagtgctgataaatttctcaa

SEQ ID NO: 20202 - DNA, 601 bp, Human
tgggagtcctaggtggagtccatagagagatatttttagtataaatgctatgatgcatgctaatcataaaaggctattaaaccaggaaattgttagttcttgaagctgggtattggtcttaaggtagactcgaaagtgctgataaatttctcaagcatcagtgtttgaataagcggagtttcaaattttggtctgctgtacattagctgtgagacactgaaaatgaatttgtcattctctgagctcagttttttttttttttttttttttttttgagacagagtcttactctgtagctcakgctggagtgcagtggtacaatcttggctcactgcaacctccatctcccaggtccccattcaagaaattctcctgcctcagtcccccaagtagctagcattacaggcatgcaccaccatgctcagctaatttttgtatttttagtagagacgtggtatcaccttgttggccaggctggtcttgaactcctgaccttgtgatccacctgccttggcctcccaaagtgttgggattacaggcaggagccaccacacctggccgtttgtttaaaatagagtaaatagacctgctgaatatgttg

SEQ ID NO: 20203 - DNA, 601 bp, Human
gaaattttggcttagaaatttatgttaattattttttttccatggccaactctactcatctatgaagttttacaatgaatctgtttatcagcttggataccaaattaccttgtttttaaattctgttttcccaatgaagttaaagactgaaaatcagatttatctgtgaatgacacacacaaactaacagatttccaactgttcaatgcctggccattcattcagagtacttttgattaaagtcactatttagggcctatagatatcaggggaaattcagcccctgatatttcaatgtgartccttttctattctccctaagtgttggctggtctgagaaataaagggaaagagtacaaaagagagaaattttaaagctgggtgtccaggggagacatcacatgtcggcaggttccgtgatgccccctaaaccacaaaaccagcaagttttcattagtgattttcaaaagcggaaggaatgtgtgaatagggtgtgagtcacagagatcacatgcttcacaaggtaataaaatatcacaaggcaaatggaggcagggtgagatcacaggaccggagtgaaattaaaattgctaatgaagtt

SEQ ID NO: 20204 - DNA, 601 bp, Human
gaaattcagcccctgatatttcaatgtgaatccttttctattctccctaagtgttggctggtctgagaaataaagggaaagagtacaaaagagagaaattttaaagctgggtgtccaggggagacatcacatgtcggcaggttccgtgatgccccctaaaccacaaaaccagcaagttttcattagtgattttcaaaagcggaaggaatgtgtgaatagggtgtgagtcacagagatcacatgcttcacaaggtaataaaatatcacaaggcaaatggaggcagggtgagatcacaggacmggagtgaaattaaaattgctaatgaagtttcaggcactcattgtcattgataacatctcatcaggagacagggtttgagagaagacaaccagtctgaccaaaatttattaggcaggaatttcctcttcctaataagcctgggagcactatgggagaccaggccttatttcatcccttatctacaactgtaaaagacagacgttctcaaaacagccattttagagaccaccccttgggaatgcattcttctcagggatgttccttgctgagaaaaagaattcagtgatatttctcctactt

SEQ ID NO: 20205 - DNA, 601 bp, Human
ttaaatttcatatgaagcaaaaaaagagcctgtatagccaagacaatcctaagcaaaaacaaagctggaggcatcattctacctgacttcaaacaatactacaaggctacagtaaccaaacagcatggtactgggaaaactggctagccatatgcagaaaacagaaactggaccctttccttacaccttatacaaaaattaactcaagatggattaaacacttaaacataaaaccaaaaaccataaaaaccccagaagaaaacctaggcaataccattcaggacataggcatgggccaagwgtttgtgactaaaacacaaaaagcaatggcaacaaaagccaaaattgacaaatgggatctaattaaactacagtgcttctgcacagccaaagaaactgcatcagagtcaacaggcaacctacagaatgggagaaattttttgcaatctatccatctgacaaagggctaatatccagaatccacaaagaacttaaatttacaagaaaaaaagaaatatccccatcaaaaatggacaaaggatatgaacagatgcttctcaaaagaagacatttatgcagccaacaaacatatggaaaaaag

SEQ ID NO: 20206 - DNA, 601 bp, Human
agaatgttgagaaatatgaaccctcttacactgttggtaggagtgtaaattagttcaaccattgtggaagacagtgtggtgattccttaaggatctagaactagaaattccacttgactcagcaatcccattactgggtatatgcccaaaggattataaaccattctactataatgacacacgcccatgtatgtttatgtggcaccgttcacaatagcaaagacttggaaccaacccaaatgcccatcaatgatgtactggataaagaaaatgtggcacatatacaccatggaatactacrcagccataaaaaaggatgagttcatgtcctttgcaggaacatggatgaagctggaaatcatcatcctcagcaactaacacaggaacagaaaaccaaactccacatgtttgcactcataaatgggagttgaacaatgagaacacatggacacagggaggggaacatcacacatgggacctgttggggcacggggggccagcagggggacagcattaggacaaatacctaatgcgtgtggggcttaaaacctagatgacaggttcataggtgcagcaaaccaccatggcacatgtatacctc

SEQ ID NO: 20207 - DNA, 601 bp, Human
gacctgttggggcacggggggccagcagggggacagcattaggacaaatacctaatgcgtgtggggcttaaaacctagatgacaggttcataggtgcagcaaaccaccatggcacatgtatacctctgtaacaaacctgcacgctctgcacatgtatcctggaacttaaagtaaaataaaagaaaatttaaaaaatataaagtttatcgatcacttgattataacaacttcatttcagagatcctccaccaaacaagaaaacttttcctataatttaattcatttagctattaaatgatasgctgggcctaatcaatatcaaattaaataggttaaatttgcaggatgattagagatgagggcatttagttcctaaagaagaaaattcattttaaaaaaggtacagaagaaaaaaactccacttatcaatttacactttcttgtttgccttacctgggatttatatttaaaataaaagtttttggccaggcgcggtggctcatgcctgtaatcccacaactttgggaggccaaggctggtggatcatctgaggttgggagttcgagaccagcctgaccaacatggaggaacctgtctctac

SEQ ID NO: 20208 - DNA, 601 bp, Human
atgttttttctgctaaactccaaagccctgtttctgtaaagtactttgttgacagccctaaagcgtgctcatagcactccatggatatccaggcactttggaggctcccattactcacaagacttgtccttcaattaacactttgtcgtattatgtggcagaaatatcctaatttaaaagacattatctccttctagtagggagaatatttgggaccatagaagctgccaagaaacactgaatagggcaggggtgtttgatatctcagttgggatcctagctgatgagatagctgggttargaatgacaaaattattggttttatggtgtatgaaccataaacagacatcacacttataccctgtgctgagctggcatgttttattctctgcctaaataataattgtgtgattttatagaagtcatttaactgctctggtgcacagttggaatttgaagtatctttgagcccctcccacttctaaaatactaattccatttcagaggctgcttgatagaaatcaatatagtagggactagctttgtactatcaatcaggttgtccaaattcttttaacctatgctgtcatctacaaaacgt

SEQ ID NO: 20209 - DNA, 601 bp, Human
ggtcagaattttctttctcaaatcttttataatcagagaattactacatatgtacaataaaaatttccccatcaagatatacaatatattttatttatatttatagctgtaatttacaaccagagcttggtatatggtatgtatgcttttattaaaatcttttaatttaataaattattgttttctcttagatctgcaataatttttctcctatcattgattacttcccgggaactcacaacaaattacttaaaaacgttgcttttatgaaaagttatattttggaaaaagtaaaagaacrccaagaatcaatggacatgaacaaccctcaggactttattgattgcttcctgatgaaaatggagaaggtaaaatgtaaacaaaagcttagttatgtgactgcttgtgaatttgtgatttgttgactagttctgtgtttactaaggatgtttaactggtcaatcagtaatgcttgagaagcactttaagtttttattgtatgaatgaataacaaaatagaccactagctagactaataaagaagaaaaaagagaagaatcaaatagacacaataaaaatgataaaggggagatcaccactg

SEQ ID NO: 20210 - DNA, 601 bp, Human
aattcactgtaatcaaatatgctggtaaataatttgtcagataattgcatcaaatcattcctaggaaaagcacaaccaaccatctgaatttactattgaaagcttggaaaacactgcagttgacttgtttggagctgggacagagacgacaagcacaaccctgagatatgctctccttctcctgctgaagcacccagaggtcacaggtatgatcagagatgataagttaattaattttcagaaaagattttgggaaggtgttgctagtgtcctccttcctgtttctcttagagaagcttcrttatttaaacttttgtgcttccagctgtaatctgtttcaaactaatggtgattacaatgggatatcttggcctggcatggtggctcacacctgtaatcccagcactttgggaggctgaggtgggtggatcacttgaggctaggagttcaagaccagcctggccaacatggccaaatcccatctgtagtaaaaatacaaaacttagccaggcatggtggcacatggctgtaatcccagctactcgaggggctgaggcactggaatcaattgaacccaggtggtggaggttgtagtgagcca

SEQ ID NO: 20211 - DNA, 601 bp, Human
gagtgagactctgtctcagaaagaaaaaaaaagaaaaaaagaaaaagaaaagataaaaggggcatctttgcacagtagaggaagataactgagagaaatgaagacagcatggcagtagcaaaagcagtagaactctggtccaatgtgtctggatttatggcaggaagagacaagataaattggcctgggattgcatgttggttttattatgagaaggccattttaaatagcaagtatattcttcaagataacttttctcattctcaaaatttcaggttcgaatgctggagtagggaaactkgaaactctccttattgaaggataaatggtaatcctaaaaatgtagtgatctgcctgagaaaattcctagtccaataagtactctaaaaagttagattcataagaaaggtgattctgtttactagaagaggtatataaagaatgttccatttaggcagaatatgtacctgagacagtttccatgaaactgttgttgggcaaaataagatttttttgaggaagtcaataattttatcttttatgaacaactttactttagaaatttacttttaaggacttttggttatgctgcagataagaa

SEQ ID NO: 20212 - DNA, 601 bp, Human
atcatgagaaaaatatggaggaaaccacccccatgattcaatgatccctacctggcctcccccttgacttgtggggattatttcaattcaagatgagatttggggtggggacacagccaaaccatatcagcccctttgtcaaaaatgagttaactctagatacgtgaacttgtttctgaattctctattctgttccattggtccatgtgtttgtttttatgtcagtaccatgctgttttagttagtatagctctgtagtttaatttgaagtgagataatgtgattcctccagttttgttcyttttgcttaggatagttttgactattctgggtcttttgtgggtccatatacattttaggatttattttttctatttctgtgaagaatgccattgatattttgataggaattttattgaacctgtagattgttttgatagtatgggcactttaacaatattgatttttccaatccatgaacatgaaatatttttctgtttgttgggtcctcttaaatttctttcctcagtgttttatagttttcattatagagatctttcaattctttggttaaattaatcctaggtatttaaaattatgt

SEQ ID NO: 20213 - DNA, 601 bp, Human
ttttggtatcagggtaatactggcctcatagaatgagtttggaagtattctcttctcctttattttttggaatagtttgagtagggtcggtattagttcttctttaaatgtttggtaaaattcagcagtgaagctagccagtcttgggattttctctactgggatgattttatttctcgtttgatctttgtgctggttattgcatgttcagattttggatttcttcctggttcaatcttgatgggtcatatttgtgtagggatttgtccatttcttctagattttccaatttattggcatrtagttgctcatagtaaccaataattattctttgaatttctgcagtatcagttctaatgcctcctttttaattttttatttatctgaatctactctttttttttttcttagtctggctaacggtttgtcaattttgtttaacttctcaaaaaagcaactttttgtttcattgatcttttgttttgttttcttcacttaaattttatttatttctgctctgatctttattattccttttcttctactaattttggttttaatttgcttttgcttttctaattctttaggatgcatcattaaa

SEQ ID NO: 20214 - DNA, 601 bp, Human
ttgagaatcacatttcaacatgagatttggaggggacaaatatccacacaacatcagattatatatattgggcttacatttctcactaaatagaaataagtatgcacatagagatgaactggccttcttcatattgtttaggacttcagtgtttacattcacaagagatttggtttatagttttatttctcagaattttcaagatttttgatattaagattatgccagccttataaaactatgcaagaaatgtttcctaatgtgagactgtttttattgccgttccctctccccacttttyttcttgtgatcacttagttgtatctttgaaatgcctgataacttttggttaaataccagatggtatatgtaagaaattgcagaattgcagaggaggtttatattcttcaaagaaagattcattcctctcccatcggcagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcac

SEQ ID NO: 20215 - DNA, 601 bp, Human
ttcaacatgagatttggaggggacaaatatccacacaacatcagattatatatattgggcttacatttctcactaaatagaaataagtatgcacatagagatgaactggccttcttcatattgtttaggacttcagtgtttacattcacaagagatttggtttatagttttatttctcagaattttcaagatttttgatattaagattatgccagccttataaaactatgcaagaaatgtttcctaatgtgagactgtttttattgccgttccctctccccacttttcttcttgtgatcayttagttgtatctttgaaatgcctgataacttttggttaaataccagatggtatatgtaagaaattgcagaattgcagaggaggtttatattcttcaaagaaagattcattcctctcccatcggcagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcacatggtttctgtat

SEQ ID NO: 20216 - DNA, 601 bp, Human
agaaagattcattcctctcccatcggcagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcacatggtttctgtatttatccagacactccatttgccatctcaaacctactcttttccaatcaaaaccaatatatattattagtaaaataaaaaataatataactgaaagttgtattttcaaggggaaaaagcaatgagacttggtaaggttgcaattactaatgtcatcttttgaagaagacagaattgataatttacttagagattatggggcttaccctagtggtcactgagttagtacaagagaaaagacttcaatgcactctgttttcacaaacacaggagataaccaggagactttcgcttctcaaaattagggtctgagggtaatggtaatgaaacttacttcttctcctataactaattaaatgagaaatatactgaagaatcaggcacgagttgccagtctccc

SEQ ID NO: 20217 - DNA, 601 bp, Human
cagtcataatgacatgatacctgttgtcatgattcagaattggacataatgtgaatccagttgaaaattgagtgtcagtgttagcttagctctctgaggttctcctacctttggaagcttgagaccaatttttgtcttgacagctttgcagtgccttctatcacatggtttctgtatttatccagacactccatttgccatctcaaacctactcttttccaatcaaaaccaatatatattattagtaaaataaaaaataatataactgaaagttgtattttcaaggggaaaaagcaatgasacttggtaaggttgcaattactaatgtcatcttttgaagaagacagaattgataatttacttagagattatggggcttaccctagtggtcactgagttagtacaagagaaaagacttcaatgcactctgttttcacaaacacaggagataaccaggagactttcgcttctcaaaattagggtctgagggtaatggtaatgaaacttacttcttctcctataactaattaaatgagaaatatactgaagaatcaggcacgagttgccagtctccccagttcactgcatcagctttggtgac

SEQ ID NO: 20218 - DNA, 601 bp, Human
agatacatgtgttcttctgctacaggctggatccacttatctagctggagatgatagtctgagacaggagttggcaaactgtctctgtaatgggccagatagtaaatattttagacttttcaggcaatgtggtttctgttgcaattcttgacatctgctattgtagcatgatagcagtcacaaacaatctgcaaatgaatgaggattgatatgttccaatttttatagaaacaaatgtaaatttcctataaaatgtttgtttcaaaaatattgtttcttgtttgcatttgttcaatgtaartacttttagctcacatactatacaaaaacaggtggcagggtggacttgtgcagggagtattttttattgatgcctaatataagacatccctgtccagtagaattttctgcaaagatgtgcgattgatttgtgcttttatgtcatatttaaagaatatttgtcagcacaagattccaaagactggctttcaactttcccagaatttttttgttttagctcttatatctagatcaatgacatatttcaaattaatttttatttcataatatgaagtaatagtggtcatgcttcaatgtctat

SEQ ID NO: 20219 - DNA, 601 bp, Human
tcttgtttctagggcacaaccatattaatttccctgacttctgtgctacatgacaacaaagaatttcccaacccagagatgtttgaccctcatcactttctggatgaaggtggcaattttaagaaaagtaaatacttcatgcctttctcagcaggtaatataaatttatttccatttgtgtttcagggtacaagataacttttttgatccattggaacttacatgtgcctcctctgcagtggtacaattactctttgtacatgatcaagagcactgttctgaatgcctgtgtacaccctgytcatgatacatcctaattattgggccagattagtggactttggggagttaatccaattcttccaaattgagaaagctgaaatataggttggttgaattctgcctctaggtacaccagtgaggtacccaagaactcctcctggaagataaaactaattacattttcctcactagccatgaggaagttatctcactccagaacttcactgagtgtcttccacatggtgtccctcaccccctaggctgggcttgtaggataaaattatccacaaacacagaatagggtcttaaaaggctcact

SEQ ID NO: 20220 - DNA, 601 bp, Human
atgacaacatgcaaatagtaaacatttaataatattccatccctagaaagtgcaggtggaatcatgccagttaatgggttaggaaatgaaactcaaagtgggttttaccaggttaccagcgttagccacacctcttcctgcccttcatcccccaccccacccacgttgccggaacgtcccttgtgctgcagaacagagttagggtcaggacacgctaggcaccttctcccactcctaccagctgaacctccaggtgcgactgctcgaagtccacaaggaagaagttgccaaggaagggcargcgccagggccccggcgggtagttctttgggcgccgtcttttgagaaagtcagcagcgagcagaaaggcgacagtgcccagtaggagagtccgaggatggaccactgcccagagggcagccgccagagagcccatcgccgcgagcatggctcagacgtcctcctgctcttctgcggtccaagcaggcggcggtcccagcaggcgacggtccccgccccgcctcgctcccagccgtgccccgcctcccagcccgccccttcgcagcaccctgcgaagatgccaggcgctggattcccggga

SEQ ID NO: 20221 - DNA, 601 bp, Human
ccaatctgttcatgccaatctgttctatcatagaccagaaggctcaagatcctctgtgtgacacaaccttaatgaaagagaataaggaaatagagacaggaagaagcagcagcaggaggaggaagatccacatccattttcctaaggagagagggttggaagaggaaaacagagagaacacgttcctctgctataaatgggtaacatggttacttcattataaaagcatccagagtaggtttgggcagggcatgtggtttctcccaaatcccagtgagggatgatcttatcaaatcttctsagggagtgacttcaatcaggaaatgtgaatatccagctttctttagtggcaggaagtttattatggggctggtttctaggagtgttggaaaattacagtcaccaaggtgcctttaacagattataggactatcaacatcaaacactcacctttcgttggccaagaaacttaccatttttcttaaagatatgttctcgcataggggtcacggggcggttcccaaagttttggtccatgtggataagggcttctttgattaagggcaagccagtaataagaactgcagatatgtcaccaagc

SEQ ID NO: 20222 - DNA, 601 bp, Human
gccattctctagtcttgataaaccaggggcgcaatgcactgtgaaaagctgcagggacctctcccctggaagccgggtattgtccaaggtttctccccatgtgatagtctgaaatatggcctcatgggatgagaaagacctgaccgacccccagcctgacacccgtgaagggtctgtgctggggaggattaataaaagaggaaagcctcttgcagttgagatagaggaaggccactgtctcctgcctactcttgggaatggaatgtttcggtataaaacccgattgtacatttgttcaatkctgagataggagaaaaaccaccctatggcaggaggtgagacatgttggcagcaacgctgctctgttactctttactctactgggatgtttgggtggagaaaagcataaatctggcctacgtgcatgtccaggcatagtaccttcccttgaacttatttgtgacacagattcctttgctcacatgttttcttgctgaccttctccccactatcactctgctctcctgccgcattcctcctgctgagatactgaaaatagtaattaataaatactgagggaagtcagagaccggtgccagtg

SEQ ID NO: 20223 - DNA, 601 bp, Human
gattgaactcacagttttctccatatgacttttcacccatgcccaactaaaccaaataccttatactcttctaagtgttccttctttccatcatctacccatttgagtgtcacctcaacacctccttctccctgcacctacatcatcatgtcttaagaggtgtaccttcctggatatctcaaatccaggtcttcactgctactatcttggactaacctactgttatttccctactgctattggaccttcctagcctgagctaccactgtctgtaacctaaaatgctacaaaagtcccttgytccttttcttctattctctgaatggcagcctaaataaaacctaaaaatatacagtgtaaatataattcccttctctacttaaagccattcaagagcttccattaatgttaggataacaactagtgtccttaacaggaacctgcatgaactattcctagccaagctcagtagcttcatctccctttaattatctccttttaatccccatgcttgtcatgttggccacctttcatttcttcaagttccctgtccttttcatttcaggggcttttcattttctattctgtctgccagattgtt

SEQ ID NO: 20224 - DNA, 601 bp, Human
tcactttgctgacttaaaggtattttgaattcggcatatccatgattgaactcacagttttctccatatgacttttcacccatgcccaactaaaccaaataccttatactcttctaagtgttccttctttccatcatctacccatttgagtgtcacctcaacacctccttctccctgcacctacatcatcatgtcttaagaggtgtaccttcctggatatctcaaatccaggtcttcactgctactatcttggactaacctactgttatttccctactgctattggaccttcctagcctgrgctaccactgtctgtaacctaaaatgctacaaaagtcccttgctccttttcttctattctctgaatggcagcctaaataaaacctaaaaatatacagtgtaaatataattcccttctctacttaaagccattcaagagcttccattaatgttaggataacaactagtgtccttaacaggaacctgcatgaactattcctagccaagctcagtagcttcatctccctttaattatctccttttaatccccatgcttgtcatgttggccacctttcatttcttcaagttccctgtccttttc

SEQ ID NO: 20225 - DNA, 601 bp, Human
agagatcaaggaggagtgaaagttccatacagaaagaagagtacaagcaaagaaaaaaaaattttggtgtgtttgacagaccatcatttgttttataacacaggtaatgccatactcctttcaatttcttcaattccagagcactcctcaacaccttttaatatctgactatggcctgctcacccactgaattggtccggataccttttgacctcgtcttacttgcagcagcagtagacacttctttcttgaaatactgccttccagtggtgctcaggataccactgtctccagattttcktcctaattctctgccagcaacttcctatatattttgctggttcatcttctattaaatcttgaaatggtggagttcttcaggaacttcttcttcatctaaaacctcttctttttctcaccctatactctatttctgggaaatcttatcaactcctaaaattttaaataacatctattgatagtgaccatctatttctgtccctgagctccagaagcatatatacaacgctgcctgcctcactttgctgacttaaaggtattttgaattcggcatatccatgattgaactcacagttttctc

SEQ ID NO: 20226 - DNA, 601 bp, Human
gatgatgtaaggaatcaagagatcaaggaggagtgaaagttccatacagaaagaagagtacaagcaaagaaaaaaaaattttggtgtgtttgacagaccatcatttgttttataacacaggtaatgccatactcctttcaatttcttcaattccagagcactcctcaacaccttttaatatctgactatggcctgctcacccactgaattggtccggataccttttgacctcgtcttacttgcagcagcagtagacacttctttcttgaaatactgccttccagtggtgctcaggataccmctgtctccagattttcgtcctaattctctgccagcaacttcctatatattttgctggttcatcttctattaaatcttgaaatggtggagttcttcaggaacttcttcttcatctaaaacctcttctttttctcaccctatactctatttctgggaaatcttatcaactcctaaaattttaaataacatctattgatagtgaccatctatttctgtccctgagctccagaagcatatatacaacgctgcctgcctcactttgctgacttaaaggtattttgaattcggcatatccatgatt

SEQ ID NO: 20227 - DNA, 601 bp, Human
agggccatataaagcagagcccatcgcagagttgtggaagttgtctcggttccggcaaagaagaggtccagggtgctgcagatgaggttttcttcatggaaacttgaagtaggattgcctgtgtgctagaaaacacaatgtttgatgttatttattggtttattcagaggattcctgattgccgtaacacaaaggggcttcatcctaggaggacatttggaagaaaaggtccccaaaagaaacaattttccctttggcctcttcagaaggcagactcttattacagcaatatcattagcaytgtcctgccccaagtgctggacacctttggatggatgaaaatcaagacaattattttcttatgcctataattttggggaagcttttagtacagtgaaaggagaatgggatgtgaacgagacagatttggcttccaatattaaccacttcaattagcagctgtgtgacctagggcaagtcacttaacctctctgttcttcagtttcctgttttatatactggaaataggagtgcacacctcttaagagggcattatgaattatatgaatgcaaggacgcagagcaaatactcaacaaacat

SEQ ID NO: 20228 - DNA, 601 bp, Human
gtattgttaagagttcccacccccatatgttcaaacttttctggaagctggaggaagaaaaataatgagaacatcattcttgagtggactatagtctgtggggaagctatatatagataatacatgataagcctagtaataaaggcacattacatcatctctggagggagaaaatgctaataatttcctaggggagcacagaaacatcttagagaggtagtacttgaacagattcttcaagaagagctaggagtttactatgtaggaaaactgggcaagtagagggaaaagcatctatcaygacatagaggcataaatatagactgcaaagaaagtgacgtgtcacttagtgaggccaccatggagggtaggtgcggccaaggctagacaggcagaaggggcatatcggaggttaacatataccagactaaagtgcttgaacattattctggaggaaattggaaggcatcacttaaaagaagggaaggacacaactagactttcacatcagaaagttaactgtttcctggaactatctcaatgtcgactgacttcgttgatttccctcttgcctctgagcttcttgaggacaaggattctc

SEQ ID NO: 20229 - DNA, 601 bp, Human
caagctaactcttgaagctaatcctcagctcaaacatcacttccttttggaagccttccctgaccactcctgctagtctgtttttacagaccacagtgagttttttcctttgggcagttatcacgtttctaaatatgtacttgcatgattacttttctcagggttgttttgccagacctgagcatttcaggtatgtagtgtttgttgaattcattcaaatattaacatattaatataatattacttcaaggaattaatatcaatgattgccaatattagtaataacttttttttttaatayagactctcactctgtcactgaggctggagtgcagtgtgtcggctcactgcaacctccatctcctgggttcaagcaattctcctgcctcagcctcccaagtagctaggattacaggtgcccaccaccacgcctggctagtttttatatttttagtagagacggttttcaccatgttggccaggctgatctcgaactcctgacctcaggtgatccacccgcctcagcctcccaaagtgctgagattacgggtgtgagccaccatgcccggccaataattgctattttaagcactttctgtac

SEQ ID NO: 20230 - DNA, 601 bp, Human
ctctttgtctgggacagctttcaaattagattggatttccctgctgggaattttaacaaggatgtctggctactcttgactgcaggatcgagcttccttacagggacaggtcagtttcagtagggcttggaaggagggggcatgaatgcactgatgagagaataatccaacagtcagtctgcactgtaccaaaaccagcccagctgctcagtgaagctataacgatggcagctctacaaaggtaaaagacatctcattcatcttggtttcaccattctctttcctccaatgtctagtacayggcaccccactccccatggtaggtttagtaatagaatcaggtagacccatgcaaggagcccctgtccatccaggtacatgctaagaaacacaggagttcccagagggagcttttcctttactctgtcgttatccaacccatcagtgagactggtcaattttactttcacctccattccatgtccaccaatgctcacttagtccagacttcttcctggcttgcctggaccactgttatagtttcctaactgtgccccaaatcctgtcacccctttcaatctgcttcacactctggaagaga

SEQ ID NO: 20231 - DNA, 601 bp, Human
ttctgtgtgagtgggcagcccttaaaaagaactgaggacattttaacatttagtaaggatggcagcacccgaccgggtgtggtggctcacacctgtatcccagcactttggctttgggaggccgaggcgggtggatcacctgaggtcaggagttcgagaccagcctggccaacatggtgaaacctcgtctctactaaacatacaaaaaattagcctggcatggtggtgcatgcctgtaatcccagctactagggaggctgaggcaggagaatcgcttgaacctgggaggtggaggttgcartgagctgagatcatggcattgcattccagccttgtgcaataagagtgaaacttcgtatcaaaaaaagaaaaaaaatggaagcacctaatcctctttgtgagctggtggtggagtctggatctctgtcaccagttttccagaggacagaacacaggaaagctgaaatctctagcagaggcaatgaatggagggcttaggaagtaagggcaggctgaagcaatgcccagccttggaaatcccagggctgccccctacagcaagatggagtgagtcgcactggccaggctgtctggagacatt

SEQ ID NO: 20232 - DNA, 601 bp, Human
taataatatgtagaaatcaagatctgggcattaggcatgctcattgctctccagatgttgttgcccctagcttatatcagtgggcagagctaagaaatatatgtatgtatataatgtgggtatatgtccaaaagtgtgtgtgtgtacatatataaaatatatatatatatacacaccaagtatatatatatatatacaccaaatatatatacccatatttacatctacatttctacatttattgattcacctattgaaaatctgagttcattgtagattacatcagattccaatccaacaycacaaagttcgattttctccctttctttatttgcaacttcctctcattatcctcaatatatttacttattggatcagtatcccttgtatataacttacctctcatcactgccacagccaccctgtgcagactccacctcataccatttgtgctctgaggccagcactcagcttccaccaccccctcccctatgtgaatgtcctcctcaccccacctgggctacattaccccacacaagtcactaccaccatctctattgtgtgtatttttagtagcttactttctccctaagtagtacct

SEQ ID NO: 20233 - DNA, 601 bp, Human
tagtggataataatatgtagaaatcaagatctgggcattaggcatgctcattgctctccagatgttgttgcccctagcttatatcagtgggcagagctaagaaatatatgtatgtatataatgtgggtatatgtccaaaagtgtgtgtgtgtacatatataaaatatatatatatatacacaccaagtatatatatatatatacaccaaatatatatacccatatttacatctacatttctacatttattgattcacctattgaaaatctgagttcattgtagattacatcagattccaayccaacaccacaaagttcgattttctccctttctttatttgcaacttcctctcattatcctcaatatatttacttattggatcagtatcccttgtatataacttacctctcatcactgccacagccaccctgtgcagactccacctcataccatttgtgctctgaggccagcactcagcttccaccaccccctcccctatgtgaatgtcctcctcaccccacctgggctacattaccccacacaagtcactaccaccatctctattgtgtgtatttttagtagcttactttctccctaagt

SEQ ID NO: 20234 - DNA, 601 bp, Human
catcttcccgaggtcccattcagggttaccagttgtcccaaagtccttcattagaaaagggtccagtacagccagtacatgatcatggattgcatttagctgtcatgtcgccttagttcttcagtctggaataagtcctcactctttatacaactttcacggctttggcctttttaaagattacagaccagttgttttgtaaatgcctctcatgcttcctcatgattggattcaggctgtggagttttccattttgggtaggaatatcaccaaagtgatactgtattcttctcattttatmctatcaagtgctatacaattgtgatgtgttacattattggtaatcacttgattaaggtggtgtctaccaagttctcttgtaaaattattctttttctctgtaactaataagtactttgagactatgtcaacaaaccattctcattaagctgtgatccattcttttccattgctatttcttgaccatatatatttttttgatttatttttatttttatttattattattatactttaagttttagggtacatgtgcacaatgtgcaggttagttacatatgtatacatgtgccatgctggt

SEQ ID NO: 20235 - DNA, 601 bp, Human
gcttctcccacctcctaaccacgtgattggggcaaattaaacaacctctctaggaatcagtgaaaatgtacattgtgcatattagtgaaaacgaatatgtgtttaagatgagaactttatatattgtgtgagctacatgctgaatccaaataagctaaataatttaataatttatacctcaaaacaaagtattttaaaatgtcacctaggtaataataaacataactgtacaattgcttattattaacttgatctggttaattctcaaaaaacaggagaatacaatttaaaagatgacctytaaagaaaatcttttgggtggtagcattactcaaacagctttctgtatattacaattctttactgtgatactttccataacaagccttttattctgaaataatttcaaatgtacaaaaaacttgcagagatagacaaagaacttggctcttctaagttgtttggaagtaaattgtctacattacccatgaaatcttcagtatgtattttctaaaaagaaagacattctccaacatagtcaaaatgcaaccatccaagccaggaaattaacactgatgcatgaccaacatcttcccgaggt

SEQ ID NO: 20236 - DNA, 601 bp, Human
taaaaaaattgttgaaaatataaggaaataaatgtcagagcagagttcctaaggtataagtcatcttttccctgtgccacttttcctccttaatcatgggggacctactggcatgggtggccctctgtattgcgactgctttggccttcctccttcagtggttcttcttatgcacagtggccctttccctttgcaggcatttcttctgaagtgtggcccaaggctgggtcctggtctccacagctgacacctagcattgccctgaccttgtcccactccctgttatgtgtgggtgaactgraggcagaagggcagagattcaattcagcttctcccacctcctaaccacgtgattggggcaaattaaacaacctctctaggaatcagtgaaaatgtacattgtgcatattagtgaaaacgaatatgtgtttaagatgagaactttatatattgtgtgagctacatgctgaatccaaataagctaaataatttaataatttatacctcaaaacaaagtattttaaaatgtcacctaggtaataataaacataactgtacaattgcttattattaacttgatctggttaattctcaaaaaaca

SEQ ID NO: 20237 - DNA, 601 bp, Human
gcaggcgagcttccagaatgaagttgcagggtgtaggaccatagaagcggaaggcgtgggctgagctagaaaggggatgtttagcctaagagctttaaaaaaatcatttaacaaacgtgacaaaaaaagacaacaaaaacaaccaaatatgttcacttttttaatccttaaaaaaattgttgaaaatataaggaaataaatgtcagagcagagttcctaaggtataagtcatcttttccctgtgccacttttcctccttaatcatgggggacctactggcatgggtggccctctgtattgygactgctttggccttcctccttcagtggttcttcttatgcacagtggccctttccctttgcaggcatttcttctgaagtgtggcccaaggctgggtcctggtctccacagctgacacctagcattgccctgaccttgtcccactccctgttatgtgtgggtgaactgaaggcagaagggcagagattcaattcagcttctcccacctcctaaccacgtgattggggcaaattaaacaacctctctaggaatcagtgaaaatgtacattgtgcatattagtgaaaacgaatatgtgtttaa

SEQ ID NO: 20238 - DNA, 601 bp, Human
tctcagaggatcagtctgagacagaaacaagataacgcatgcacagtgctaccaaactggggagtcttcatagctcacttctgtggctgctcctagggcccacttttaactcttatcaactattttgcaccactttgacttgagcttctcaacaggtcagaagcaaacacatatctcacaaaggaagcaggaaggaggcacactatagatagaacttttatgatgtgttttatggtttacaaaccacttaaagctcaccatttcttttgattcttacaagaactttctttatggaaggaawcattatcctcttttcatctcctagataaaaaggtaaattatttagcatataaatgattttcccaaggctaattcggacgagacagtagagctgggatttggatctagttttctctgagtcaaattcctctgatctttcttgaaagtcactttcattttgtcccaacacatctgagcagacaccagtggtttcagaacacgtgccatgtcttcttactttccttgcccctttctttcttaacaatattacacctgaggaacagcgcagaggcggtgactgactggggaaatggtgataccc

SEQ ID NO: 20239 - DNA, 601 bp, Human
gccttaggtgtgtgcttatgtaaactacagaaactgtttcaatgacacctgctttccctgtctctaaatgaggaataaaacctgccctgctgacttctcagaggatcagtctgagacagaaacaagataacgcatgcacagtgctaccaaactggggagtcttcatagctcacttctgtggctgctcctagggcccacttttaactcttatcaactattttgcaccactttgacttgagcttctcaacaggtcagaagcaaacacatatctcacaaaggaagcaggaaggaggcacactayagatagaacttttatgatgtgttttatggtttacaaaccacttaaagctcaccatttcttttgattcttacaagaactttctttatggaaggaaacattatcctcttttcatctcctagataaaaaggtaaattatttagcatataaatgattttcccaaggctaattcggacgagacagtagagctgggatttggatctagttttctctgagtcaaattcctctgatctttcttgaaagtcactttcattttgtcccaacacatctgagcagacaccagtggtttcagaacacgtgcca

SEQ ID NO: 20240 - DNA, 601 bp, Human
aagataataataacttctatgcgtttgtagcgtccaacacttcagctacttctccttgaacatctcttttgatcttcaaaacagataagggaaaaggggcccgattagcaccccaagtccaaggaaacaaagagaggagtttggacagttactcacagatagaggagcaccaggctgacagccaggagaagccaggtttccaccgccaaatttgggatgaggtccatcgccactttccttcttcaactgtgttctgtgagtcttccttttagctgagtgctgctgtttgctgggctgtttrcctggagcttccctgccctgcacagcagtcttcagccaagctgctgaaagatttatgtgctggagaaggaggcagggctatagctgcagccaatagcaaagaatcgcacacacccctttgctgacctcttttgagttcatgttctatgaggaatcatgaaaagcttaatcagtgttatcggggagtccaagggttctgggttcttatcagaaactcaagtggagccattggcatgaaatctattaaccctcctctcacctgcccctccatggctgccttcattctagaataattgaaatc

SEQ ID NO: 20241 - DNA, 601 bp, Human
actgagtagctgggactacaggcgcatgccaccacacgcagctaatttttgtatttttagtagagatggggtttcaccatgttggtcaggctgatctcgaactcctgacctcgtgatccacctgcctcggcctcccaaagtgctgggattacaggcatgagccattatgcccagcctgtagtttgccattttaacttttgtgccaacctgataatatgaatatactagatatatattgcaatatacaagattgcaagatgttaccactgggcgggacaggatgaagagtacatggaacctycctgtacattttttaggtaaccttctgtgaatatatgtttttttcaaaataaaaatttaatcagtggatcaatcattatttaaatttcaaaaaatggatgcttacccttcgatttgtgaagacagaataacattctttcactagcactgttctgatcacgtcgggatctgtgatggccagcacagggagttgaccttcatacgttctgtgtggggacaacggagctgattaaacttcactagcccgattctgcagctggagccacacccaggaagccagactttgatcattatgttatgt

SEQ ID NO: 20242 - DNA, 601 bp, Human
ttctcaaaaacaatgtcaagtaccccactagttttatgttgttctcttttcttttataataaaaaatatcaaaaaagtagtgaagtttagctagatatgtacattttctgtatcagtgattgcaaacttggaacctgttcaatgattttgaaagaccctctgaatggggcagtgcataattaggattattatgcaaggacatttttgcttatctgtggtggtagatatataatgaaaactatacacagaccatttgtgtgtgtgtgtgtgtgtgtgtgtgtgtgtgtgtgtgtgtgtgtggattttatgtgtggcccacgacacttcttcttccactgtggcccagggaagccaaaagattggacacctctgctttaattcttatcaaaattatggcaggtttgtttgtagacacttacaagcttattctgaatttttatggaaaggcaagggacaagaaaagctaaagccattctgaaaatataaatcaataaagtggaaagaattgccctatatgatgttaagagttactgtacagctactagagtcaccacagtgtggtattagtggaggagtaaacaataagaaatagattcacaaa

SEQ ID NO: 20243 - DNA, 601 bp, Human
taaaattttatgctttggtgatggatgaaggcactgacactacagatacggcacaacttgctatttttattagaggtattgatgatgaatataatgtcactgaagaaatcgaaatgtcaccatgctattaaaagacacaactaaatcaagagatttatatgaagcagtgaaaaatatgttaaagcaattttctttgtcctttgtaaacatatgtgatatagctacagatgctgccctggcgatggtaggtaaaagagagggacttgtacaattaatagatgatgcagttgccacacaaaastcacatttgatgaagtattattgcataatacatcaagaaaatccatgtgcacaagctttaaaagtagataacgtcatgcaaattgtcatcaaggctgtaaatttcacaagggcccaggaattgaatcatcgctagtttcaggaattccttaaaagtatggatgctgactctagcaagtcattcactttttagaagtaagatggttaagtcaaggcaaaatgtaaagattttatgctttgtgatgtgaaatcaagctgtttatggtatcaaacaaaattggtgccagaacttgacaatgaa

SEQ ID NO: 20244 - DNA, 601 bp, Human
gctaactagaggtgggtagaggtagtcctatgagaagcagagaagctgagtctacctatctgtcacttacctggtcacctcctttatactacataatgcacaacactctacacagactctgggagagctcaatgaatgtacaaaatcaccaactactcatgcagtacattagattaagcccatctttatttcaaggttttattgactaagttgaaatctctggtgttctggggcacagctttcttgaagaccaaagtagaaatccttagaataactcattctccacttagggttccatctsttgaatccacctttagaacaatgggtttttctggttgaagaagtccttgcgtgtctaatttcaaggggatctacaatagttaaacaagcatatggagaattaataaatgaagtgaaagaagaaaagatggaagcaaagtagaaaaaatatgacaaaaatgctttgcaagcatataaaaacgactcttaacaccatgtatcttgaactcttcatacttaatctataagctgggtaaatactggatagtaaaagcactcaccatccatcgtttaacaaaatatttatggagcactgactctg

SEQ ID NO: 20245 - DNA, 601 bp, Human
ctcacaggatcagcagcccgtagccttctttgcggtagtcgcgataggccttccacggtttgatctccagccgctgcgggtacgcgctctcggtgcggtacagcgcttccagcaggcatggcgagcccaggtgcaccgactcaaaggaacccaacttcatgcggaaaatcttgccatacttcttgtggtactccacctgcagccggccgggcacagcgcggtgtcagcgcgcatcctccgccgtgcccgaagcgctttccctcctcccgcctccttcctcctaggggaccggggaccctcsctgcccagacgccgaagcgcaccatgcgcccgaggcgcgcatgtcggggagggtttggagcgccactgggagggcggaagagggaggagagagtcaggggcgcgaaaaggggtttaccagggtgtcgtgctgtttcttgagaccccctttccagagaatctgcagcaggctgcccagcagtggccagctggtggggcccggcagggcggccgcgttctgagtctcgccaccagctgtcagcgggcagactggcacctctcgcggctgaggggacgtgtacgccgtagatgtcaccagtct

SEQ ID NO: 20246 - DNA, 601 bp, Human
ttatctcatttaattctcacagcaaacccgtggggtgggaactgttactcccattttgtagatggggaaactgaggcttagggaaggtaagtggtatatagccaggtctcatagccagggagtggaaagctggggttcaaatccagggctgtagaataccaaagtccacactctccattgctccctcattgtgatatgactttaaaagagggtggaggagggagaaataagggtttggtggggaggaggctgtaggaaggaatggagagaaagagaagacccccactttgaatcacccgarttgcattcttttttcctttgttctttgtagctgtgacttgaagctccaccaatatccctatgtccccacgagccccaggaaagctggccccagcctgcagacctcattgattttgttgtccagcttcatcacttcccctggtttcattagtttcttttgaaaggcactccggacccgctgccagtcttccccttccctgtgagagaagcaggaatacatttagagcacactgaaaagaaaagaaggagatgcagaaatactccagctgcaacttcaggaaccataaaatcaaacaaacac

SEQ ID NO: 20247 - DNA, 601 bp, Human
ccgtgagctggtgtggccatacagcccacatgtgtggatttagtttgcaagtttaatttgcccgcatagcgcatttaaaagttctttgaatttgttaccattaaaaaaaacaagaggtttcatatgaacatatggatttaccactactagtttaaaaatgtaaataataattatgagacttggtgacatgaggtctgcattctgacatggcattcgtttgctggaactggggctgctgtccctcctgggaggggcatgcactatcacgtttcctgaaatttttactgggtctgccttattrttttatattagtcatgtgagccctggaagcttctgagtttgcaatccttcacctatatgatcccatctggggacgcatccagttcaaaataaacatccaaagtgaacagaagtaaaaagagattactttatgcttaaaactccctttgactccgtgctggctaagggataatgtccaaataccttagtataatacaaaaatattgttaagacctatccagtatcatttcagagaaagcctcacatcagctacactaaatgaccgattctctgaacacaccacgtcatttcatgcctccct

SEQ ID NO: 20248 - DNA, 601 bp, Human
caagaccttcaaagaaaacaaccgcaaaagacacattttaaagccgttgaaggaaaacaaaactttaaagctcactgagctaacttcaggtcttgctacatcgcatattcactggccataatgttattcatcctgaagtcacactaattatatattctccctgggaacccaccttatcccctaatgacctcgtcctgggttatttcctgagcttttcctgaagccaccctgaagcttaagtttcagcttttgatctaaaaataattctggcaatttaagaaaaggaaaacattttttttttctaatcagaatgggggaataaaaccacaaaggaatcagctaactgtccctgttggcccagcatctcaaggattgtgttgcagcagctatcctgaggtgtgcccttccacatctgggcaagcaaacgtctctttattggttggtggttatgttaagcatgttgaacttggaaccagaagatctaccaattctggacacagctccttccctaagtagtctatgaccttgggatagtcacataagacctttggatgccagtttcataaaccagagttttcaataactaatgcctcacatttaa

SEQ ID NO: 20249 - DNA, 601 bp, Human
agcaagtattcaacaaatgtttgttgtatgactcattaacaatccatagttcaaggcataacttaagcacctaaaagaagcattaaaagggctgctctggcctttccctaggcagcaataatgcctgtttacaaaagagttgtcaaaagagccatgttttatccgcaaaatcacctgcaaaatcagtgagcaagtctgtgacgacaacttactttcaaacgaccatttgttcagttcgctgtacaagtcttcaacgtggcctctttcatcacagagctcatctattctgcccataaaatcrgccaagaccttcaaagaaaacaaccgcaaaagacacattttaaagccgttgaaggaaaacaaaactttaaagctcactgagctaacttcaggtcttgctacatcgcatattcactggccataatgttattcatcctgaagtcacactaattatatattctccctgggaacccaccttatcccctaatgacctcgtcctgggttatttcctgagcttttcctgaagccaccctgaagcttaagtttcagcttttgatctaaaaataattctggcaatttaagaaaaggaaaacattttttt

SEQ ID NO: 20250 - DNA, 601 bp, Human
cttgagcccaggagttcgagaatagcctgggcaacatggcaaaacgctgtctctacaaaaaaataaaaataaaaaaattattcaggcatggctacatgtgcctgtagttccagctactctggaggctgaggtgggaagatctcttgggcccaggaggccgaggttgcagtgggccgagatcataccactggccactgcaccctagcctgagtgacacagtctggaaaaaaaaaattatacaggattactgcaaccaactttttagtggtggataattggctcttgacttataaagtaggaractagcattaaaaaggtaaacaaatggcctaaaatcataaacctgaggagtgagagtcaattagcttagtcagcacccacccacagcttttccaactacctccatgttttccaaactctacttatttcttcccagcctttcaaggtttccccgtatttgtgttccacagtggttggcaggtacaccactgggaatatgtgagatagctctggatggtacatgaactttaaaaataattagttactctgctgggcacaatggctcatgcttgtaatcccagcactctcagaggtggaggtg

SEQ ID NO: 20251 - DNA, 601 bp, Human
tataatgcacattaaaatgaacacttaactattgaaataaaatatgtgtgtatgccattttttgggaatcactgtgaagttctgtaaaaatcgatctgtaaaacatcaatcaagaaaactgctttcttaaagaggctgcttactgttttgatggccatgatgaagttcacagcttcatcccctgcattcttctggagaagcccaaatctcttctcatacaacacgaggcagatacctgtcatttaaaataatcatcactttacacaaacagcaatgctggagttggagtctatgtttagckggttattaaagactcaattctatgcctcttaaaagtgtgggattttctgagaaaaggcaacagtccaagaatattgaggaaaagcagagtctgagagaaaggggacaccatcactttctttttctagaaattatctccaggtccaatgactcatcacctcagagtgtcatgatcagagatccactgtcctgatcaagtcacacaggagatccaggggccctagcaaaggtgctgcagggtcgggtctgcactctgcctctaacccagctgtgtttttagagtcacttattggattctatc

SEQ ID NO: 20252 - DNA, 601 bp, Human
ctgggctggttctggctggttgtgaagggcggccctttacctgatttgaaaatggtgtcccaggccagagtgtggtcctgccagaccttggtgttgaggctcttgtgcagctcgactggagtgaccatcatcctcccaaacgtgctcatcatctgagagaaatgcaaatgcctttttattctgaattctccttctctcaaagacaatgttcgttctggaagaggaacattctaaaccgcagcaccctgcactttttaaaaggctggaattacaaggacacccccggctctctctgcaccgstcctgggagcaatgcccgtaccccacctccacctcctttcaatattgaaggtaatgtgggggatgattttccactggatgtgtttgataaaaattgtaatcttatgacctaattgtaaaaaaaaaaaaaaaaagaggaaaaacgataactttcatattcacttcaatttctaataatttccaaacttcagtgatttccaaaccaatttcacagcgtttatcctatctacacgccacccaaactattcaaaaagataaaatctgaaaaattttgggctctttttaaaaagtatttttaatc

SEQ ID NO: 20253 - DNA, 601 bp, Human
cactcttaattcccaaagaagactacagaaagcttgttacttagaatttgtgtatgctggggcaatccccaaaacacctgtgtttgcaaaacctaaatgtggtgatgaggctcaggagatcactccagacctcctctctgaagctccagacacgggggtgctgggctggttctggctggttgtgaagggcggccctttacctgatttgaaaatggtgtcccaggccagagtgtggtcctgccagaccttggtgttgaggctcttgtgcagctcgactggagtgaccatcatcctcccaaaygtgctcatcatctgagagaaatgcaaatgcctttttattctgaattctccttctctcaaagacaatgttcgttctggaagaggaacattctaaaccgcagcaccctgcactttttaaaaggctggaattacaaggacacccccggctctctctgcaccggtcctgggagcaatgcccgtaccccacctccacctcctttcaatattgaaggtaatgtgggggatgattttccactggatgtgtttgataaaaattgtaatcttatgacctaattgtaaaaaaaaaaaaaaaaagaggaaa

SEQ ID NO: 20254 - DNA, 601 bp, Human
ttacaggtgcccaccaccacgcccagctaatttttgtatttgtagtagagactgggtttcaccgtgttgaccgggctgatctcaaactcctggcctcaagtgatctgctcgcctgggccacccaaagtgctgggattacaggggtgagccactgcacctggccagattttacttttaaccactcttaattcccaaagaagactacagaaagcttgttacttagaatttgtgtatgctggggcaatccccaaaacacctgtgtttgcaaaacctaaatgtggtgatgaggctcaggagatcrctccagacctcctctctgaagctccagacacgggggtgctgggctggttctggctggttgtgaagggcggccctttacctgatttgaaaatggtgtcccaggccagagtgtggtcctgccagaccttggtgttgaggctcttgtgcagctcgactggagtgaccatcatcctcccaaacgtgctcatcatctgagagaaatgcaaatgcctttttattctgaattctccttctctcaaagacaatgttcgttctggaagaggaacattctaaaccgcagcaccctgcactttttaaaagg

SEQ ID NO: 20255 - DNA, 601 bp, Human
aggagtcacctaggcatcttctcaaaatgcagaatctgaatcagggcttgggtaggcctggaactctgcattcctaataagcttctaggtgatgctgatgccactgggctgcaggtcatagttttgagtagtaagagtttagatcttgggagaaaaaagtgtaaaagaaggtaggatttgggttcactttcagaatccaacttggacccagatattactaagcacacataccccacatacatacgcacaagtagagtgtccatccatgttgacaataatggtaaaaatttctaatatttakaacataaaatctaggcgtgtacctccctcactattaagcaaacaaccaccaggctcattatatggtaataatcatgctgatcacatatggcacagcagttagagttcgagtcctggaagctccttgtctggcttcaaaccttggctttgccatcacctagcatgcaatcttgggaacgttggctaacttctatgtgtctcaggtacccctctcagggctaataaaaggacctaccttataggtgtgttgtgaggattaactaaatgtgtaagtgaacaatgcctagcatcaaatattccc

SEQ ID NO: 20256 - DNA, 601 bp, Human
tcacaaggctctggctaacatggcccatccaattctccagtctcagctctgaccacatttactagttctgtagctccatccctctttctgccccagggcctttgcatgggccgtttcctctacctgcagcgctcttccacgaggtctttctgtggctggctcttctcattattccagagtcagctccagtactgctttctcagagagggcttccctttaatcatctccatctctctatattacaccatcctgatggcgtcctccacaatccacaccactatctaaagtgaccacatttgtwtgtttacatggctactgtctgtcttccccacttgcatacaagttccatgagagtgggaacccttgtctctggttcatggtggtctctcaagaacctggaacagtcccaggcatacagtaggcactcaatagttcctgaattccttcatttattcaacaagtatctatcagccgctactagatgccaagtactgttctatgtcctggaaacacagcagtggacaactctaagccattgccctcagagaggtcacgttccagttgaaaaaataaaagaataatgggtgacactgtactttga

SEQ ID NO: 20257 - DNA, 601 bp, Human
actagagaaaaaatattggtggaaacagccaatgtagctttaagctacataatattcaccactagtagtcatatgtatttattttttaggccgtactttgctaatttaagccaaatatttcctgaaaatgatcattgtgtccacctccgcagacatgaagacgctgttgctaagtgccatgtgccactcacacaaatgagcaccaagtgcaagaccattcagagatgatggttattttattatttttggaagaagatgcctccaaggcagtcttcttcatgtcagaggactggcagcctcrgctgcaaataaactgtagatgccattattataagagtctaatttacaaaacaggaagagggtgtagccatcaaattagatacactttcaaatggttctgattttccaaatgtgactttcagaatagccaggaccaaaaaagaaacagatttaaccatatcagtgagtccctcaccgcaagtaccaaatagagtttccaaagggcagatgactgtagcttttaccaaagccacgtaaggcagtctgagcctgtagggaaaactgcaggggctaagctgcagcagctgatttgaggggaagt

SEQ ID NO: 20258 - DNA, 601 bp, Human
ccacaccctaaaaagtcaccacaaaaataaacaggcactacctacactgagggttacaaccacatgtaaacagccctcatacgagggtgccaacaccaaaaataagaaattcaaacattgagctgagtactccagctacagtttctgacaaaggcccacacccttttaagtggcatcttttatttcctctgcacaggcaatgactagagaaaaaatattggtggaaacagccaatgtagctttaagctacataatattcaccactagtagtcatatgtatttattttttaggccgtacttygctaatttaagccaaatatttcctgaaaatgatcattgtgtccacctccgcagacatgaagacgctgttgctaagtgccatgtgccactcacacaaatgagcaccaagtgcaagaccattcagagatgatggttattttattatttttggaagaagatgcctccaaggcagtcttcttcatgtcagaggactggcagcctcggctgcaaataaactgtagatgccattattataagagtctaatttacaaaacaggaagagggtgtagccatcaaattagatacactttcaaatggttct

SEQ ID NO: 20259 - DNA, 601 bp, Human
aatgagaggctttaagagaatgttatagtggaaatggacaataaatggcatttctgaaatttaaaagttcctttggccacaccctaaaaagtcaccacaaaaataaacaggcactacctacactgagggttacaaccacatgtaaacagccctcatacgagggtgccaacaccaaaaataagaaattcaaacattgagctgagtactccagctacagtttctgacaaaggcccacacccttttaagtggcatcttttatttcctctgcacaggcaatgactagagaaaaaatattggtggraacagccaatgtagctttaagctacataatattcaccactagtagtcatatgtatttattttttaggccgtactttgctaatttaagccaaatatttcctgaaaatgatcattgtgtccacctccgcagacatgaagacgctgttgctaagtgccatgtgccactcacacaaatgagcaccaagtgcaagaccattcagagatgatggttattttattatttttggaagaagatgcctccaaggcagtcttcttcatgtcagaggactggcagcctcggctgcaaataaactgtagatgc

SEQ ID NO: 20260 - DNA, 601 bp, Human
ttgcttgatataaaaaacattcatataaaaatggagtaaacagagagggatggtgatcctcagggtgttgctaatgagaggctttaagagaatgttatagtggaaatggacaataaatggcatttctgaaatttaaaagttcctttggccacaccctaaaaagtcaccacaaaaataaacaggcactacctacactgagggttacaaccacatgtaaacagccctcatacgagggtgccaacaccaaaaataagaaattcaaacattgagctgagtactccagctacagtttctgacaaakgcccacacccttttaagtggcatcttttatttcctctgcacaggcaatgactagagaaaaaatattggtggaaacagccaatgtagctttaagctacataatattcaccactagtagtcatatgtatttattttttaggccgtactttgctaatttaagccaaatatttcctgaaaatgatcattgtgtccacctccgcagacatgaagacgctgttgctaagtgccatgtgccactcacacaaatgagcaccaagtgcaagaccattcagagatgatggttattttattatttttggaa

SEQ ID NO: 20261 - DNA, 601 bp, Human
ttctcaataattgtatctcttgttcctctcatcttcttgagttagttaaaaccccagtgcaaggctgtttagtaaactgttaacgttggttttcccccttcattccagactaaaatgtgtatgtttccgtgctagcccttgaagcgtgatgtttgttctatgtttctccaatctactcttcacaaagttgacagtatccttctaatcctaaaatgttgtgagttttgttttcccaaaaggatgtaaaaagaatttccaaaaaatgttttataccagaggctcaaaagcaaagctttctctrtgtcctattatataataatatagctcttttgtgagcctccatctcataaccttcaatcatgcccctatcttaattagtgcttacagcgttcattagagtagcaagattattgaattaaaggggagggcactggctttccaagatttaatagaatttgcccaaatgatttaggaaatgagtgccagaaaagaaatatggctccaaagatttttttgcagtgtgataattgtttctaattagctaggggaagccgcccatgagtaggggaccacttgttttgtgtttacgagaacagtgttc

SEQ ID NO: 20262 - DNA, 601 bp, Human
tccaaggttttgtaaggtatagaatatacaaattctacttactcctttgggtaaagcatattcacccagaactgttgccttgtcaagagtccgagttgtaaatggtacactcggcgtaagcctgaaaagataaaatcaaagatgtaaaggtgagcacagtctaagttctctctgaagtgtcaatgggaatgcagattggattaaataaatgctgcccaagtgcatactcaaagaggcagcatgatcacagatcttcctaaagaagttgtttttttcttctcaataattgtatctcttgttyctctcatcttcttgagttagttaaaaccccagtgcaaggctgtttagtaaactgttaacgttggttttcccccttcattccagactaaaatgtgtatgtttccgtgctagcccttgaagcgtgatgtttgttctatgtttctccaatctactcttcacaaagttgacagtatccttctaatcctaaaatgttgtgagttttgttttcccaaaaggatgtaaaaagaatttccaaaaaatgttttataccagaggctcaaaagcaaagctttctctgtgtcctattatataataatatagc

SEQ ID NO: 20263 - DNA, 601 bp, Human
tggcaaaattgacacaagttgtcaccttacaaatcaaaagccaaatccacaaatttataataatgatggttgccaacatgcgctgagtgcttaaaatgtgccaggtaataaataggtaaagggctttagaattgtgcaccatactcacaaccaccctgcgcagcagattctgttattaaaccccttttacagacgaagttgaggctcacagagattatgtaactcactcaagacaacacagataaaagatgaaactgaatgcaggtctctgtctccatagccgtgaattctaattctataytatgcaacatgtcaactattctctaccatctctgcattcccaaaatgaatattttccagtacaaagtctagggagatctggtgaatatttgcaaagtgtatcttccaaggttttgtaaggtatagaatatacaaattctacttactcctttgggtaaagcatattcacccagaactgttgccttgtcaagagtccgagttgtaaatggtacactcggcgtaagcctgaaaagataaaatcaaagatgtaaaggtgagcacagtctaagttctctctgaagtgtcaatgggaatgcagatt

SEQ ID NO: 20264 - DNA, 601 bp, Human
ttgaattcattgtaatgtctattaggagaacataactagacttactaactcttaatttcattaaggaaattattactcaggacgaggccaacatatgctatttggcttatgttatttaaaggaaataactcagtagtattgaaataaatagcacctggttggtatatggacatggcaaaagttgtggagggaacatgagaactcctctattgtcagaaaaagtattgaatggcatactgcagaaaaaatattctattgtgttcaatacaggctgataaatatatacatttatattacatgyggttgcataacacaaacctagaccctagggctaaatacagtccaccgcttgttttttataaaatttatcagaacacagcctttgtaggcagaataacagatctcctaaaatgtgaatgccctaatccctggaacacgtgaatatactaccttatatgaaaaaaagggctttccagatgaaattaaatttatgaacttggagatgggagacatgatcctggataatatcttgtcagacagaagcaatgtaagaagaaagagagattcaaagtgtgagagggactcaaccaaccattgttac

SEQ ID NO: 20265 - DNA, 601 bp, Human
tgtaatcccagctactcgggaggctgaggcagaagaatcgcatgaacccaggaggcggaggttgcagtgagctgagattgcaccattgcactccagcccaggtgacagtgtgagacactgtctcaaaaaaaaaaaaaaaaaaaaaattagggccttcttaggctaacttttgatcacttcaatagttttgaattcattgtaatgtctattaggagaacataactagacttactaactcttaatttcattaaggaaattattactcaggacgaggccaacatatgctatttggcttatgttatttaaaggaaataactcagtagtattgaaataaatagcacctggttggtatatggacatggcaaaagttgtggagggaacatgagaactcctctattgtcagaaaaagtattgaatggcatactgcagaaaaaatattctattgtgttcaatacaggctgataaatatatacatttatattacatgtggttgcataacacaaacctagaccctagggctaaatacagtccaccgcttgttttttataaaatttatcagaacacagcctttgtaggcagaataacagatctcctaaaatgt

SEQ ID NO: 20266 - DNA, 601 bp, Human
ttccaccaccaggggtggtggctcacacttgcaatcccagcactttgggaggccgaggcgggtggatcacgaggtcaggagttcaagaccagtctggccaacataatgaaaccccatctctactaaaaatacaaaaaattagctgggtgtggtggtgtgcacctgcctgtaatcccagctactcgggaggctgaggcagaagaatcgcatgaacccaggaggcggaggttgcagtgagctgagattgcaccattgcactccagcccaggtgacagtgtgagacactgtctcaaaaaaaaaraaaaaaaaaaaattagggccttcttaggctaacttttgatcacttcaatagttttgaattcattgtaatgtctattaggagaacataactagacttactaactcttaatttcattaaggaaattattactcaggacgaggccaacatatgctatttggcttatgttatttaaaggaaataactcagtagtattgaaataaatagcacctggttggtatatggacatggcaaaagttgtggagggaacatgagaactcctctattgtcagaaaaagtattgaatggcatactgcagaaaaa

SEQ ID NO: 20267 - DNA, 601 bp, Human
aatggattgtcagtattactcccagccccagaaaatttagctgttgtaggtcattcattgtgaaatgtaaacttattcttgggaattaaagattcaaacagtgaatgtggtaggcagggcctgaaacggtttgtaacctctacctgactgacaagtgccagcctccctttcatgtcatggaagatgcaagacagaacaggctcccaggccattctaagcacctgaagatggtgctgacacaggtgaagtgtaaaccagcagtgaaccctgtagaatgccttggatcccagcactcagtccrcttccctgagttggatatgatgttagcaaataccaccatctagaaagacagtacagcttctggaacaattttgcagaagaaaaagtatcaacacctgggcctaaatattctttataagctgttgtatggtgtggtgtttgaagtttgctttccggtaacgtagaagccataagcaccattcttgcagaaaagttgaaatggctgttttggtcttggtaaaaaaaaaaaaaaaaaaaaaaaaaaaaaaaaaaaaaaaaaaaggtataccctaattgtatatcaaagaagtgtatttaaaca

SEQ ID NO: 20268 - DNA, 601 bp, Human
aggcctgataactttaaccatcatttagcttggcttacattattaagcagggacattttcctaagtagtacattaagcagagctacagtaaatggattgtcagtattactcccagccccagaaaatttagctgttgtaggtcattcattgtgaaatgtaaacttattcttgggaattaaagattcaaacagtgaatgtggtaggcagggcctgaaacggtttgtaacctctacctgactgacaagtgccagcctccctttcatgtcatggaagatgcaagacagaacaggctcccaggccrttctaagcacctgaagatggtgctgacacaggtgaagtgtaaaccagcagtgaaccctgtagaatgccttggatcccagcactcagtccgcttccctgagttggatatgatgttagcaaataccaccatctagaaagacagtacagcttctggaacaattttgcagaagaaaaagtatcaacacctgggcctaaatattctttataagctgttgtatggtgtggtgtttgaagtttgctttccggtaacgtagaagccataagcaccattcttgcagaaaagttgaaatggctgttttgg

SEQ ID NO: 20269 - DNA, 601 bp, Human
ataaatgtatatttctgaaatattctaaaaatataatgtaggaagaaatatttatcaaatacacagaattatatacagtatgcatttaggaaaagcagtagtaaaaatatgcacaaataaaccatctgtaaacacaatttttaagtcttataagtattgcatgcatttctgtgcattttacatttatgaaatcatatttttcctaggagttcaaatcacaaaacaaatgttatataacagatctctaacttttgcatgctttacacttgtcccatttaatagacagaaaaattatggcatrggaaatcattttataatattaaagtcacactgaatgtttttaagctgtgactaaactttgaaacattgccctgcaccacagatcctaaatcaagtactgcaaatattaaaaaaatgactgaggcaaattaccattagaacccacacacacatacacggacacacacacacagacacacacacacatgcatgtctgtgcttcatatgcacatacacaatttaaaaattattgcttcatctttaccctaatgccataaaggaatcacatttaaaaaataaacaattttaaggtcctctaaca

SEQ ID NO: 20270 - DNA, 601 bp, Human
ccacgtccccgctggcgcctcagacgccgcacaaggtcgcagactacgttgttcagggttccggcgtagcgggcggccgcttgaggccggaggaggagcggggccaggagactgcggagcctttgccattcttcgccttccctgcagggttgaggagagagtgcgcatcgggaaggtggggacggctcgacgggactggctgcagtgaaggagcgcgttcggctgcggtggccaggagagggattgcgtctgcccccttggggtacggaaacctgcaccggcctgcgcctgtcttccagcycccttcctctttactcatttcctgccctcaggggccggggttcccgggtaacttgagtcacagaaccttacattcattccatccagatccttgtaccctagcccaattcctccggttcccccagttcccaggattcgggcctcaaaggataaggaggtaggcggggagtgaggttggggctcaacctgagtgtgggtgaagcagactgggatgggaaccccaagatgcccaatggtagagtgggacagccgacctcccaccatgcccccagattgatagtttcgggacccgcagcaggag

SEQ ID NO: 20271 - DNA, 601 bp, Human
agatgtctctgcctgagaactaagtgatggggcaaacccacttaatagtggccagagagcaaaggagagttataagaaaccgtaaaccaggctagggcagattcaccttcctaggggcaagacaaagaaggaagggggtagacagagcctactaagtaagctgcttatcccttctgccacatggttcagattcaatctaagaatgtgtatggtgacacctagtcagagacaggccctggcaggggacataaaaaacaaataaggcttcacccttcctctcaaagagcttacatgcaaagaygaaggaccaaccaggtacagaccagatgcacagttactgagcttatgctttgataaatgcttagccagcagcatcaatgaacactatgaaagcccaaaaagagaggcagttgaatctttcctcaggccatccagcattattagttaaaatctgatttcatccttgggggatgcatacatgatcagaagggccaagcaagcagagagaccatggttttctcacctggcttcctgagtcaggccaagtgcatacttcacacattggtcagggccgcctcacacttcactatggtggttctat

SEQ ID NO: 20272 - DNA, 601 bp, Human
tttttttttttttttttttgagatagggtcttgttctgtcgcctgagctggggctggaatgcaatagcactcacatggctcactgcagcctcaacctcctgggctaaatcgatcctcctgtctcagccttccaagtagctgtactgcaggcatacgccaccatgcccagctagttttttgtattttttgtagaaacagagtttcaccatgttactcgggctggtctcaaactcctaggttcaaacaatctgcccacctcggcctcccaaagtgctggaattacagtcgtgagccactgcacccagcctatatttgtatttttgaaagaacactgtggtgaagaattaggagaaaaaatagtacttaaactcagtatgaattagaatcatctggaaggctgttaaaacgcagatgtctgggtcccatttctagtccatccacgctgacgcctagggtttgcactacttaacaaacttccaggtgacgctgatgctgttagtctggggacacacacttagagaactactgatctaaacccttgcctctccaagtatggtctaggcgccagcagtcttggcatcctgggagttagatggactct

SEQ ID NO: 20273 - DNA, 601 bp, Human
ggtggtggacaccatgcagaaccagagcagccagctctacgcagcactgcctgagaggctctacataatccaggagggcaggatcctctacaaggtggtgacctggggacagggggcccagggagggcaaaggggcccagggagggcaagggcaaagagaaggctttgcatcaagcagaactggattcaaatcaccacccagccacttaccagccatgtgaccatgggcgagtgctttcacttcttggagttccttcaatttcctcttctgcaaaatgggaatgttggtctccacctcacsggggatgaaataatgcacacgaatgtccctagcatttggactggagctgcatcctcccggcttccttttgaacccagatgatggcccagtcctggtctggtttcaaactcagagacagagaatgttgtttttgttctctgttttttgggtttctttctttcttttttttttttgagacagactctcactctgttgcccaggctggagtgcagaggggtgaccttggctcactgcaacctccacctcccgggttcaagcaattctcctgcctcagcctcccaagtagctgggactacaggc

SEQ ID NO: 20274 - DNA, 601 bp, Human
aaaatgactcatacctagccgggtgcagtggcttacgcctgtaatcccagcactttgggaggccgaggcaggctgatcacttgaggttgggagttggagaccagcctgaccaacatagtgaaaccctgtctctactaaaaatacaaaattagccaggcgtggtggcgcatgcctgtaatcccagctacttgagaggctgaagcaggagaatcgcttgtacccgggaggcagaggttgtggtgagcagagatcgcaccattgcactccagcctgagcaacaagagtgaaactctgtctcggaaaaaaaaaaaaaaaaaaaaaaatgaccggccgggcgcagtggctcatgcctgtaatcccagcactttgggaggctgaggcaggcagatcacgaggtcatgaattcgagaccagcctgaccaacatggtgaaaccctgtctctactaaaaatacaaaaattagccaggcatggtggcatgtgcctataatcccagctacttgggaggctggggcaggagaattgcttgaacccgggaggcggaggttgcagtgagccgagatcgcaccactgcactccagtcttggcaacagagcgagact

SEQ ID NO: 20275 - DNA, 601 bp, Human
ccaaccttcctgttaactgctgatgccactgtacacactttctcaaccacctcacggttgcatctgccattgaattagccatgctgatggctcctacacagacatcatttgaccacctcttgcaactaacctccagacctacatgttccttacaacttggaaatccttaaaagttgggaatgcctgattcgtttctcttgcagggtaaatctggcccttggaactacaacccagaggaagttcgtgctgttctggaaaagctccacagttaatctggacagatacctcaattctaggtgaycaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagag

SEQ ID NO: 20276 - DNA, 601 bp, Human
agaccttttttttttccttccgggcgcaaaaccgtgagctggatttataatcgccctataaagctccagaggcggtcaggcacctgcagaggagccccgccgctccgccgactagctgcccccgcgagcaacggcctcgtgatttccccgccgatccggtccccgcctccccactctgcccccgcctaccccggagccgtgcagccgcctctccgaatctctctcttctcctggcgctcgcgtgcgagagggaactagcgagaacgaggaagcagctggaggtgacgccgggcagattacrcctgtcagggccgagccgagcggatcgctgggcgctgtgcagaggaaaggcgggagtgcccggctcgctgtcgcagagccgaggtgggtaagctagcgaccacctggacttcccagcgcccaaccgtggcttttcagccaggtcctctcctcccgcggcttctcaaccaaccccatcccagcgccggccacccaacctcccgaaatgagtgcttcctgcccgccctagtccctgctctccacgggtgcgctgcgcagggacccccccccccccgcctccctcgtcactcttcttatccct

SEQ ID NO: 20277 - DNA, 601 bp, Human
ggaagcacggaggctgaggctctagttgaagtggggcaagagcgattttcccttgagcttccatgctgcgagcgcctgtccctccaaagggcgcctgggcagcagcagccgaaggcgctactaggaacggtaacctgttacttttccaggggccgtagtcgacccgctgcccgagttgctgtgcgactgcgcgcgcggggctaggagtgaggtcggagggagggtgtggaggcgatggccggtgggcccttctctgtggggtcctcgatctacccagattagcccgcaatctctctgtccsggggccttcgggcgccatcgcgccagcgccgagagtcgagcaggggcgccgcgcaagatctttgtccgccgcctcctgcgcgctgcgcgcaagttcgtttccccggtgacgttccccatgcttacttaccccaccctctctggatctgtaccgcgagaaatctggggtcctcagggggctaggtagaggagaaacgctgaaaccggaccgaaacctcgccctaggcttagcgatggctaaaaaccggctgggataagagggaggcaagcaacattccgactcgctgctttctggctgtct

SEQ ID NO: 20278 - DNA, 601 bp, Human
tctggagtgcaaggtgactgtggttcttctctggccaagtccgagggagaacgtaaagatatgggcctttttccccctctcaccttgtctcaccaaagtccctagtccccggagcagttagcctctttctttccagggaattagccagacacaacaacgggaaccagacaccgaaccagacatgcccgccccgtgcgccctccccccgctggcccacacgccggctgctgagtgcccaatggggcttgtagcggctcggctggaaaatcgctcactgagcgctcccctgtgctcctagccyagtcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcagga

SEQ ID NO: 20279 - DNA, 601 bp, Human
aaggcttgagatgagaaaattgtttttctttttccttgttggagtgaagaagtgtctcctgaccccacccccctaaaaaaacttatcagcttcagactgtaagtgttcccactcccccatttatttatttctgagatgtaattaattgtatgaatttccagaatttgtatacagaaagggcttaagaaggatagtgtggttacagggagtgcttattgatgcgcttttatggcactttatatttgagaaaataagtatcctcatcaatgaagtggggattattaccggaaagcccctttakacgctggcattggctcccgggcaggaggtctcgtgttaagtcctcaggtctcattccaatttcctttgcagctccctcttcccgccacccaggagggatacaattacccacacaacaaagagggcctcgggagagtcgccagccctggtagcatatgaaccaggcaccggcgttggagctggccagggcagggcgggaggaacgcgaggcctgcgcgcctttgtgtggtgctttcgccttgatggatttcttttctgacgctttccacatttcccgctcccttttgccgcctgggggtgg

SEQ ID NO: 20280 - DNA, 601 bp, Human
tatcagcttcagactgtaagtgttcccactcccccatttatttatttctgagatgtaattaattgtatgaatttccagaatttgtatacagaaagggcttaagaaggatagtgtggttacagggagtgcttattgatgcgcttttatggcactttatatttgagaaaataagtatcctcatcaatgaagtggggattattaccggaaagcccctttagacgctggcattggctcccgggcaggaggtctcgtgttaagtcctcaggtctcattccaatttcctttgcagctccctcttcccgccacccaggagggatacaattacccacacaacaaagagggcctcgggagagtcgccagccctggtagcatatgaaccaggcaccggcgttggagctggccagggcagggcgggaggaacgcgaggcctgcgcgcctttgtgtggtgctttcgccttgatggatttcttttctgacgctttccacatttcccgctcccttttgccgcctgggggtgggggtggggggttagcgggcagttgtgttaatttgccctccactcccggcgcccttacggaattcccggtggccgccagtcgcc

SEQ ID NO: 20281 - DNA, 601 bp, Human
actcttccacgaccccatttcatgccagtttattttaagctgccactaggctggagacccgccaagaaattatgagacgtttcggtcccagatgcctgtgttccctttctgggctgctgtggtcgccctttgagtctgcggggcccggccagtgggtgttgggcagctcgatcggagcctggccctttgcgtgtgggtcagccttcacccaactccgaccccacctccggagctgccgggcgggggtcgcttacgggcccggaggggcgccgggtgccccgcctctcagagacaccgttcyatatttgaagccaggagcaggaagggagtatgatgggggcttagagtatatgcctgtcggctcacagatttggctcctagctcctttcaggaagtagcttttaatgaagagctctggcaaagtcctcatcctcccccaagaaaaccattgtcctccacccatttccccgcggtcggaacctccctaaccgaacctctctccctctctctcgtcctagcgtacgatacctggtgcggcgtggcccatggatgcaccagaaaactggggctcaagatctgcggtaagtgacaggacccactg

SEQ ID NO: 20282 - DNA, 601 bp, Human
gccaggagtttgagactagcctgagcagcatagggagaccccatctctacaaaaactttcaaaaaattagccaggtgtggtggccacatagctgcagtcctagctactcaggaggatgaggcaggaggatcgcttgagcccaggagtttgaaattacaatgagctatgatggcgccactacactccagtctggacaacagcaatacagtatgaccctgtctcaaaaacaaacaaacaaatgaaaaagagcccctccgtctatgcatatgcaattccatgccatagcttggtgaacagagartgtgctgggcttcagctcccacgtgccctgttggccataggtgtttatgccatacacagctcaaagccccacttggcaacaactggctggagccaggtgctttctagctacacatacctgtgcgcacatgcacgcacacatacacatacacactctctcactgggccccataagcctttgagtttggcagcaggggtgaggaacctgcagcaggagctcccctcagctcagaggtggagtcatgatttttctccccttgcggctggccagtgtgctagcacccaaccaaacacaactgca

SEQ ID NO: 20283 - DNA, 601 bp, Human
tacagtatgaccctgtctcaaaaacaaacaaacaaatgaaaaagagcccctccgtctatgcatatgcaattccatgccatagcttggtgaacagagagtgtgctgggcttcagctcccacgtgccctgttggccataggtgtttatgccatacacagctcaaagccccacttggcaacaactggctggagccaggtgctttctagctacacatacctgtgcgcacatgcacgcacacatacacatacacactctctcactgggccccataagcctttgagtttggcagcaggggtgaggarcctgcagcaggagctcccctcagctcagaggtggagtcatgatttttctccccttgcggctggccagtgtgctagcacccaaccaaacacaactgcagctttgcctctcctctgctttcctctttgcctctaagaatgtagagctctgtgaccagttacccacaggcttaaactaggtcctcgaagctggggtgtagagcaagagggagtacactcggcttcattctctgggaccccttcttacaggaccccttgctagccagggaaattgtcaaggcactgacctccatgtcatccacc

SEQ ID NO: 20284 - DNA, 601 bp, Human
aaatgaaaaagagcccctccgtctatgcatatgcaattccatgccatagcttggtgaacagagagtgtgctgggcttcagctcccacgtgccctgttggccataggtgtttatgccatacacagctcaaagccccacttggcaacaactggctggagccaggtgctttctagctacacatacctgtgcgcacatgcacgcacacatacacatacacactctctcactgggccccataagcctttgagtttggcagcaggggtgaggaacctgcagcaggagctcccctcagctcagaggtrgagtcatgatttttctccccttgcggctggccagtgtgctagcacccaaccaaacacaactgcagctttgcctctcctctgctttcctctttgcctctaagaatgtagagctctgtgaccagttacccacaggcttaaactaggtcctcgaagctggggtgtagagcaagagggagtacactcggcttcattctctgggaccccttcttacaggaccccttgctagccagggaaattgtcaaggcactgacctccatgtcatccaccacctcttcatccttggagaagcagttccttcca

SEQ ID NO: 20285 - DNA, 601 bp, Human
tgctagccagggaaattgtcaaggcactgacctccatgtcatccaccacctcttcatccttggagaagcagttccttccagggcctctcagagccaagggaggcctggttcacctacctttctgaggatcccagtattttagagaacaaacaccttcctaaacaaagtgaaagacatgtgacaatatatattatatgtttatattagcaaattaattgttttaacataaattataatgcagtgtaagtgtgctattcataaaataattacaggatttagagaggattctgattcctagtayattactggaagtgcagcccaaggaatgggatgcaggtttaaagccgtgtcgtagggccgggcgcagtggctcgcacctgtaatcccagcactttgggaggccgagacaggtggatcacctgaggtcaggagtttgagaccagcctgaccaacatggcgaaacccccatctctactaaaaatacaaaaattagccagacgtggtggtaggcacctgtaatcccaactacttgggaggctgaggcaagagaatcacttgaacttgggagctggaggttgtggtgagccgagatcatgccact

SEQ ID NO: 20286 - DNA, 601 bp, Human
ttggagaagcagttccttccagggcctctcagagccaagggaggcctggttcacctacctttctgaggatcccagtattttagagaacaaacaccttcctaaacaaagtgaaagacatgtgacaatatatattatatgtttatattagcaaattaattgttttaacataaattataatgcagtgtaagtgtgctattcataaaataattacaggatttagagaggattctgattcctagtacattactggaagtgcagcccaaggaatgggatgcaggtttaaagccgtgtcgtagggccrggcgcagtggctcgcacctgtaatcccagcactttgggaggccgagacaggtggatcacctgaggtcaggagtttgagaccagcctgaccaacatggcgaaacccccatctctactaaaaatacaaaaattagccagacgtggtggtaggcacctgtaatcccaactacttgggaggctgaggcaagagaatcacttgaacttgggagctggaggttgtggtgagccgagatcatgccactgcactccagcctgggtgacagagcaagactccgtctcaaaaaaaaaaaaaaaaaagctg

SEQ ID NO: 20287 - DNA, 601 bp, Human
ggccgggcgcagtggctcgcacctgtaatcccagcactttgggaggccgagacaggtggatcacctgaggtcaggagtttgagaccagcctgaccaacatggcgaaacccccatctctactaaaaatacaaaaattagccagacgtggtggtaggcacctgtaatcccaactacttgggaggctgaggcaagagaatcacttgaacttgggagctggaggttgtggtgagccgagatcatgccactgcactccagcctgggtgacagagcaagactccgtctcaaaaaaaaaaaaaaaaaagctgtggcataatgatcgtttctcagcctcatgagcgcatctctgggagagcctgtgtcaaaacctcaagccgagtttctgcttcctgcagctgcccagagggaaggggcttcaaggtggggagactcagggagtgagtcagaagcctaagcaggcgtcggggacaacagagtggaggttcagctgggcaggacctcactacatgaggccacatgggtttggtctttcaagtctggcaaattccacagctcaatgttctgggatgagaggagcagtctcagagttcaggtgccatctgat

SEQ ID NO: 20288 - DNA, 601 bp, Human
ggctcgcacctgtaatcccagcactttgggaggccgagacaggtggatcacctgaggtcaggagtttgagaccagcctgaccaacatggcgaaacccccatctctactaaaaatacaaaaattagccagacgtggtggtaggcacctgtaatcccaactacttgggaggctgaggcaagagaatcacttgaacttgggagctggaggttgtggtgagccgagatcatgccactgcactccagcctgggtgacagagcaagactccgtctcaaaaaaaaaaaaaaaaaagctgtggcataaygatcgtttctcagcctcatgagcgcatctctgggagagcctgtgtcaaaacctcaagccgagtttctgcttcctgcagctgcccagagggaaggggcttcaaggtggggagactcagggagtgagtcagaagcctaagcaggcgtcggggacaacagagtggaggttcagctgggcaggacctcactacatgaggccacatgggtttggtctttcaagtctggcaaattccacagctcaatgttctgggatgagaggagcagtctcagagttcaggtgccatctgatcctgcatccctct

SEQ ID NO: 20289 - DNA, 601 bp, Human
aattcaggaagtaggcaaagagatatggaaaaggatacaatcccatctttatacccaagtgtggagctctattatagtgtatttccccccttctcatgtcctttgggctttagtgataaatgtaaaaggtgctgggagcaacaaaaagcttggtggctctgctttccccttcttccctccagaaatagcccctggctcccttgtgtgggaggattctaatcaccgcagccctcccatgcatccccccttctcccacccatcacagttgaattgtagtcctgggaagcaaagctgaattctmcagattaacttgcctttttgcacctcttgggactttcttccaagtctgccttgtgacacgtgtgactccgcaagtttcttggtatttacagaaacagctttggggtcaccaagaagcttagaacctttttcctcttttcagtgtgctgcattttgggctaagactgaggctgaattgaaggaggagaagccaaaggaaagagcagacgtgcgggccaggagccccacaggggatggtggagatgtggagggagtgtgctccacgctggcaggttctcctgcccttttggcttaaccctct

SEQ ID NO: 20290 - DNA, 601 bp, Human
ttatatattatatataaatataaattatataatatttatatatatatgaaaatgagctgggcatggtggcgtgcacctgtagtcccagctactcaggaggctgaggccaagaggcagaggctgcagtgagccaagatcgtgccactgcactccagcctgggcaatagattgggaccctatctcaaaaaaaagaattttcattcttggatttaggctattcacaacctaaagagagcagaatgacccatcctctgcttcttttcttgcctccattttcaggtctatttcattctgataaatsctgcccttgcctgtccctgacactggggagaattgggctatttcctctccctttctgtattagtttcctaggaatgccattataaatgaccacaaattggatggctcaaaacaatagaaatttgttctctcacaattctggaggctaggagtttaaaatcaaggtgctggctatgctctctctgatggctcttggagaggatccacccttgtctttaccagcttccaggtgttgtggatattccttggcatttgttggcttgtagatgcatcgctccaacctctgccttcacttcacatg

SEQ ID NO: 20291 - DNA, 601 bp, Human
catatctttttgaggaacacaattcaacccatgacaccttttaccagctaggccaaaaagacacatgcacacacaggccaaaaagacacaggcacacatgcgcgcgcgcgcgcacacacacacacacacacacacacacacacatacacacatgccttctcattctactgcaacttctggaacttaggacactctgagtcaccaaattctatttccagtgggagtccttgaggatgtcctcttgcctccttttcttgttccaggagctctctctaatcagcaatcctcatcaaagcagttrctttccaattgcctccagttcaaggactttggggcctctgtctgagatgcttagaaacagctcagactgtggactaagcccaggagtgacacagtggtttcttctccctataactctctccacactacagtctggctttcctgagctctcaggcagacagatctagaataattgacagtccctagcttagttgccaccacaggggaagccccaaggccacaactggcaatcctgtgttctttcttcttctttgtctctccttctttattttccctctcattcttcctcgtcatttgaaga

SEQ ID NO: 20292 - DNA, 601 bp, Human
cattctactgcaacttctggaacttaggacactctgagtcaccaaattctatttccagtgggagtccttgaggatgtcctcttgcctccttttcttgttccaggagctctctctaatcagcaatcctcatcaaagcagttgctttccaattgcctccagttcaaggactttggggcctctgtctgagatgcttagaaacagctcagactgtggactaagcccaggagtgacacagtggtttcttctccctataactctctccacactacagtctggctttcctgagctctcaggcagacasatctagaataattgacagtccctagcttagttgccaccacaggggaagccccaaggccacaactggcaatcctgtgttctttcttcttctttgtctctccttctttattttccctctcattcttcctcgtcatttgaagatagatttaagactgagactaggaggctggtggtgatagagctgagtaagactattggatgtcaaaaacaaagtgttataatgaaataatgatgctggccaaagatgctttttaaaatgaggaatcccagagagctgctgaggtctgccaacaccactgga

SEQ ID NO: 20293 - DNA, 601 bp, Human
acagctcagactgtggactaagcccaggagtgacacagtggtttcttctccctataactctctccacactacagtctggctttcctgagctctcaggcagacagatctagaataattgacagtccctagcttagttgccaccacaggggaagccccaaggccacaactggcaatcctgtgttctttcttcttctttgtctctccttctttattttccctctcattcttcctcgtcatttgaagatagatttaagactgagactaggaggctggtggtgatagagctgagtaagactattgkatgtcaaaaacaaagtgttataatgaaataatgatgctggccaaagatgctttttaaaatgaggaatcccagagagctgctgaggtctgccaacaccactggaataagtgcagcttcattaaatgactgatggatacacaagactcagttatatgtacaaaatttatgttgtttgatttttaaagaaaagcactctatcaatttacatttagttacttctcatcttggtcagatggctaatatattcctaatggaaaacaaatagtgttattcggctgcattttaaaaagagtcagaatt

SEQ ID NO: 20294 - DNA, 601 bp, Human
ggaataagtgcagcttcattaaatgactgatggatacacaagactcagttatatgtacaaaatttatgttgtttgatttttaaagaaaagcactctatcaatttacatttagttacttctcatcttggtcagatggctaatatattcctaatggaaaacaaatagtgttattcggctgcattttaaaaagagtcagaattccccatgtatgtttagcttgacttgctttggtgtgatattttgaactttgccagtttgctctacatgcgctttctcagagagatgagaactacatcatttyattatgaaagcccagaatggcgttgtccctcaaataaaaatacatgattttgtcataatatcaactaatattatctacaaaaccaaagcatcttgtggtcagagaaagcactgacgggcctggcctggtggctcacactcgtgatcccatcacgttggcaggctggcaggtggatcacgcgagctcaggagttcaagactaacctggcaaaaccccatctctaccaaaaatacaaaaattagctgagcgtggtagtgtgcacctgtgatcccagctactctggaggctgcagtgggagga

SEQ ID NO: 20295 - DNA, 601 bp, Human
agcagactctgccacacaagaactacagcttgttgacagtcaatttgccttcgctctgagtgaactcctccgggaaggtgagttgaaccactgcaaaagggctgactcacttccctactcggaatatagacatgctcagaatgctcctctagtgtcactccatgaatgccaccatcctactgttttaaatctttacttccaatcccatgttcttatgcttcaacccagagcttctggcaggtttagtttctggttctgactctgaaatgtaatcttgtactttgactttagcatctaaccwgcttcttctgaattcatatttgacctttgatctcttgacttcatttgctttcctcagtcatttaggaaaacagtacccaacctggaatctaggttgcaagagaagaatctcctatagttctatacaaaatgatgtgcctatcttcattttttacttggagagaaggactacagatttcctaggattcccaaagggatctgtaatcccaattaggtgaagaaccactgggcatggtggctcacaactgtaatctcagaactttgggaggcaaaggcgggaggatcgcttgaggccaagaat

SEQ ID NO: 20296 - DNA, 601 bp, Human
gtcatttaggaaaacagtacccaacctggaatctaggttgcaagagaagaatctcctatagttctatacaaaatgatgtgcctatcttcattttttacttggagagaaggactacagatttcctaggattcccaaagggatctgtaatcccaattaggtgaagaaccactgggcatggtggctcacaactgtaatctcagaactttgggaggcaaaggcgggaggatcgcttgaggccaagaattgaagaccatcctgggcaatatagtgagacctccatctctacacaaaataaaataaagttaaaaataagaaatttttaaaaactgctttggtgaactacaaggccttctttaagagtgcagctgcacagattgtaaacatggcccaggatggggcagcagggtcagaagaagtgtcaggaatgaagaacaccatgtcagcccatttgtcaggcctggctgtggatcagcagccatggactgatatactagctttcaggagagagtgtcaggcctaagctaataagtcaggaaaagagtggaaaattggtcctttagactcaggcagggactatcaaacaggatacagctaaggccaa

SEQ ID NO: 20297 - DNA, 601 bp, Human
cagatgctagaatcatcctagtaggtttcctcctcaaggttgagaatggtgtcttctaatatcttagtttccttagtacataggatgtcacctggcagagaatagccactcagtaagtatttgttgaatagaactgaaagaaagtttaggaatcaggtacctggcatagataaggaacctgaaatagattagatcagttaagctcatgataaactctctagactcttcctcctaatcctgagagtaatggccatgttcctggtccttggggaggctaattcatgcaaaccttgggcctaaytggttttaaatctgaagcatggagtgggacctatgcctgatattcagtcccattccctctcccttgtccatgtggttcctgcctggccaacactgacttgatcctaagccaactttcatccagtctttgatatggttctgatattacggtatgtgatttcatttgttccttgccttaccccagagagctttcttatatagtactgggagattctagcacagacactgccaccagtatctcctcgccatgcaaacatttttgtcatgtcaacatttccaaaaaccagtggaaccattaata

SEQ ID NO: 20298 - DNA, 601 bp, Human
tgtggtggcatgtgcctataatcccagctactctggaggctgagacaggagaatcacttgaacctagggatggaggttgcagtgagctgggatcacgccacatcactccagcctgggcaaaagagcaaaactctgtctcaaaaaaaaaaaaaaaagaaaaaagaaaaagaatatctgctacatttaggaaaaataaggcagtatacggaaggcattatcaactaagagacttaatcccaaatcttcccaggaacacaaaagatgcattttcacatgtgtgactgggtgtatttttttttttctttctctctgcccattttcttagggatttaacttctcacaattggccaataggatcatctgccttgctactgaactaatgactaacaaaggctgtgtcacgtggcatcccaactattcagtaaacatgcatcatggtacccacaaaaatgtcttgttgttacataagttgttgtgagacctccaaacccagcaggaactgctgctttttgagtttttcaggagctgttagaattctactctgggaagaaccagacagcaggcctcagttttttgagcagcttccagagccacccggagg

SEQ ID NO: 20299 - DNA, 601 bp, Human
atataattttttaatgacttggtaaatgatagcaatgagaaatttgattaaattcactaccatttaaatatgacctgacactgatgctttttagtgagctaagcacttagttaactttccttggaatttttcacaggtctctttcacaaaggttttattatacactgaagggaaaagttcttcagaccttcctctcttctccttgaaacagagtgcactaaattattttgttaggtcctttaactaaaggacctaagcacgatgaagaggttgaaagttcacaacaagggtttagctctarggagagcagaggcaggatgattctgagccaattgctctatctaggggaaaagatccttcacaggtattaaaatgcagcacctagctataggccaggcctttgggaaggagtctgcaaaccaatgaggcaagttacccatgttttcatcatcatacattagacttagttgtttctgtaatgccctagctagtgtgctccttaaccatctaattgtgtctgacagaatgatgcagttgctaggagaccatgcttgttaagctatcattgcagcccaaactggcaaaatcactctaatttagc

SEQ ID NO: 20300 - DNA, 601 bp, Human
gcccaggaggcggaggttgcagtaagccgagatcatgccactgcactccagcctgggcaacagagtgagactccatctcaaaaaaaaaaaaaaaaaaaaaaagccataaacggcaacaacaaaaaaggagtcgtgtcattttgaaatataatgaccacacaacctgtttcagtaatttgtgtcttcttttttgtttctaacaataacctcttgaaccatctgctgcaggttttgaccatagtgattggttgctgaaatgggaccctggtacaggcttcattcctaagtggactgactaggktgtacagtcagcagtgacactacctggggaggctgatgctttctcagtgctggactttgctcaggcccattagcaatccacagccagccttgtgcatctgctctccttgttaacaccgacccactcaacaaccctcatactgctgttattaatcagccatgctggcttttgaaactcatgctcaaccagtttgtcaatagttggaactattgcaatatcagggcatatactgagaccaatggcttccccatctacctgcctgcctgtcacctaaaaggcataacactgttatgtggaagg

SEQ ID NO: 20301 - DNA, 601 bp, Human
atatctcaatagtagtaacagtatctttagcgacctttggaatagttaagcacaggtcattgtggacatgaattcaggcctctgtactaaaatctatttcagggaatgttctgtctagtgatttgctcaccatttgatatataatgaattataggacaagtataagctgatctgctatagctgtccatcagagagaatacacgtggctataacatctataacaaaacgacgattcctctacaagaggctgtttctcactgctaacgttggtgtttctggcgtgggaagaaatgcacaggcrtgcatggcatgcacgttcagacagctgcattgtaagagttctgtcatgcagtctgaaaagggaagaaacaggatggctttctgtagccacacctgtgaggcgtgatgattgttgtattattagattactgatttttcttttctgaaaatacatttgagttttaatcacatctgtggaagctgtaacttttaaggtagtcaatttcatgtcttgttcaacgatgtaagcagaaactgaattgccctaattttgccaactggccattattgggattattgtttaaatttttggtaaaggaag

SEQ ID NO: 20302 - DNA, 601 bp, Human
cctggatcttccggtcagacatgagatcacagatgcgggtgatgatgctctttgggtcggtctcattcatggctaccagttccacccggggtaccacggagagatggtggaaatcatctttctcgtgggcatccttgatggccacctcgtcggaagtgcccacgaggatgacagcaatgccaatgctgggggggctcttctgagaacgagctctgctgcctgacacggccaggacggccaacaccaaccagaacttgggagaacagcactccgctctgggcttcatcttcaactcgtcgaytccctgcaaacacaaagaaagagcatgttaaaataggatctacatcacgtaacctgtcttagaagaggctagatactgcaattcaaggaccttatctcctttcattgagcaccaaacccaactccatctaccagcctactctcttatctctggtatttgctctgcagaatgagagaaaatgaaactttcaaaagcctcagaaatccttgaacaaggcaataaaaggtgctattgctatagtcattggcagctacaggcagagacaaaggaggaaaagaggttgtgagtggtccaggtagc

SEQ ID NO: 20303 - DNA, 601 bp, Human
ctggtctgtgtcatcagcaaacaccaccccctggatcttccggtcagacatgagatcacagatgcgggtgatgatgctctttgggtcggtctcattcatggctaccagttccacccggggtaccacggagagatggtggaaatcatctttctcgtgggcatccttgatggccacctcgtcggaagtgcccacgaggatgacagcaatgccaatgctgggggggctcttctgagaacgagctctgctgcctgacacggccaggacggccaacaccaaccagaacttgggagaacagcactcygctctgggcttcatcttcaactcgtcgactccctgcaaacacaaagaaagagcatgttaaaataggatctacatcacgtaacctgtcttagaagaggctagatactgcaattcaaggaccttatctcctttcattgagcaccaaacccaactccatctaccagcctactctcttatctctggtatttgctctgcagaatgagagaaaatgaaactttcaaaagcctcagaaatccttgaacaaggcaataaaaggtgctattgctatagtcattggcagctacaggcagagacaaaggag

SEQ ID NO: 20304 - DNA, 601 bp, Human
gatgtgccttagagagacggtgactcgtccaggggcttacagcttgtttatgccaaacccagtctcctttctgctagcccagtgttctgttttcaaggtgacgttttattttccaacccctcattccatggcccctgcaaaaaatatggggtatgagctcacaaaagacctcatctaattgaaatcttggcctcatctcacccagtcttatatcacgtctgagatttttgacatttaagtgatgctggagagaatggtatggggaggggtgcagtggggtgggaggaagaatcagatcagytctatctggcaaagcctcagaaaatttgcgtggaaacaaaaaatcttttttggtagctctgagcgcaattcttgcagataattaaaaataaatagatatttcaatgatatccagaattagaaattattatggcaagaagcagtctcagagatcagcctggttgaaatgacttctcctatggatgaggaaaccaagtccccagatacagcaaatttgctcaaggtcacatgctgactaaatggcaggaatgggactacagtaagccctctgaggaccagcccagtactactttcttagatg

SEQ ID NO: 20305 - DNA, 601 bp, Human
aaactacttttaccacatactatatatataatccttctaatggccctttcattagggattaccttatctattttatggaggagtaaactaggactgagaggtcaaggttctttccaattcatactcagaaagtgtcagggtcagcttacaaactgagccaaaaagtctgtgttttttcattgtattacattgctctttgtccccccatgctggttcctgggttaggggctgaactctgaaacggccttatttgtactagaacacaggttctgaaggctaccatagctggattttaatcctmgagctgccagttatcagctaagagacggctggaaaatggcttaataggtctaagattcagtttcctaagctataaaatgggtataataacattttatgagttaatataaccaaaggatgtacaatgatgcctggcacattatatagtaggtgctcaataaatgttggcttctcttatccctataactaactgctcctcctctgaatacagacgtaaacacaccctgcctgacatttctatgctattccagggatatattaatgtaccactggctctgccagttcagaagttaaggtagtg

SEQ ID NO: 20306 - DNA, 601 bp, Human
gaaccatttccttaaaggtcaaggattgccttccttcaaatacatgagaaggacagcttcatgcccgtgagcctcttaggttgtagaggcagcttctgccattattggaccaatatctgggtatttcagtaaatggtgcaattggaagaagcactagctatgaagtgagtgagttgtattggactgactcaatttatgttctcatctatatggccacaccatgtaatggaggcctggaaatgccttctccaatgcttctgaaccttgcagatacagtctttctcaacagacctacctactwttttagagttgaatttgttcaggaataattatgtacaataaataaccagcccccttttccccttgtatcatttctcttaaacttcctagcctagattcactttttcaacctactttgatgtattgtatgttatcagacatcattagggtatgagaatataagtcaatgttaaagtatccttccacgttaaatattattatctgcaacagtgggaatttaacaagtgacaagggaacatgtctaagctgtaattcacaaaccaactacaatctatcccccattatgaagtgatagggttga

SEQ ID NO: 20307 - DNA, 601 bp, Human
atgctctaaggagacttgatatttaaagtggccccatgttgaattcctctgtgaagacaaacatcctttggtaaagtgagtaattgtaagccctcgctctgagctttctttgcaaatctggattttcggctcctgttattttttcaagggagagaggcaatgcacactgactttagctcttgacattgccaacctaagtatatactcatgtgattcccagatgttccacttctcactggtgccacacaggctgggatataggtcatggcttctggatgaagcacaggtggaaggcccctgwttgtaccatgccatggagacaccccaactcccacctcagaatacacaaaccaaattaaaaggtaggtctgcacttggaaatacttcagtaaagtgttgtttcacagcttagactgtgaatccaacagaagcatgaggaagattttataaaatactgctgcctgaaaccctatactcagagattcttattaaattggtgtagggtggggctggttattttaacatgcaaccaacgtagagaaacactattttgaaacatacagtggtctaagccccaacctagacttagtgaatcagaaaa

SEQ ID NO: 20308 - DNA, 601 bp, Human
agctttataaattgtaaaatgctctaaggagacttgatatttaaagtggccccatgttgaattcctctgtgaagacaaacatcctttggtaaagtgagtaattgtaagccctcgctctgagctttctttgcaaatctggattttcggctcctgttattttttcaagggagagaggcaatgcacactgactttagctcttgacattgccaacctaagtatatactcatgtgattcccagatgttccacttctcactggtgccacacaggctgggatataggtcatggcttctggatgaagcmcaggtggaaggcccctgattgtaccatgccatggagacaccccaactcccacctcagaatacacaaaccaaattaaaaggtaggtctgcacttggaaatacttcagtaaagtgttgtttcacagcttagactgtgaatccaacagaagcatgaggaagattttataaaatactgctgcctgaaaccctatactcagagattcttattaaattggtgtagggtggggctggttattttaacatgcaaccaacgtagagaaacactattttgaaacatacagtggtctaagccccaacctag

SEQ ID NO: 20309 - DNA, 601 bp, Human
cagaggccaggcatggtggctcacgcctgtaatcccagcactttgggaggccgaggtgggcggatcacgaggtcaggagatcgagaccatcctggctaacacggtgaaaccccgtctctactaaaaagacaaaaaattagctgggcgtggtggcgggcgcctgtagtcccagctattcgggagcctgaggcaggagaatggtgtgaacccgggaggcggagcttgcagtgagctgagatcgcgccactgcactccagcctgggcaacagagcaagactctgtctcaaaaaaaaaaaaaaaagaatatcaggaaggccaaaggggaagtcatagaatcctggcctggctacctgcatctaaggggagaaaggaagctgcttttgactttgatttccccccacctaacctttgcatagacagtgcttgggcttctgcccatgtatgtattgtgacctcactgcaatctctatttgctgatggtaaaatcttgcctgttgtctgaatctccatgtagcccctccactgcagaaatgaacatctgcctgcacagttttacaacatatttgcacaggtcttatgatgtaatctgtgatcctgatag

SEQ ID NO: 20310 - DNA, 601 bp, Human
ttcctgatttttctttagcttctagcacttagcactcaatgtttcaaagacaaccctgatcctactccgatgccaacacttcccaactggtttcctgtcatagaagcttgcgtgtaaaagaatatcagaggccaggcatggtggctcacgcctgtaatcccagcactttgggaggccgaggtgggcggatcacgaggtcaggagatcgagaccatcctggctaacacggtgaaaccccgtctctactaaaaagacaaaaaattagctgggcgtggtggcgggcgcctgtagtcccagctaytcgggagcctgaggcaggagaatggtgtgaacccgggaggcggagcttgcagtgagctgagatcgcgccactgcactccagcctgggcaacagagcaagactctgtctcaaaaaaaaaaaaaaaagaatatcaggaaggccaaaggggaagtcatagaatcctggcctggctacctgcatctaaggggagaaaggaagctgcttttgactttgatttccccccacctaacctttgcatagacagtgcttgggcttctgcccatgtatgtattgtgacctcactgcaatctctatttgctg

SEQ ID NO: 20311 - DNA, 601 bp, Human
cagaatctaaagcctaaatcccaggctgttctttatgtgcttttgggttgaaaggaggagttcttttcttcccactgggaatgatgagaatgtaagttgggcctgaagccaactcataaactgtgtctgaaaggaagaaggagtaaaaagggatcaataaaaataataacagaaataatgaaaagtaaccactgcaacgagcaacaaatagcatggggttagatttatataacatttttcatttctcagtttattacagtctggagtggggataagtgtaggtgtttgtgtttcaatagakgtgcaatgctatttttgtggtcaggaaggttccagtattctgttgtgcaacacaaggatagaggtgaggggttgaggtggtggcagtacaggcttgtgtaagagcagatgagtgaaactacaagagaaggcaaaatacagaagaattcagatctctcaaatacataaattacagcatatagttcctaaacatataagaacttcattttatgtatttgtgctttgcaaggcacaaatacataaaaaagggaataagaccaggcgtaggggcaggaaggcatgaatcaatatttaaaaccaa

SEQ ID NO: 20312 - DNA, 601 bp, Human
tggcaatgccatagccagtggaagcaaagaccttcccactgccaatggtcaccagcttgcagccttcatctctgcctgccatatagttcagcactgctgcatcatagatgaaggcatccagtttcctgtacaggaaaaaagcaaacaaatccaatggaggaattttagaacaaaactacctgtggggccattaatatgaagcagtagggttccagaaaactatgtggagaattggttcaaagtaaggtttaagttggaactctgccagaatctaaagcctaaatcccaggctgttctttaygtgcttttgggttgaaaggaggagttcttttcttcccactgggaatgatgagaatgtaagttgggcctgaagccaactcataaactgtgtctgaaaggaagaaggagtaaaaagggatcaataaaaataataacagaaataatgaaaagtaaccactgcaacgagcaacaaatagcatggggttagatttatataacatttttcatttctcagtttattacagtctggagtggggataagtgtaggtgtttgtgtttcaatagatgtgcaatgctatttttgtggtcaggaaggttccag

SEQ ID NO: 20313 - DNA, 601 bp, Human
acatgtgcagagggaaaacatgcacactggtaaaacaccatgtgaacatgaatcagaggtcaggggtatgcttctacaagataaggaatgccaaaattatcagcaaaccaccagatactataggagaggcatgaaacagattctcccttgcagaccccggaagagattgaccctgctggcactgtgatttcagacgtctagtctctggaaatgtgagacaagacatttctgttgtttaaggcactcagtgcatggcactttgttatggcagcaataggaaacaaatatatacccgaaaacyacacaatatactgtgaaatgcttttccggaaatgcacaggttaaagaaatggaagaaaaggaaaggttgatgttttggactggccatcagtagaggacaaatgggcactttccctttcttgaactcaccatctccaaagagctgcaggatagcaaggtccacctggcgcttccacccagaatctttttggatggcaatgccatagccagtggaagcaaagaccttcccactgccaatggtcaccagcttgcagccttcatctctgcctgccatatagttcagcactgctgcatcatagat

SEQ ID NO: 20314 - DNA, 601 bp, Human
tgactggatgaaacatctaatatcagttctcctactttatccctgaaggtttgattatagcctgcaacccagaaaaagacctccttgacaaactgcttcaatcctctccctgccatctttcagcttgttatgggttgaaagatgttatagaatccccctaaaatatatatgttgaagtcctaacccccaataccttgggatgtgactttatttggaaatagagtcattgcaaacataattaagctgagatcatcccagagtagggtgaacccctaatctaatatgactggcattcttaagmaaaagggaaattcagacacagacatgtgcagagggaaaacatgcacactggtaaaacaccatgtgaacatgaatcagaggtcaggggtatgcttctacaagataaggaatgccaaaattatcagcaaaccaccagatactataggagaggcatgaaacagattctcccttgcagaccccggaagagattgaccctgctggcactgtgatttcagacgtctagtctctggaaatgtgagacaagacatttctgttgtttaaggcactcagtgcatggcactttgttatggcagcaatagga

SEQ ID NO: 20315 - DNA, 601 bp, Human
ataacataatcaaacgagtgattcagaaaattgcccttaaaattgtgcaaagcagattgggtagggagaagacaagcagagagagatgggcagagagattgattgattccctagggcccctcagatttactgatctcttgttgaagaaaataaagagcaaagaggagtaagcttggataaaataagacccccaaattcagacttgccttctttacacattgtttaacggtgctttgatcactttaactcatgtcagatttcaatgacctttttccacttcaccagatgctaggaagtaggmggaagtaggaagaggtcccagacaaaaggaaagtaaaagaaaccatgtgccctagaatgcatctaattctagacaagcaaaattctgaaaaatctcatggagaaaattgcctattcccatagttctactttggctaaaaaattgaactttgcttgcataatctgactaaagttttggcaacttttgcaaatcatctctttctcatggatacagtctccattattgcctttgagtgacagctacactaaaattacagaagctcttataccaaaatggcttggtaacactccagctaaaaca

SEQ ID NO: 20316 - DNA, 601 bp, Human
aaaacagccagtactaaataggaataaataactcccttgttgaattctctcatttattctctctttagctcctgttttccttcttatactttctcactcacttaatattatcatcaataattaacatcttaacaaattagtattgatcgagagctccctgtgtacagctctttgtacagggctttgaaggacaccgtgcaggagaggcaacgggctgggttcctggagggctcagtatgtttgattctaaagtcaagccaacctccttctcacatcttgttccctgcctggaaaggtggamaaacttggaacttttctccctggctagggaaagcatatgaaaagaggttgtttgaattgtgtcattataatgaacgggactaatttggaaagggaagttgtctccgtggatgggaatgagaggggagagggttagaagaatcgtagcgaaatgggaaagaagaaaggtttagacaaggtaagtctcattgtctcacagggcatcagcaagatggaagatcttcaaggtaaggttattccactttcccagttcttctaacccttcctgattaagctcaagagaaaattccaagcctttttt

SEQ ID NO: 20317 - DNA, 601 bp, Human
ggtggaggcgtttgacgtcaccgccactggggcagccggctggtccagttcctgcagggagttgtcctcactgatgtcatacaggttgcctgctttcttgcaagcctcacaccggatgcacgcctgcctgcccgagttctgacccgtcaccgtcgtggagtagttgtgcagcttggagggacagctgcggcagaagttgcccccggaccggtcctcccactccacgttggtcaggttcttctcccaaggtgcaggtaccccgctgaccacgccgtgtttgtcgcccgtcccgtgcttgatrtgagacctgttggtacagggccctcctccgctgacggagtcgcgcttaaagtcatcactccgctccttgtagatgtcggtcaggtctacgtgctcccagtggggtgagttctcctttgttcggaactggtccaggtagaagtcccgtagcccttccttgtccctgaagtagcgcttgtggtcaggggagcggggcggtcggcgacggtaggccagctcgatctcgtcaaactccctgcgggacttggccgaggcaggccgcttcttcaggctgtccttatattgctgcttacgcctcttg

SEQ ID NO: 20318 - DNA, 601 bp, Human
gtccccaaggcaccgtgggacactatcataacgtactttccagtttgttcaagaatccactctgccaccaatgaccttttgttctgttcaccaccactatcgagtctcatggggttgaagcaagcattttttggcttatatataaacacaaatggcctcccaacctctgcttggcacatgattcctagacagatgtcatctaagcagcatgaatttagccagagcctctttcctttcacaagcagtgtgctaaatggtctcacatagatgcttttgcttcctcacctaaatgaaaagatcmgtttgggaaaagctacctttgtgctcacatagcctctttttggttctcccagcttcactcaaagaggatatcaaggagctcttccacaccaggaggaagcccgcatgcagcccttcctttctccgctctaccctcccctgctgagagggcccatggcatcatctcatgggaacaggaatggctgacagcggggggaagaaggagagaactgtgaaaaggaggagagatggtgctggtcaccagggttgcccccagtaggaaccagaactccaggatcccataaataaattaaaacaagaa

SEQ ID NO: 20319 - DNA, 601 bp, Human
tccaatgttaagtgaagggagcatcagttctgccggtaccctcatccctggagttttatacatgtatatctttttttattcctcaatggtacaatctgagagggaaacaaggtgttgcaggaaggtagaagggcttctaccaagagtgttcactctgggctcaagtcacattcccagggagccaggcccaaagaggtggtggagggtccctctctgcccccgtctcccatttccaagtctcttcccctcttttcgtacctccagagctgcactcatggagtgcagctcatttctcttaaakgtcaagctcatttctcttaactgtctgctctgtagcagttgtaatcagttttggggggaagaagcctgctcgtctagcttcaggttaagtaagaagggatcaaagcattggaaacatccccctctctcacttaccctaccatacacgactccttacttcttcaaaggtggcttcgttcttccccaaaccttggccagtcgagagtctaaatgctcaaaagagctttgtagaatcttttgctcccaagtgtgggcaaaagaatcatggctgtgaaaattcggtttccctttagccttcctg

SEQ ID NO: 20320 - DNA, 601 bp, Human
agtaagaggaagtattttgctaatattgtgaaattcacacatattaagtaaagatctttgccaaatgtcctgctcattttataattggcatttccagcagaatttttttaacttgagaatgacatgactattgcttttgctcacctgtctttttctgttttcatccgtgcataaagtcactcctctttctgttctgactttttgctgtccatagacatcccagttaccagtgtccttgaattgatagtggcttctgtttgtcagtctcatataagaactacagctcatcaggaggagatcrcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagaggtgagtgcgtgctctttaga

SEQ ID NO: 20321 - DNA, 601 bp, Human
ggatatagccctcctcagggagttggtttgtagcacagtctgggaaacaatcggtgctctcatttcaaggacagagtgaaatgaacagaaatgaaccaaaggtgatgatgaggaagctgagattgcttctatgttttccctgaatcctgtccttactatgttggctttatcattttgtttggtaaattttgaatttctgcaatggaagtcatacacatattggactcttttttaaaaaacattatggttcacctccagcctgggcgacagagcgagactctgtctcaacaacaacaacaamaaaattctggttcacttgatggtgccaccaaaagttccacaggcttccttcattctttttcattcattcttctttttgcccttctgactgaataacttcaaatgacctctcttgaatttgctgattctttggcttaagtctgctgttaatgctttccattgagtttttcagttcagttattctttcattccagaatttttacttggctctatttttgtggttatctctttgttgatgtttacattttgctcatgcatagttttcttattttatttagttgtctgtctgtgttttcttata

SEQ ID NO: 20322 - DNA, 601 bp, Human
aaagatttacaaaagactgctacacaatgtttacatatattgaactgtaaggaatgaatttggaaggaaatattggatttagttctaaaatctgaaaccaaaaattaatatatagaattgttggggtatggagcagtcctgaagtggttgattttatgttatgaggccctgaggttggctgtgtgtgacagatctcacttatagttgaatcctgcttataattttattgtggactcatattatctcagggtcaggatatatcacaggaagtacagcaccaaggtaggaaactcgatgcacyagcagcctctaccaataaatattctgcctggaaaacatgtgagttctgtctcttatgggttttgttttgaatttacaaaaattttccagaagagcaatggtataagatgaatgtcaatttccataaaagcctattcactcataatattggtcaagtatgctactaatgctttgcacggactttattcctttttttctttaggaaaataagttttgattcaaaatggaaagccaaacatacatttgctccaccaaccttagcaattggaaggggaccatttctcctcccctcttacaatga

SEQ ID NO: 20323 - DNA, 601 bp, Human
gctactaatgctttgcacggactttattcctttttttctttaggaaaataagttttgattcaaaatggaaagccaaacatacatttgctccaccaaccttagcaattggaaggggaccatttctcctcccctcttacaatgatagtgtatacgttaggaggaaaagaccagaaaaagacatttctggtggcagtaggaaggaaatgaaagacaaataaacatcttgactaaaaaggtaaaagagtatacccaatggcttaatcagagacataaagaggagtggagtatctccagtagcatkgaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatcaccactgcactccagcctggatgaaagagcaaaactctatatccaaaaaaaaaaaaaaaaagaagttcctggttcaagaagcaattaatatatatataaacaaatataattgaaata

SEQ ID NO: 20324 - DNA, 601 bp, Human
agacaaataaacatcttgactaaaaaggtaaaagagtatacccaatggcttaatcagagacataaagaggagtggagtatctccagtagcattgaagaggaagaagaaagcattcttcagtggcagaattggttgggttttctttctccctggcccacaaaatgttcctggtcagggcgagcatggtggctcatacttgtagtcccagctacttgggaggctgaggcaagaggatcactggagctcaggagttcttggctgtagtgaactgtgatcaccactgcactccagcctggatgamagagcaaaactctatatccaaaaaaaaaaaaaaaaagaagttcctggttcaagaagcaattaatatatatataaacaaatataattgaaatagtttacattggaaacaacctaaatttgtttgtaaacaagctaagagagtaacacctctatatctggctttatcacttcacagataaaattttatagattaagccttcaagactttgaatagctggcaggtggacatcattcattcattcattcattcattcattcaataaatatgtattgaacatctcctatggataggtaccattgt

SEQ ID NO: 20325 - DNA, 601 bp, Human
ccactcatgctttcatggatttgtatccacattgatactctgttaactggagtaactttctactgtaccaagtagatggttcttgaaatatttaaacatttcaagcaccctggctgatttacttcatgtatagtgtcactaatttaatgttaccttcctttttccttgatgagaaagatgtctaggaaatatgcccatagtttctttcttgaacatgtttctcaactgccctttgcctttacatagctcaccaagcccgactcagaatctgccctctgggtgcgtcttccaccagcttttstttcatcctgtggcagatagtatcctttctctctatatctgaacagtctgaaaaattgttccacattgtaaatttaaattctctttaattttttttcagcaattgtgttttctttcaatacatttttaaattttctttctaagctttgtatgtgtatatttaaaactaaaagcccttttcataactcatgtcattaaaacagaaccttgatctattttggtttactccagtacctcacttgactggtggaaactctacaagagatataaatagtttttaaggaaaaaggaatttcttaac

SEQ ID NO: 20326 - DNA, 601 bp, Human
gaacatcagtttgtttatactttttttctagtattctttgaaattttcctttaaagcatttctgaagaggcttaatataaagttactttttattttttattttttttttagaaacagggtctcactctgtcatccaggctgaatgcagtggtgtgatcatagctcactgctgcccagaactcctgggctcaggccatccttctgcctcagcctcccaaaaaactgagattaagggcatggacctaaagttacttttttaaaatttatttttatttttttgagacagggtcttgctctgtcrcctaggctggagtgcagtgcaatcttggctcactacaacctctgcctccctggctcaagccattttcccacatcaacctctcgagcagctgggactacaggcatgtgccaccatgctcacctaatttttgttttggtttttgttttgtagagatggggtttcaccgtgttgctcaggctggtctcaaactcatgagctcaagcattcacccgcgttggcctccaaaactgctaggattacaggcatgcgccactgcgccttgtctctaaagttacattttttaaatctgatttatttagt

SEQ ID NO: 20327 - DNA, 601 bp, Human
ccgcgttggcctccaaaactgctaggattacaggcatgcgccactgcgccttgtctctaaagttacattttttaaatctgatttatttagtgaatcaaatacaatttagcacatttactgctgacagaaaatgtaataggggccaggcacggtggcaaatcccagccctttgggaggtcaaggtagacagatcacctgcggtcaggagttcgagaccagactggccaacatggcgaaaccccgtctctactaaaaacacaaaaattagccaggcatggtggcagatgcctgtaatcccagytaatcaggcaggagaatggcctgaacccaggagacagaggttgcagtgagccaagattgtgccactgcactccagcctgggcgacagagtgagactccatctcaaaaaaaaaaaaaaaaaaaagtaataggccccgtttttgattccctgaaatttcaaggtttatttggtctataaataatagaataaatactggtgttgaaatttgcagaactgaacattggagttttacaaaccagcactattgtcaggaatgttttaacaattcattcatctgtctcctactcatgagtgatcatc

SEQ ID NO: 20328 - DNA, 601 bp, Human
acagaaaatgtaataggggccaggcacggtggcaaatcccagccctttgggaggtcaaggtagacagatcacctgcggtcaggagttcgagaccagactggccaacatggcgaaaccccgtctctactaaaaacacaaaaattagccaggcatggtggcagatgcctgtaatcccagctaatcaggcaggagaatggcctgaacccaggagacagaggttgcagtgagccaagattgtgccactgcactccagcctgggcgacagagtgagactccatctcaaaaaaaaaaaaaaaaaaaagtaataggccccgtttttgattccctgaaatttcaaggtttatttggtctataaataatagaataaatactggtgttgaaatttgcagaactgaacattggagttttacaaaccagcactattgtcaggaatgttttaacaattcattcatctgtctcctactcatgagtgatcatctgctctgtggatcatatgtgcttgattttccttgctgactagctggtcccagactgcaggcagcaggaccaagccaagaaggggtcatggacaggtccagaaggaaagagtgtgaatctatgt

SEQ ID NO: 20329 - DNA, 601 bp, Human
tttatttggtctataaataatagaataaatactggtgttgaaatttgcagaactgaacattggagttttacaaaccagcactattgtcaggaatgttttaacaattcattcatctgtctcctactcatgagtgatcatctgctctgtggatcatatgtgcttgattttccttgctgactagctggtcccagactgcaggcagcaggaccaagccaagaaggggtcatggacaggtccagaaggaaagagtgtgaatctatgtgtctgacagaagctttgtttacacgagtaacatgagaarcattccagaacacctctgaccttaataaccagtcaagctgataagatagtcttaagtctctcactgtgctactgtgtctgtctgcttaagtccttggcagccagtttactcaaaatttattctcagggctttgtgttctgaatcgttcctacagcttcttgcaatactcagttatgatgtgtttccagcagtgtgcctcttaaaataatctcaaaacttaagccaacaataattatttttttgaaattttgaaatttttgtttaccacttccctgatgtccctaaatataaaaaaaagaa

SEQ ID NO: 20330 - DNA, 601 bp, Human
tatgtatgaactcatgctggtgtgtgtgtgtgtgtgtgtatttgtataaggcacacatgtgttggctggtgcatgtgcaatgcttacacccacttgcattttttgaaggtgagggtaggaattgtagtttgaattgcactatgtgctgtttggacaaactaagcttcgctcatttggcaaattttgtcataatcactcatcactatcagaaatcatcacaaacaattaggcaaacatgaatcaacaagtcgtgcagttaaaactgcaaaaaaatcttatcaataaaaaagcatgctattayagtctcaatttctatgctgtaaaacaagtgcagtaattgcatgaagaataggtttctttcattactaattttttatacaaaatcaaggattaaagtttaatataatgatatctgagagataaacacagccttaaactaagaagcaaaagattctatgtatttgctttaggaaaatatataatattacttaaaagtgaattctatctgtatgtaggtttttcttggttatcagaattaccatcctcttcttggccacttcacatttgaggttgctagccagggaaggttctcctgagtaca

SEQ ID NO: 20331 - DNA, 601 bp, Human
aagttcactttaaaggtaaatatttcttatgaagaataacaaaacattctatgtcatatatattttggggttttccaacattgttctggatggtatatgtcattgctcctttctcataaaattgatagtcaagatttgcttctacagaaaagggaatttaaactattttctttctttctttctttcttttttttttttttgagacagtttccctgtgttggccaggctagagtgcagtggtggctgatctcggctcactgctacctctgccccgccaggtcccggttcaagtaattcttcygcctcagcctcccaagtagctgggattataggcacacgccaccatgcccagctaatttttgtatttttagcagagatggggtttcaccatattggccaggctgctcttgaactcctgaccttgtgatccacccacctcggcctcccaaagtgctgggattacaggcgtgagccgctgtgcctggcctaatttaaactattttctatcattgtttctgtatattataatctgaacttttagcatgtatttataagtttataacttaaaatattgaaatatttccaggaaatctttggaaag

SEQ ID NO: 20332 - DNA, 601 bp, Human
tcccagtgctcaccgctgcaggtcatcaccatgctcaatgcactgtacactcgcttcgaccagcagtgtggagagctggatgtctacaaggtaggagtggaccagggaaataattgttttaccagcaaactcactggggaacaagcactgtgcctaggacctgaattataatgcaactgaaaggccacctctgtagggtcttgcaagcccagtcctgggagcaggtatggtgcattcattatgtgggtgttttccagccagcaatagctctgaatctgcccagaaacagagataattgttstgggaggactgccacactgtcctctcaaagaatgaggagagaatggagggaggatagggtgctcaaagaatggaggatggggtgtaggacctgtgaataggagaagtttaatagtgaatctgccacttcactgtggaaaccgagttgaattattaagtgtgagataattcaaagtatggcttatacaaggaaacattatcctttgtatctgtaagagtaaagacacatgaggattataaaaattgcctttaaatagattacttcaatatagagttaacatgatacttttcatggccagtt

SEQ ID NO: 20333 - DNA, 601 bp, Human
acatatggagagggagaagagggcacaatggaccaatgccagatttccatatgacgtgacgaagggatgcagtatgcacaaagggctgcaaaagcagatatggtaggcccctaacatcaggtaggggtgggtgtaggacttcttctaattagcctatttattgagcacctgtgatggccatcatgatgagcacttcttatgtactcattgctgagaaaaagcttatgggtggcattgccacctggttcattcattactgggcacaggtaatgtaggagtcaataaactagacaaactcaargggcttacatatgattaggggaaacaaagacaataaacaaatgagtaaatttatagtatttaagtcagtataataatgtgaaagaaaaataaagtaggttaaggggaagaagaagggcagtgggtaaggggtgattgctatttcttagagggtggtaggaatcagcttttctaataaggtgaggttttagcagggactgaaggaaaggagggacaaccacgtggttatctgcagagagattgctccaggagaaaggaatagcaagtgggagcatgtttgatgtgcttaaaggataatgga

SEQ ID NO: 20334 - DNA, 601 bp, Human
ggtgggtgtaggacttcttctaattagcctatttattgagcacctgtgatggccatcatgatgagcacttcttatgtactcattgctgagaaaaagcttatgggtggcattgccacctggttcattcattactgggcacaggtaatgtaggagtcaataaactagacaaactcaaagggcttacatatgattaggggaaacaaagacaataaacaaatgagtaaatttatagtatttaagtcagtataataatgtgaaagaaaaataaagtaggttaaggggaagaagaagggcagtgggyaaggggtgattgctatttcttagagggtggtaggaatcagcttttctaataaggtgaggttttagcagggactgaaggaaaggagggacaaccacgtggttatctgcagagagattgctccaggagaaaggaatagcaagtgggagcatgtttgatgtgcttaaaggataatggaaggcagtgacattggaactaagtgagcaatatggagaataagaagataaagtcagagattaggagaaagacaggtaaagaagaaatctggagccataataagggtatcagcatctactctgaggg

SEQ ID NO: 20335 - DNA, 601 bp, Human
agcatttatttatagtatggaaaatatattatgtctaggtggagaccattggcgatgcctattgtgtagctgggggattacacaaagagagtgatactcatgctgttcagatagcgctgatggccctgaagatgatggagctctctgatgaagttatgtctccccatggagaacctatcaaggtaaggcagatgatatattgtccaaaagatgtcacaagagcaaatgcgtatagttgattaccaaaaccatggtgtatcagttgggggttagttgagagagagagagaaagcaaaatctrtatagagaacacaatcttctctaacttgtttacattggaagaaatttattatagggtattaaatggcttacagaatcattgagaggacagaagaacccatctataagttgggctttcaaaaaatgtttcccatagtatagggattttctattgtcaaagtaaaatggcttctaaaggcaaacttcagaacaactgcattttcaaaaatctggaagctgattccaaaactatcctaccaaagccacagtcaggaaactgccatgttcagaaagctgctgcctcttcaaaaccacatctact

SEQ ID NO: 20336 - DNA, 601 bp, Human
tgcaacatacttttctaaatttaatggtataaaatcacaaacttttattatgcgtggattctgtgcatcaaaaatttggataagtcatagcaggaatacctcgtctgtgctctacaatctatgggacctcagctgggaataccgaaatgggtgagggtgcctggaatagctgggattgcaacgattgaagctggaggattcattccaagactgctgcttcacttacatgtcagattccttggtggggatggctgaaaggttgggttcagctgggattgttagcgttacatgtgatgccctratatgtattttttatgaggtggttcatgtcccactgaacaagactggtggaagctgcatgacttagtcttggaagacacaccgcaacacttccactgcactctatcagccagagcaatcacaagtctgcccagaagagagagggctcagagcccaagaatcaataggaggagtgtaaaataatttgcaagtatgttttaaaagcatcacaatatctgactttttcagatttattttcgataattgcatttttttagaggaggactatatatttctttctctttctaatttgtttgagggg

SEQ ID NO: 20337 - DNA, 601 bp, Human
agatatgctcagggcacgatgtgtgtcttaaacacgttgtgttttaaatcttgctgatgaatttgaaaagctctgtaagaaaatgttagggttgagagattcaaaactggagaaggggaggaaggcagcacggcatggaaggactaggagggacacttgccttgtctgcatcgtttcggtttttacgagcagaatatatttacattttaattatgaaacaagataaaaatgctatggtaaatttaatatataataagctggagtaactaagtataggaagaaaaactggtttaaccagaasagtgctcacagaaagcaaaaattcctcaatctaaatatgctgaagtcatagttgatatttatgagcagaagagctttattctatctatctatctatctatctatctatctatctatctatcacttgctaaatgtgtaaattaatattctcctaaaagagacaaagccagatatataacagacatctaagttttgcttgttaaagtaaaactttgatgaagaaaggtctttaaaaataatcaaacccctgcattttataggtgaaaacatgatcggagggaagtaaagagacttaaggaag

SEQ ID NO: 20338 - DNA, 601 bp, Human
aaggaagccagactaccagttactagtagagcttgttagaatacaaagttcctgattcacagtctagtgcttttgtttgaaaattttgtagaactcatatgacatcttaaaagtaaatgagtctggaaagtttctagcagatatctgaaattagttattaaaactagacataactgaattcttctgatttctaaattatatccaagttactgagttcttggtcttcattcaaaacgcatacatctaatacaactttttaaaatggttgagtaaacaaagagtttgaaaataattaacatgrtatcatcatcatttaaaatatctccactttagcttgttttgtagtagcagtaatttaagtgtttgtgaatcttttaagatcatcaagtaatcagacctttgaagattccattgttaaatatcctgctttggctaggcaaggtgacttacatttgtaatcctagcactttgggaagttgaggcaggaggatcacttgagcccaagagtttgagaatcagctgggcaacatagcaagaccttgtctctacaaaaaatttaaaacttatccaggtgtgatggtgcatgcctgtagttctagct

SEQ ID NO: 20339 - DNA, 601 bp, Human
cccttgctatgttgctgtggttactatgatccctgtgcatggaaacttgtttcagatgttgaagacagacacaattaagatggtttgtgtaataaacctaaatggaaaagagttaagaagtgtgactgttgattctgcactagtaatttttaattgcatgtgaggagtagagggaagttggctgaaggttttgaggaaaggggtggtgtcctgagggtgaatggtaaaataatttagacggtattcaaacgacactgacgagtaggaagtgttttaccagtgactgggaacatcatgttawtttttgctttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataact

SEQ ID NO: 20340 - DNA, 601 bp, Human
tatgttgctgtggttactatgatccctgtgcatggaaacttgtttcagatgttgaagacagacacaattaagatggtttgtgtaataaacctaaatggaaaagagttaagaagtgtgactgttgattctgcactagtaatttttaattgcatgtgaggagtagagggaagttggctgaaggttttgaggaaaggggtggtgtcctgagggtgaatggtaaaataatttagacggtattcaaacgacactgacgagtaggaagtgttttaccagtgactgggaacatcatgttattttttgmtttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcttcataacttttttcttccttagtcgtaaggaaaaaagaaacgtgataacttttatca

SEQ ID NO: 20341 - DNA, 601 bp, Human
gacactgacgagtaggaagtgttttaccagtgactgggaacatcatgttattttttgctttcagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacaggtagtaattatgttaaacacctaaaatctcttgtttttatttatatacaattgccatttgccccactgatttgattcattcktcataacttttttcttccttagtcgtaaggaaaaaagaaacgtgataacttttatcatcctcactttaacttttttacactgcttattagcctcctaagaatgacttgcctgaggtgtttgtggcccagccataaatccatgacagatattacatagtcttccatcattcttcttttagaagcacatattaatactcttagtatgttgataggtgttctgacatcaactagtacactgcagtgcagttctggcagtaaacacccagactcagcacagtcataaccacaagttacagggca

SEQ ID NO: 20342 - DNA, 601 bp, Human
cagtcaaattccctatcatacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatccgtggtaactagaaatatatctttcatgtacattttgtctcattataytggaaactcttaagtaacaaaagagtttttcagatctatacagtagctaaattatactaagcaagttagctttcctattctcagagataactctttaatagcatcttctcccttcttcttctacatttatttatttatttatttatttatttatttatttatttatattttttgagactaagtcttgctctatggcccaggttggagtacagcagctcagtcttgcctcactgcaagctctgcctcccagtttcaagtgattctcctgcctcagcctcccaagtaggtgggattacaggc

SEQ ID NO: 20343 - DNA, 601 bp, Human
ttcatgtacattttgtctcattatattggaaactcttaagtaacaaaagagtttttcagatctatacagtagctaaattatactaagcaagttagctttcctattctcagagataactctttaatagcatcttctcccttcttcttctacatttatttatttatttatttatttatttatttatttatttatattttttgagactaagtcttgctctatggcccaggttggagtacagcagctcagtcttgcctcactgcaagctctgcctcccagtttcaagtgattctcctgcctcagyctcccaagtaggtgggattacaggcgcccgcctccacgtctggctaatttttgtatttttagtagatactgggttttgccgtgttggccaggctggtctcgaactcctgacctcaagtgatctgcccaccttggcctcccaaagtgtaggattacaggcgtgagccaatgcacctggtcttctcccttcttaaggcaccagcatcctttcctttccagcccagactctcagttgataatcttgcctcatatttcaccaccagaatagaagtcagacaggagctttgccatctttgtgctg

SEQ ID NO: 20344 - DNA, 601 bp, Human
gcccaccttggcctcccaaagtgtaggattacaggcgtgagccaatgcacctggtcttctcccttcttaaggcaccagcatcctttcctttccagcccagactctcagttgataatcttgcctcatatttcaccaccagaatagaagtcagacaggagctttgccatctttgtgctgtaggttctctcagcagagctaccccagtactcatctcctccttctttgttcccattacattgggccagctcccctcctgcccctggttgatacagttttactctcagtgctatttcctctcacsttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttcaatttctgctctgttttatagcaaaactgaaagaagttgtctatactcactatctgtattttttccacctcttattttctcttcaactcactccagtcagtgtttactccactcaaccggttcttatcaaggtcatcattgtgcc

SEQ ID NO: 20345 - DNA, 601 bp, Human
gagctttgccatctttgtgctgtaggttctctcagcagagctaccccagtactcatctcctccttctttgttcccattacattgggccagctcccctcctgcccctggttgatacagttttactctcagtgctatttcctctcaccttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttmaatttctgctctgttttatagcaaaactgaaagaagttgtctatactcactatctgtattttttccacctcttattttctcttcaactcactccagtcagtgtttactccactcaaccggttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagt

SEQ ID NO: 20346 - DNA, 601 bp, Human
tttactctcagtgctatttcctctcaccttctcaataacttttctgtggaaattaactctctatgatcaatttctctttgatgaaatgattattcccaacagaatacaaccatatctattaaagctctgaattgaaaaataaaaaattccttgtttccaagtccggcttctgctacaattttcaatttctgctctgttttatagcaaaactgaaagaagttgtctatactcactatctgtattttttccacctcttattttctcttcaactcactccagtcagtgtttactccactcaacyggttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagtgtcttctcttggtactccttccctaccaaacctttgttgccgtgctcagagcctcttttcctgttatcttctgtatctgaacttttatgactctaactattttttaaaaaaaatcttt

SEQ ID NO: 20347 - DNA, 601 bp, Human
gttcttatcaaggtcatcattgtgccctgctaaaataaaatcactgtcagttttctctccttatcctctcagaagcatttgaataggctgagaactccctcatttaaacattttcttctttaaatttttggcaccacattcacctagttttctcactaccccatgtctacaccttctcagtgtcttctcttggtactccttccctaccaaacctttgttgccgtgctcagagcctcttttcctgttatcttctgtatctgaacttttatgactctaactattttttaaaaaaaatctttcrcccatcctgtgattctctgcagagctacagactcatatatcctattccatatttccacttggatgactaattcacatattaaaatgaactggaccgaattagaatgagtgatttcccacacagactgatgaaatccacttcccacccaggcaagcttaccaatcaccttaaaatgatatcaccatccacctagttactcagaccatcgaccttacagtgatcatttcttctcctctctttaaagagacactccttaactatcataactatagcaacaaccttctcctcacataccctctc

SEQ ID NO: 20348 - DNA, 601 bp, Human
agtgatttcccacacagactgatgaaatccacttcccacccaggcaagcttaccaatcaccttaaaatgatatcaccatccacctagttactcagaccatcgaccttacagtgatcatttcttctcctctctttaaagagacactccttaactatcataactatagcaacaaccttctcctcacataccctctcattatcctatttcatcttctcagttcacacctgtatctgaaattgtcttatgcagtatttatttatgtgttgattgcctgcctccctttttagaatgttagcttccwgtggtacacattccatattcccagctcctagatcagcgcgtgaaacacagaaggaaagcaagaagtatttactggttaactgttgactcctgggtatgaaaacaactcagtataacctgagaattggaaaaatccctggggttcattgtaatggtaattggcctatggtcctactgggtataataggtagggataagaatccatgccttgagataatatgattctactctctctgtaggcattaagaggaatcatcctattaagtaggagtcagttgcccatcctttcactgacacctgt

SEQ ID NO: 20349 - DNA, 601 bp, Human
cagcagaggaccacaacatgttgacatatatttctgacaacaggacaatgctcatgacttaagtcttagattcactgtattggcaatgttactagaaatgcacatataggtttttatagcatagatggtgttatcttttaaataaattttttattactgtggtaacacatgcccatttcagaaaatttacaaaattagtaaattataaagtaagtaataggaataagtcataatctcattacccagagatagtaactattaacatttctgtctttgtttcagttacgtttatatacacatrcatgaatgacattgaaattttaatttaatttatattgaacttcagctcatttgctgaagtcatttctactttttatagacaaatatgatatagcttttttccttttgtattgatttcaataatagtttactttctttttattctcgtatatgagatatttatgccttgcctaagggaaagcagtagttaatactgtcttatttaggcaaaatataaatacttaatgttaaatacttttaacaacattttaaattcctttctttcagagatacttcacttttcttccatatgctgggaaaa

SEQ ID NO: 20350 - DNA, 601 bp, Human
taattttaggggataatattcgacattttgtttgcattcttgaagtaaggaaaactaatagagactagtagagactacattagatcagtgagtcagtggatccaggtctactacattagttccaggtcagtgggtcaatgttagaggattatgtggtgatccagggatcattagaaacaaaaatggcaagtggggaggatacatggatgctgtccagtttgtggggtaaacaggcctagaatctcttatttgtaggacaagtctgagcacattgtgctagagaagcaagaattgacttctrtaagaagaaggaacaaagtgaataaaggaatataggaaagataacagagaattggagcattgatgcagtaatttgcggaaaaatggtgtctggtgaagaaggtgtagagaaaaatgtccacctatgaggacatctgggctgttgctgccttttttgggtgttgctatcatcaagctttcatcgaaatggtttgtttttctaaatggtttttcttatatattctgattttttaaaaagacaatataatgaacatttcaaactccatagcattctaattatgtttgtctgttaagtgtcttt

SEQ ID NO: 20351 - DNA, 601 bp, Human
tcataaatctagattattcattttaactattgctaatggagtggtttgctggtaaaccagctttggaggatgaggtagagaatccatgattccagcatttgccaatttctgtggtgttactatgtccactctggcaggtttcaggctatggatggcttaactgtcttacaaagttcctgaattttaacaattggctctcacaagccagtatgaaccagatctagcatgttactatatgtgcatgtgatataatgtgtattctagagtatgaatgagccagactctatcttctacctgtggktaattagagtgtgtccaatttttcattattacaaaaagtgattcaataggtatctttatacatatgtctttagataatataactaaaaatggtattcccagaccataggctatacccagtttcaactttaccaagcattaattagctgttcaaaatgattttaccaatctatgctccaccagtagtgtatgaagtgtgctattctccaaggtgatattgtcagacttactgttaccaatatgataggtgtggtgtgatttctaattgatgcttagtcagtttttaaaaattgatttattc

SEQ ID NO: 20352 - DNA, 601 bp, Human
gaatccatgattccagcatttgccaatttctgtggtgttactatgtccactctggcaggtttcaggctatggatggcttaactgtcttacaaagttcctgaattttaacaattggctctcacaagccagtatgaaccagatctagcatgttactatatgtgcatgtgatataatgtgtattctagagtatgaatgagccagactctatcttctacctgtgggtaattagagtgtgtccaatttttcattattacaaaaagtgattcaataggtatctttatacatatgtctttagataatrtaactaaaaatggtattcccagaccataggctatacccagtttcaactttaccaagcattaattagctgttcaaaatgattttaccaatctatgctccaccagtagtgtatgaagtgtgctattctccaaggtgatattgtcagacttactgttaccaatatgataggtgtggtgtgatttctaattgatgcttagtcagtttttaaaaattgatttattcaattttcacaactgtcctaaggaatatgtactattattatccccattttaaaggctggataatggacatctgtgctgct

SEQ ID NO: 20353 - DNA, 601 bp, Human
ttaacaattggctctcacaagccagtatgaaccagatctagcatgttactatatgtgcatgtgatataatgtgtattctagagtatgaatgagccagactctatcttctacctgtgggtaattagagtgtgtccaatttttcattattacaaaaagtgattcaataggtatctttatacatatgtctttagataatataactaaaaatggtattcccagaccataggctatacccagtttcaactttaccaagcattaattagctgttcaaaatgattttaccaatctatgctccaccagyagtgtatgaagtgtgctattctccaaggtgatattgtcagacttactgttaccaatatgataggtgtggtgtgatttctaattgatgcttagtcagtttttaaaaattgatttattcaattttcacaactgtcctaaggaatatgtactattattatccccattttaaaggctggataatggacatctgtgctgctagagctatcagactttgaagcttatacttttaatactgtctaattctataccttttcattatgtattctcaaataatagtcactcaaaaatatttataaattca

SEQ ID NO: 20354 - DNA, 601 bp, Human
ctcaaataatagtcactcaaaaatatttataaattcatgactaaggcatcattttcattagttttattgtttagcagattacatatttattgatgtactgatgaaaattaaactgtcattcttgagacagatttctattcagttggtttcttcaatacatagatgttgtcacagtaccaaaatctaattcaacatcatcattctatttaatgtagacatgacattacagactagtgagtagaagaccatggtctgtttgggtaaatataataaatgcttttctgtagaaattggttgagarcccacagccatgcaacatttttcatctatggcctgaatattaggttagagagaaggcttattaagttctcatttgatggaaagctagggaagcaaatggaaagagatgccaatagcttaatcagtaagattagaatttgaaataggtttagcataatgaacaagtagtaaaatagcaaacaatataatgtggtaaacagatgaatttcaggagaaaaaatattgctaataacaattagtaagtagagtggtgatatgtacaattaaatctcatttgagtcctactaatctagaattcata

SEQ ID NO: 20355 - DNA, 601 bp, Human
gacctcagcgagtctggcccagtctgtccctgcttctcccctctggccccaagtgttctcaaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcawgttgtgggaacttatggcttctcagcctcccactcggaacccacctctggtttatgctccagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtg

SEQ ID NO: 20356 - DNA, 601 bp, Human
caaatatgcccccgcctgcctgtctgtcactgcagctggcccagccctcatcctctctcccatgaacctctgtggtggcctgctctccctggctcccctgtctccagtttatgttccacacaggtgccaaaatgtctgcaaaaaatggagatttaacatacactagcccttggcttaaaacctgtacatgcttctctgccacctgcaaatgacagtcccatttcctcagcaaacctctgcatgttgtgggaacttatggcttctcagcctcccactcggaacccacctctggtttatgctycagaacatgatgttgttggaccctcccctccacctcctccaggctgagttagcctctgtctcccctcctgccctgggcatggctcttccagtagacacccccacatcacagtctaactctgtgtccacattccctgcaactgctgagctcctggagccaggccctgggaaccttgttcctgtttttgttcccagagccaaatagatatttgatgtatgattgttgaatgcagcagtgagtgaataaagacatgaatggttaactgaaaacattttatcaaaactgttatttgtcatcaga

SEQ ID NO: 20357 - DNA, 601 bp, Human
tgaatgcagcagtgagtgaataaagacatgaatggttaactgaaaacattttatcaaaactgttatttgtcatcagagcatgggccggtttccaacagctaacatttaggagtgaccatttgccaggcactgttctaagccctttgcatgtggccattcatttcacccacatagcgccatcaatgacatgctgtcactgcattgcttgtcaaaagggggaactgaggcacggaggctgagcttttactcaacatgccatctatgttgagggacttctgacttggatagccattcaactgcsagcactatggaggccagtcaggcctggccctgccttggaatttctgtgttattcagggacataatggggtttgtgttgatttttgttgggagtgtgtgggttaatctaggtgcaaccctcacctccttcccttctgatgtcctcactcccattggtcatgtgacccttaacgcccatcccaagctcagtgccaattccttgccccagggtcctggggattgacatggatcccaaaagcccgctgctgagaggacagggccactcccacccccctgactgtttcccagagcagctctgggg

SEQ ID NO: 20358 - DNA, 601 bp, Human
agatattgaaggaatgcagttttactgctctgaggtaggtttcaaggcttgagccaggcttagagatctttgtcctgatactggggataaagtgaagagaatatgaatgggtatgtctcgcatggttagaaaatctttttttttcctgtatttgtttaaaaagcattttgtaacttaaaaaaatacctatacaccttttttttttttgagatggagtctcactctgtcactcaggctggagtgcagtggcaccatcttggctcactgcaacccccgcctcctgggttcaagcaattctccyacctcagcctccccagtggctgggattacaggcatgcaccaccacacccagctaatttttgtactttttggtagagatggagtttcatcatgttggccaggcttgtcttgaagtcctggcctcaagtgatctgcctgccttgggctcccaaagtactgggattacaggggtaaaccaccacacctgaccataatacatcttaaatagaacattttccagctaatatttaaatgactgcatgtcattagaatctgaatgagtgttgtgttaaaatattttgtgttttcatatttatttact

SEQ ID NO: 20359 - DNA, 601 bp, Human
caggggtaaaccaccacacctgaccataatacatcttaaatagaacattttccagctaatatttaaatgactgcatgtcattagaatctgaatgagtgttgtgttaaaatattttgtgttttcatatttatttacttacttatagctacggataagaatataggcaaatttaatctcccgtaaaaattaaaaggcagatgttttcaaagcacagaattacatggtctactctagacattgctcctaaggttgagcagaggggataagagctttttctcttttttcctttcctctttttttyatacaaagttcgttgtagatattttagaaagtatagaaagccccgacaaggggaaacccactcaacccaattttaatgttgttgtcatttcttttagtttttttgggtgcatttctatgtagctatatcctattgtacaagcaatttaggatcttgcaatataaaatgaaggcatgacctttgagctggccaaaagtatgggctgatttttgcaaatgggtcctggcagcaggggacataagtggggaaccaatccccacacaagcagaggtgagctggcttaggggcgagtgcatagct

SEQ ID NO: 20360 - DNA, 601 bp, Human
tatgggctgatttttgcaaatgggtcctggcagcaggggacataagtggggaaccaatccccacacaagcagaggtgagctggcttaggggcgagtgcatagctgactttggatgtagactagatttggggaaatttaaatggggtccaagactggaaatgtgtaatgggacagaaggtagaaatgtttaaaatcttaagttgttgagtttgttctcaattttgtgaaaactctttatccctttttgttccccaccccattttctaaccagaagtcaaatatgacaacattcatgatgtaraaaaaccaattcatcagtgtgacttgtgggtgagggtggggacagggccggtgttggtatatttagttttagagatttgctggaaaagtaacatttttgcttttgtctttctttcgttcctccatttctccagaagaatatgaaagtgttactcagacttatttgtttcatagctctactgatttcttctctggaggctggtaagttaagtatttctttgtgttcttgtctgctaagaaaatctgttatttagaatacatgaagtaccttccctaacagagtcatttctcatactcgtct

SEQ ID NO: 20361 - DNA, 601 bp, Human
catccagaaatgagagcctggtgccttctatgcaatttcctgggcatgcacacagccctgcatacatgcccacccttctgggttccccaggaatgtgtcagagcttttcaaagccctctggaggttatggctctggtattgcagctttaggcagttgtaaaaaacaattaacactgagtttttccagcaaacgccttggggatagtgcttttgctgtggagctcttggtgaggtcaataacaccaccaccctatgaatgtgactttgaggacctgccagtcaagtcaaagagtggcagtgytctggaaatgggacttttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagaccc

SEQ ID NO: 20362 - DNA, 601 bp, Human
tttcgaggagctccaaaccctctctcttcttgcaagcctgctggttttcaaagcctttgtgtctgcaaagctcttgatattcatggctgttttagagctgggaagagtaggatggaagtcatttaagttataaagctacaaaccctgctgatccgtgatttggcatgtttctgtttgtttccttattttctagtaaatgctcttctggttactgcaagcctttgatttttgaaattttttgccagtctttttgttgcctttatggaggaatgatttatgagacccccactccaccatattrgaaatcttgcaaattcaatttctttgaatagaaaatagtattaatagatatagggcaatccaggctatctacttcttctcaagggagctttaatagtctggaaaatttgctcatttcatttacgttattaaatttattggcataacattgtttataatattccctcactaccctttacaaattatttaaaaaagagatgtcatctcttttttttcctgattagtctggctaaagatttatcaattttattgattttgtgaaagaatctgcttttggtatctttgatttttcttcattgtt

SEQ ID NO: 20363 - DNA, 601 bp, Human
tattttgaagcactgttagcagctacataaacatttggtattattgtgttcctgttgattaatgacttctttatttttttaaaatttatttatttatttattcattcatttttgggacaaaagtctctctgtgtcacccaggctggagtgcagtggtgcgatctcggctcacagcaacctctgcctactgggttcaagtgattcttgtgcctcagcctcccaagtagctaggattatgggtgcccaccaccacacctggctgattttttttgtattttagtagaggtggagtttcaccatsttggccaggctggtctcaaactcctgacctcaggtgactcacccgcctcagccttgcaaagtgctgggattacaggcatgagccaccacgcctggccgacttctttatttttatgaaatgccccttttttcttgtaatatttttactgtaaaatctactttgataataatagtcactcaagctttaactaattaatttttattaaggtatagttgacaaaatcgtgtatatttacagtgtacaatgtgatgttttggtatatgtatacattgtgaaatggttaaccctagctaattaatc

SEQ ID NO: 20364 - DNA, 601 bp, Human
ctactttgataataatagtcactcaagctttaactaattaatttttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccrcctttcaatgagagtgtttagactatttgaaattttagtgtgtttattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcac

SEQ ID NO: 20365 - DNA, 601 bp, Human
tttattaaggtatagttgacaaaatcgtgtatatttacagtgtacaatgtgatgttttggtatatgtatacattgtgaaatggttaaccctagctaattaatcaaactttcttttcatgagtgttagcctggcaaatatttttcttttctttttaatctatttttacctttatttataaaatgtctgtatgtaggtgtatgtgtttatgttaggcaccacatagttgggcctttctttagccaatctgatcatttccgcctttcaatgagagtgtttagactatttgaaattttagtgtgwttattcatatattagggtttaattctgggatcttgctatttgtttttctatttgtcccatcaattctgttatttttttctctttttttgctgccttttagattaattggcatttttaggattcattttattttgctttttggctttttagtcataactgtttgttgtgtatgtgtttttttaatgactgctctggggcttaaatagccatctctaagttatctctgtctgccttcaggtaacactatacagtttcacatatagtatacaaagttaagagtatatacccatttctcctttc

SEQ ID NO: 20366 - DNA, 601 bp, Human
cttgaataaatggaatacaatagtaataaactattttaatttttaaatttattaggcctattgtctgtgtcatttctgggtcagttttgactgatcgatttttttcctccttatcgttggttgtatgttactgcttctttgcatgcctaattatttttttggatgttagacattgtggattttaccatgttgggtgctggatattttcgtattccccagaatgttcttgagctttgttctgccacatgattgttacttggaaatggtttaatcctttcgggtcttgcttttaagcttaatkaggatcaggaaaaagtttattcttggcctaattttccctaatgactgagtcagaacccttctgggtactctgcctgatgccttatcattaatgaggctttccaccctggctgttgggaacagcaactgtttccagcattgggtgtgctccatgtgttactccctccagttcgtttggtagtcctccctctagccttgggtcattttcttatatgcttacactgactgatactcagctgaaaacttgggggagactctcagttatcccaagactctttctgcttgtcgttatgcagctcta

SEQ ID NO: 20367 - DNA, 601 bp, Human
tatgggaatgttctgagagcctgcacctggggaatctcagtgagtgtcagtgtctagcagcaagcatcggtgtggacactaatgagctttggaataagtcacatttccagaatctacctcctgttcattctgtgttaggtgttaacctctctaaccctgtttcctcttctgtaacaagatgatgcaatctcccaaggttattgggaagattagagatatggggtacacgaaacttgtgtacctggtgcaaagaaatgcttggtgcaaaacagctatgcaattaataggtgtaggatgattkttcttgttaattttcttgtgtctttcaattctgcgttaaccatgtttcatattgaaaactatatcacagcaaaatgaaacaaaatgcacaaattgccaggggatagtcagaatgctcaaactttttgtaaatattgagattttgtaagatttatgtaataaaataagagttattccaatcagaacttttttgcaggttataggggtgactattagtagttatgctgggacaacaggtataaattgggactatcccaagcaaactcagaatatgatcaccctataaatagcttcacttttc

SEQ ID NO: 20368 - DNA, 601 bp, Human
tactcggagtgaggtaatattttgttttctttccaaggcccacaccaatgatgcctagcactttttgttcactcaaggattcaaaaatatttattgagcatttactatgtttcaggaactgtaataggtatacattagggaaaaaaacagagaatatcctaccttcatggtgttcactttttttttgattgggggaataccgagtgctcaattttatagtttctcatagtttcttcatggccacagataaacccctgaaaccaatcttttcataaataagtcagattaatttctggggctycttgatacttttttgcctattttaataaattacagcattattccataaccctgtagttctcactattgggtcattaacacagtcattaaatgcaagcaggtctagtattgactagcccttctggccaataacacccaattcaaggaagtgactttccactactctcgcctttgctgacatgctttcacttaagagaggcatttgtctggggacccagggtcctggtgatgtgtgtgtttttcagtagcaccccactctatgaattcggaaggtctagctctaccccgggattcacagtgt

SEQ ID NO: 20369 - DNA, 601 bp, Human
gattttaatacttcaggatgtgtacaaataaggctattcattaaaatattaatcataatagtgaaaaattaggaaattgtgttcatcaataggaaatagttaatcatagtgtatatgtattatggaatgctaagcagccatgacagagtctattttggaagacaaatcatgtgggcccaaattcccaatccacagtaattacaaaatagtaggcaaaaagaccccatttcaaaaactgcacatgttcacagagaagataaggaatgagacgcataaggttactaatggtggttttctctgkgtggtgggtttagggtaattttcctttttctttgtgcatttctatatctaaaattttaattcaatagccatttattaatctagatagatcagaaaaaatcaattaatgttaagattaaaaatacattctttgcaggatcccagatacaattgatctgtaatgtcaccggccagttgagtgacattgcttactggaagtggaatgggtcagtaattgatgaagatgacccagtgctaggggaagactattacaggtatgtatgctaagagttattcacattttgatgttaaatcccacgtg

SEQ ID NO: 20370 - DNA, 601 bp, Human
cctactccatctgctccccagcttcctctttaattattggataactaagtagagaaggaggccaggagaatgtggaaatgtgaaacttccctaagcctccaccttattcgctttccaccagtctttaactttacccaatggactctctgacctcagggaacttttgtaggcttttgagtgattttaacttttccctgttttactgtggaatgctctatcctgtggtcttcggtattatttcccatgttattgtatattatgctatttaggtagaaacttcatagaatgcaccttagttttmtcattgctttgtacattagtatccattacaaagtgataataatgaatgagttaatattgtctgaatgcaggccattcccagatatgggctctctgagacgaagatatttaatttgctgtgctcaaagttttaattctttttggttctaatattttttctcctttttttttctttttgctatagtcactaatttccagaagcacatgattggtatatgtgtcacgttgacagtcataattgtgtgttctgttttcatctataaaatcttcaagattgacattgtgctttggtacagggatt

SEQ ID NO: 20371 - DNA, 601 bp, Human
tcccagctacacctgaggctgaggcaggagaattgcttgaaccggggagacggaggttgcagtgagccgagtttgggccactgcactctagcctggcaacagagcaagactccgtctcaaaaaaagggcaataaatgccctctctgaatgtttgaactgccaagaaaaggcatggagacagcgaactagaagaaagggcaagaaggaaatagccaccgtctacagatggcttagttaagtcatccacagcccaagggcggggctatgccttgtctggggaccctgtagagtcactgaccckggagcggctctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctgg

SEQ ID NO: 20372 - DNA, 601 bp, Human
ctcctgagaggtgctgcaggcaaagtgagactgacacctcactgaggaagggagacatattcttggagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatsctgtcctttgttattatcctgcattttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcc

SEQ ID NO: 20373 - DNA, 601 bp, Human
gagaactttccatctgcttgtattttccatacacatccccagccagaagttagtgtccgaagaccgaattttattttacagagcttgaaaactcacttcaatgaacaaagggattctccaggattccaaagttttgaagtcatcttagctttccacaggagggagagaacttaaaaaagcaacagtagcagggaattgatccacttcttaatgctttcctccctggcatgaccatcctgtcctttgttattatcctgcattttacgtctttggaggaacagctccctagtggcttcctccrtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttct

SEQ ID NO: 20374 - DNA, 601 bp, Human
ttttacgtctttggaggaacagctccctagtggcttcctccgtctgcaatgtcccttgcacagcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctyttgcctgcacccttcctcctcctttgcctaggaggccttctcgcattttctctagctgatcagaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacataga

SEQ ID NO: 20375 - DNA, 601 bp, Human
gcccacacatgaaccatccttcccatgatgccgctcttctgtcatcccgctcctgctgaaacacctcccaggggctccacctgttcaggagctgaagcccatgctttcccaccagcatgtcactcccagaccacctccctgccctgtcctccagcttcccctcgctgtcctgctgtgtgaattcccaggttggcctggtggccatgtcgcctgcccccagcactcctctgtctctgctcttgcctgcacccttcctcctcctttgcctaggaggccttctcgcattttctctagctgatcrgaattttaccaaaattcagaacatcctccaattccacagtctctgggagactttccctaagaggcgacttcctctccagccttctctctctggtcaggcccactgcagagatggtggtgagcacatctgggaggctggtctccctccagctggaattgctgctctctgagggagaggctgtggtggctgtctctgtccctcactgccttccaggagcaatttgcacatgtaacatagatttatgtaatgctttatgtttaaaaacattccccaattatcttatttaatttttgcaattat

SEQ ID NO: 20376 - DNA, 601 bp, Human
tggggagaatctgttgccttgctttgtcaggtctagaggctgcccacattccttgacttgtggccccttccattgtccataccagcaatgtctggttgagtctttctcatgctgctccctctggactgaccttctacccgcttctacttttgaggacactgcttacactggattcacccagataatccaggatcatctctctactcttagatcagctgattagcaaattgaatgtcatctgcaccttcattcctctttggcaggtcacatagctcattaccgggttccagggattgggagrtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccaactctaggaagctttgcttcccttcctgcccctcctcagaagcttcatgcccttctcaccatgtctcacctactgatgcctcctggtcatttgggcaattgtctgtctcagcagctaaacttgca

SEQ ID NO: 20377 - DNA, 601 bp, Human
cccagataatccaggatcatctctctactcttagatcagctgattagcaaattgaatgtcatctgcaccttcattcctctttggcaggtcacatagctcattaccgggttccagggattgggaggtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccawctctaggaagctttgcttcccttcctgcccctcctcagaagcttcatgcccttctcaccatgtctcacctactgatgcctcctggtcatttgggcaattgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaaga

SEQ ID NO: 20378 - DNA, 601 bp, Human
tcattaccgggttccagggattgggaggtggatgtctttggaggtggagaattggtctagctaccacagaaagggattttactacttgtgcccaaacgtattctgaattttcaggccttgcttcttggctcatgctgttacctctgtctgaaatttccctcctccattgtcgacactttactcctcttaatgtgggtgtcccaactctaggaagctttgcttcccttcctgcccctcctcagaagcttcatgcccttctcaccatgtctcacctactgatgcctcctggtcatttgggcamttgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgcgtgtgtgcactgcaaattaaatctcagcttgtcttaagggtttgcatgtttgttatatccatcaaactgtgac

SEQ ID NO: 20379 - DNA, 601 bp, Human
gcccctcctcagaagcttcatgcccttctcaccatgtctcacctactgatgcctcctggtcatttgggcaattgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgcgtstgtgcactgcaaattaaatctcagcttgtcttaagggtttgcatgtttgttatatccatcaaactgtgaccttaacagttccccctttagaagttatacttgaaataggtattcatagaatacagtcactttagcaaaagaagaaacaattttcaccagaagcaagtgtcacagtgaggtgtggaggctggttagcacaggctgttgacatgatttattgtgtttacataatgaaaaaatatgtaatccagagaaacatgccccaagcttagggagaggagggtgagagacagaatgtaa

SEQ ID NO: 20380 - DNA, 601 bp, Human
tttgggcaattgtctgtctcagcagctaaacttgcaatccaggagggtatacatggtcctcttctctgtcatgttcttagtacctaatggagtgcctgccacccattaggctgttgaatggaaaaatgatcgtaatcttcaatcatacagtcctttacttcctaagatacatttcataattttacccaacggtgctttccaacacactaagatgacatctctgtgtatgtgtgtgcgtgtgtgcactgcaaattaaatctcagcttgtcttaagggtttgcatgtttgttatatccatcaractgtgaccttaacagttccccctttagaagttatacttgaaataggtattcatagaatacagtcactttagcaaaagaagaaacaattttcaccagaagcaagtgtcacagtgaggtgtggaggctggttagcacaggctgttgacatgatttattgtgtttacataatgaaaaaatatgtaatccagagaaacatgccccaagcttagggagaggagggtgagagacagaatgtaaggaatctattttcttttgtattatgaagaaccagaatttcctgcaagtcaaagtgacagagg

SEQ ID NO: 20381 - DNA, 601 bp, Human
caagggcagccagccggagccttcctggcaccctggcttaccagccttgtggggtgccaggtgcattatcaatgttataaactgagtttctccttcattttttataggccagacaaactctagaattttacccttgcacttctgaagagattgatcatgaagatatcacaaaagataaaaccagcacagtggaggcctgtttaccattggaattaaccaaggtataaaggattttcctcccagagcatgcagtgtggttaaaaactgtgcatcaaatctcacctgcttctaaaaattcacrtttctggtatccatcattatgggattttaactggtcctacttcagaagttagatttgggagaaaaattatttttaaaaaatggttttttttgcaacaatgtgaatacacttaacacttaaaaatagttcagatgctaaatattatgatatgtgtttttaccataataaaaaaaatttgagacctgaagagtcagaaagatttatactaagaattaatactttgatatatgattttttccctctagaatgagagttgcctaaattccagagagacctctttcataactgtaagtcaaaaaa

SEQ ID NO: 20382 - DNA, 601 bp, Human
agaagacagccttgagggtgccgtctatagggagcacaaatgtgagcagatcacattatgaaaagcagactccaaagtattcactctgtggtatcccccacactcggcaaatgtttttgtgcattttcttatgtcagcctcaaaacaaccatatgggatctgcacaaaggagggaaccaaaccttaggagagttaaaccacttgtctgaggctctgcctcttaaaatccttcaagaggatttcactacacttaccttctcactcacctctaaaggctccaggacgtgctccaggatttgcmtgcaaggggccagtttgcatatctgcaaatattgctgggaaacaagcaagattggtgcctgattatgacccattgtgaaccaaaatgtgaaccaaataaaagaatgacctatcatctggggcatctataatgttattcataggcaagaacttgctttgttatgttctgaatcaccataacacagatgctaatataaaacaaatatttatataagtgagggtgactgctttggtgacgaggacatgggataaaaatatggtggcagaaatcattgtctgaaaagtaattgttttactttta

SEQ ID NO: 20383 - DNA, 601 bp, Human
gcctcttaaaatccttcaagaggatttcactacacttaccttctcactcacctctaaaggctccaggacgtgctccaggatttgcatgcaaggggccagtttgcatatctgcaaatattgctgggaaacaagcaagattggtgcctgattatgacccattgtgaaccaaaatgtgaaccaaataaaagaatgacctatcatctggggcatctataatgttattcataggcaagaacttgctttgttatgttctgaatcaccataacacagatgctaatataaaacaaatatttatataagygagggtgactgctttggtgacgaggacatgggataaaaatatggtggcagaaatcattgtctgaaaagtaattgttttacttttattcttttcgtgtgtgtgtgtgtgtgtgtgtgtgtgtgtgtgtgtgtgtgtgcatgtgccagatttcttgtttgaaaggcaatgagcttcatccaagtatcaaagaatgttagcatctagagagctgtagttgctatttcatttttaggaccaagagttgggtgatttgggtgctagaatcaattctaccagtaaccagacaactattcccaagtc

SEQ ID NO: 20384 - DNA, 601 bp, Human
ttgcatatctgcaaatattgctgggaaacaagcaagattggtgcctgattatgacccattgtgaaccaaaatgtgaaccaaataaaagaatgacctatcatctggggcatctataatgttattcataggcaagaacttgctttgttatgttctgaatcaccataacacagatgctaatataaaacaaatatttatataagtgagggtgactgctttggtgacgaggacatgggataaaaatatggtggcagaaatcattgtctgaaaagtaattgttttacttttattcttttcgtgtgtktgtgtgtgtgtgtgtgtgtgtgtgtgtgtgtgtgtgcatgtgccagatttcttgtttgaaaggcaatgagcttcatccaagtatcaaagaatgttagcatctagagagctgtagttgctatttcatttttaggaccaagagttgggtgatttgggtgctagaatcaattctaccagtaaccagacaactattcccaagtcacttaacccctctgtgcctcagtttcctccagtataaaatggggtgactttattctagctttcttttagactttttgtgaggaagatatgaaagtattta

SEQ ID NO: 20385 - DNA, 601 bp, Human
aatatttgaattttggaataccatgtaagtcatgcttactgttcattctcctaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaaagcgaggtccctccaaaccgttgtcatttttataaaactttgaaatgaggaaactttgataggatgtggattaagaactagggaggggraaagaaggatgggactattacatccacatgatacctctgatcaagtatttttgacatttactgtggataaattgtttttaagttttcatgaatgaattgctaagaagggaaaatatccatcctgaaggtgtttttcattcactttaatagaagggcaaatatttataagctatttctgtaccaaagtgtttgtggaaacaaacatgtaagcataacttattttaaaatatttatttatataacttggtaatcatgaaagcatctgagctaacttatatttatttatgttatatttattaa

SEQ ID NO: 20386 - DNA, 601 bp, Human
gggtgcagccgggggcagggggagccgggggagggcgcagggggccgcggggacgcgagcggagggctggatgcctgccgggctctctctccgccttcctcttccctcccagtcctgccgagctgacggcgtcccggatcacatggagcccccgccccaccccagcccgccccccgccgccaacgccggtggcccttccagtcgcgttactacccagagattcatttgtaccagggacggagggagagaggagagggaggaggggacacacacacacacacacacacacacacacacagasagagagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttt

SEQ ID NO: 20387 - DNA, 601 bp, Human
gtgcagccgggggcagggggagccgggggagggcgcagggggccgcggggacgcgagcggagggctggatgcctgccgggctctctctccgccttcctcttccctcccagtcctgccgagctgacggcgtcccggatcacatggagcccccgccccaccccagcccgccccccgccgccaacgccggtggcccttccagtcgcgttactacccagagattcatttgtaccagggacggagggagagaggagagggaggaggggacacacacacacacacacacacacacacacacagagasagagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttttc

SEQ ID NO: 20388 - DNA, 601 bp, Human
gcagccgggggcagggggagccgggggagggcgcagggggccgcggggacgcgagcggagggctggatgcctgccgggctctctctccgccttcctcttccctcccagtcctgccgagctgacggcgtcccggatcacatggagcccccgccccaccccagcccgccccccgccgccaacgccggtggcccttccagtcgcgttactacccagagattcatttgtaccagggacggagggagagaggagagggaggaggggacacacacacacacacacacacacacacacacagagagasagagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttttcct

SEQ ID NO: 20389 - DNA, 601 bp, Human
agccgggggcagggggagccgggggagggcgcagggggccgcggggacgcgagcggagggctggatgcctgccgggctctctctccgccttcctcttccctcccagtcctgccgagctgacggcgtcccggatcacatggagcccccgccccaccccagcccgccccccgccgccaacgccggtggcccttccagtcgcgttactacccagagattcatttgtaccagggacggagggagagaggagagggaggaggggacacacacacacacacacacacacacacacacagagagagasagagagagagagagagagagagagagagagagattgttccagctgctctcgctagagaaagggagtgacccaaggggccgcgagtgaagggacaggatggcttaggtacctctgcccacaggaccccacaacagggagaggttccagctacagctcctccgtggggtcatggcaggggctggggagtcccctcaaaagccctgagcccccctgcaccgccgctaagggacaccccagaagttagcatcagtgggactcggaagctccgatctcaacaagtaagttgtcttcttttcctcc

SEQ ID NO: 20390 - DNA, 601 bp, Human
gacaaactgccccttcttggaacaagtgttctacccagaagagctccctggtcagatagctctggtaatcacagggcgaaacaaaagcgaactggtttctttacagtggacttctcgctgtccttacccactgagtctcatcactgggagaggaggggatgcagaatttcctaaactcaaaaggttctcaccaaccccttacttggagagacctttgctgcaggggaagggcttttgtggctgggctccctctggggcagccagccctcagcattcttgcagaaggttggtttagtgaacscagggcaggtgaggctcctttctcacaaaaaaacagtgcatccatgctgaggcatcaacatccatgtatgcccaagaaaatgccctttgtgtggccagcatggcacctccctgctcagctactgactcaccagcagctggtagccaaggaccccccagttcctcagccactcagccatggcagacctctgtgaggtggctccagggagtccaaggcctgggaccgcctgaactctggcagaggaccctagtccccaccccactcgcagcaaaaccccacatcctgcatatttcatttctt

SEQ ID NO: 20391 - DNA, 601 bp, Human
caaggctgtggggacaacaagggtaacgactgaagggagaggcccggcccaggcaggcatcactgagagcagagagcaggctgtgggcgcacctgtgtgggtgcgctggggctgagaagcagccttggacctgggtctgctttgtatgagcccctcccagagaaagcccaaagtgggagctggagacggttgccttcagcacccaaccaacacagttaatgccttccttggccagaagattaaatatcagaaagctgctttcctgtgaccctaagcacagaggcctcctcatccataaacraagctgccctcctctctggagagaaagcaacacctaaaaatagcataggcatggcacgggctgagtagacagggaaacgaggcattggagcagcctcaaatcaagaagccaagctctgtgtgtgcgtctgctcctcttcctgtgtgtatgtgtgtgtgtatgtgagtgtggagccctctctccgtatgtgtccgcccaaaacaatccccatatgttccaaatgcctgtcagattctccgtgttcattcatgctgaatttatctttgccctttcctgccttttttcccatcttaatcttct

SEQ ID NO: 20392 - DNA, 601 bp, Human
ggcaattccttttaaatcagataccaacgacccattactgagaggtacagagcgtacagcccttggtgttctctgctgttatctgccaaatgtgtgtgtttttcctctgctgtgttctgtgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttckagtgctttttggcccaagaatctcagagtgcttctaatcatcacagtagtttttgtgttttgttttgttttgttttgttttgttttgttttgtttttttcacaatctcagccagcctgtggtgtgacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgag

SEQ ID NO: 20393 - DNA, 601 bp, Human
tgtgtccagtgtagcctattggagaatcggtctcattagagtgactcttagaaggtggcctgggactagacagcccctctgagcacatgcatagtggcatcagcagcttcctggcctactcccaatcacactgtgccctgcacctcccaccaagggggaaccccagcagctggggcttttctagtgctttttggcccaagaatctcagagtgcttctaatcatcacagtagtttttgtgttttgttttgttttgttttgttttgttttgttttgtttttttcacaatctcagccagcctgyggtgtgacctggggagaaagttgagtgtcaggggacatgatgagccagttggccctgaaacaggaatggggcaaagagaaaggagagccaggagcatttaaaaatcagcatctgggccaggcaagatggctcacacctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgagg

SEQ ID NO: 20394 - DNA, 601 bp, Human
ccctgcacctcccaccaagggggaaccccagcagctggggcttttctagtgctttttggcccaagaatctcagagtgcttctaatcatcacagtagtttttgtgttttgttttgttttgttttgttttgttttgttttgtttttttcacaatctcagccagcctgtggtgtgacctggggagaaagttgagtgtcaggggacatgatgagccagttggccctgaaacaggaatggggcaaagagaaaggagagccaggagcatttaaaaatcagcatctgggccaggcaagatggctcacrcctgtgatcccagcattttgggaggccgaggcgggtggatcatgaggtcaggagatcgagaccatcctggctaacacggtgaaaccccgtctctactgaaaatacaaaaaattagccaggcatggtggcaggtgcctgtagtcccagctactcgggaagctgaggcagaagaatggcatgaacctgggaggtggaggttgcagtgagccaagatcatgccactgcactccagcctgggcgacagagcgagactccatctcaaaaaaaaaaaaaaatcagcatctgccccagttgtggcca

SEQ ID NO: 20395 - DNA, 601 bp, Human
acatacactacgttttttcctacacatatatacttataataaagtttaatttatacataaagtacagtaagactaacaacaataatagaacaactataacaatatgctgtaataaaagttacatgaatgtttacactttctctatctcaacatatcttcgtattttcaatccacagtagacttgaaaccatggaaagcaaaaccatagataaaggggaattactgtatacaacgtgtcagctaaattcagaaattaatctctggggaattattcagtgtttcaacttatacacacacacayacacacacacacacagttgctccttcgtgtagcttttggacatgaagtgtattccagatcaaaagcttctgccatatttttttccttatactttagacaagaatgacaggaggttggacagaaaatcaccaatgcctaaagcaacttgaaacaaattttgcattctactttcacaaaccctcatttgtgatgtgcccaaagatacaatcaggtatattgtctatacaactcacccagagtcaatacaactgcacagaaacaacagaatacgatcttaatagtcttttctcctccactgtg

SEQ ID NO: 20396 - DNA, 601 bp, Human
cactgcactccagcctgggtgaaagagctagattctctctctcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcytttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaatgctaataaaatggtgctttaaaagatgtg

SEQ ID NO: 20397 - DNA, 601 bp, Human
tcagaggtttcagtgagccgagattgtgccactgcactccagcctgggtgaaagagctagattctctctctcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcctttgtgtttctatgtaaattttatcatcagtgtgtctatttctacaaatagtcctgatagggtttgaattgggatttctgtgaatctatagatcaatctgaggagacttaataatgatattgattctcccaattcatgaatatagtatacccctgtatttatttgttttcttgaatttcttttatcattgttttgtagttttcaccatgacagtcttgcacatattttgttaaatgtacagctgagaatttaattttttctggtgtacaat

SEQ ID NO: 20398 - DNA, 601 bp, Human
ttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctctmaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcctttgtgtttctatgtaaattttatcatcagtgtgtctatttc

SEQ ID NO: 20399 - DNA, 601 bp, Human
tttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctctctcwcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcctttgtgtttctatgtaaattttatcatcagtgtgtctattt

SEQ ID NO: 20400 - DNA, 601 bp, Human
caatttttttgaaaagaatatccttggcagggcacggtagctcacacctgtaatcccagcactttaggaggtcaaggtgggcagatcatgaggtcaggagtttgagaccagcctggccaatatggtgaaaccacgtctctattaaaaatagaaaaattagccaggcgtggtggtgtgtgcctgtattcacagctgcttggatggctgaggcaggagaatcgcttgaacccaggagtcagaggtttcagtgagccgagattgtgccactgcactccagcctgggtgaaagagctagattctstctctcaaaaaaaaaaaaaaaaaaaaggaaagaaagaaagaaaagaaaagaaaatcctttttgctttaacttgccttgcaggtttgtagaaaactcaattgttgaaatttgggtggatatatttctggattttctattctattccatgttggaccaataccacactgccctagtcactgttgcattatagtatatctttaaaggagtaatgggaatccttcaactacatttttttccccaataatttttggctattctgcttcctttgtgtttctatgtaaattttatcatcagtgtgtc

SEQ ID NO: 20401 - DNA, 601 bp, Human
tatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagtwttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatccttggcagggcacggtagctcacacctgtaatcccagcactttaggaggtcaaggtgggcagatcat

SEQ ID NO: 20402 - DNA, 601 bp, Human
ctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcggttgtttgccttcttattgttggattttgagagttctatgtacaagtcctttgtcagtcgtgtgatttgcaagtcttcttcctagwctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaattttgtatggggtgtgaactgtggtttgactgttttcttgtatatggatatccaattgtttcacacaatttttttgaaaagaatatcct

SEQ ID NO: 20403 - DNA, 601 bp, Human
caaaacaaaacaaaacaaaacactgccaaactgtttccaaagcatctgcatcgtgtttaatttccataagtaacgtatgagaattctaggtcctccaaataattagcagtccttcgtagtgtcagtttttgtttcagccttccttatgggtatgctgtggcatatccctgagattttaattcgcattttccagtgactaagggtgttgaaccactcgtgccttcctgtgcctatttgacactcctatattttctttggtgaagtgtctgttcaatcatctgctcattaaattttccttcgrttgtttgccttcttattgttggattttgagagttctatgtacaagtcctttgtcagtcgtgtgatttgcaagtcttcttcctagtctctgaagtttctttctttcatagagcaaacgttttaaatttttatgaagtaagacttctcagttttatttttggtgaattatgtttatactgccatatataggaactctttgcttaactggaggtcatggagattttctcctacattttcttttaaaagttttatagtttcagagtttacatgtaattccataatctccatttagttaaatttt

SEQ ID NO: 20404 - DNA, 601 bp, Human
aaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttcctcctgggatggtgaaaatgttccggacctagatagtgatgaaggtagcacgacactgtgagtgcactaaatgctattgaattrgacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgtaattttagaaaataatttaaaaggttttgtttcagtttgtaagatttcttttctggcactttaatggcttgaggtatcattatc

SEQ ID NO: 20405 - DNA, 601 bp, Human
aacaaccccaagctatatattaccagatgaaaggataaacaaaatatggtccatccatacaatggagtattacacagccataaaaaggaatgaagcagtgatccccactacactgtggatgaaccttgaatgcatgatactgaatgaaagacatcagatgcaaaaggtcacatagtgtactgtccttttatatgaaatttccagaacaggccaatctgaagagatgtatagtggattggtggctttcagcagctgtggggaggtgggactgaggagcgactgctaatcaggatggggtttyctcctgggatggtgaaaatgttccggacctagatagtgatgaaggtagcacgacactgtgagtgcactaaatgctattgaattggacactttagaatggttgaaatagtgatttttatgtgaattctacctaaacatgctattacagctcatatatactttttccatctggattcttcacaaaagaatatgttgtgagcatctttccatgatattaaatcatcttaggaaacattattttgtgttcttcaaaatgtgcatgttaagtattcaaatcagtcttaaatttttaaaaatatgt

SEQ ID NO: 20406 - DNA, 601 bp, Human
gccaattttcatatttcttcttttgatggacatttaaaaaaagtaagagtgaggctgaacatcttttgcacgtgttgatgttatttgctttctttttatggaactggtattcttattatttttcctctttttctttggaccctttaaaagtatttacttttaagaatgtgtattaagattgatttttttctgcctagtgttgcaaaatattgccttttaacttttggagggtacttttgattaatttttatgacgttaagtaggtccacatttttctttcacagctgtaaaatccatcaayttcccaggattttgtttagggtgggtgggggcccctttaccaaatgtgaagttttctcttattctcatgtctttttctgagctctttatgctgttccatgggtctattttcttgtttctgcaacagtgtcacactgtttttattcctgcgactttgtaacaattcttttaaaaagtttatttcgttacagggagaaaaggtctcacttgcaaacagagagaagctggagagttgtgtctttgctcccttgataaggattggggctggggtgtttccttagggacgacctggcccagctgc

SEQ ID NO: 20407 - DNA, 601 bp, Human
tggccaattttcatatttcttcttttgatggacatttaaaaaaagtaagagtgaggctgaacatcttttgcacgtgttgatgttatttgctttctttttatggaactggtattcttattatttttcctctttttctttggaccctttaaaagtatttacttttaagaatgtgtattaagattgatttttttctgcctagtgttgcaaaatattgccttttaacttttggagggtacttttgattaatttttatgacgttaagtaggtccacatttttctttcacagctgtaaaatccatcmacttcccaggattttgtttagggtgggtgggggcccctttaccaaatgtgaagttttctcttattctcatgtctttttctgagctctttatgctgttccatgggtctattttcttgtttctgcaacagtgtcacactgtttttattcctgcgactttgtaacaattcttttaaaaagtttatttcgttacagggagaaaaggtctcacttgcaaacagagagaagctggagagttgtgtctttgctcccttgataaggattggggctggggtgtttccttagggacgacctggcccagct

SEQ ID NO: 20408 - DNA, 601 bp, Human
atcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctatcatcatccatccatcatgatctatctctccaccatctatgaatcattcatttttataaatrtatatccatatgcttcttgctgttttacatgtacatatgtatatatttgtcactttttttcactcaacagggtgccttaatgctatctttttctgagtgctgtatattttattccatattttattcagctcatttctatgttgaagaggacattaaacattttcaattatagtcaatatttccaatttgccttccagagtgtctgtactgatttaccttctagcctgcagtatgtggtgagactagtgatccctatttccttcttttgtgtaactgtatagtattccattgtgtggctgt

SEQ ID NO: 20409 - DNA, 601 bp, Human
atctatctatctatctatttctatcatctatcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctatcatcatccatccatcatgatctatctctccaycatctatgaatcattcatttttataaatatatatccatatgcttcttgctgttttacatgtacatatgtatatatttgtcactttttttcactcaacagggtgccttaatgctatctttttctgagtgctgtatattttattccatattttattcagctcatttctatgttgaagaggacattaaacattttcaattatagtcaatatttccaatttgccttccagagtgtctgtactgatttaccttctagcctgcagtatgtggtgagactagtgatccctatttccttcttttgtgt

SEQ ID NO: 20410 - DNA, 601 bp, Human
atctatctatctatctatctatctatctatctatctatctatctatttctatcatctatcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctatcatcatccatccatcatgatctatctctccaccatctatgaatcattcatttttataaatatatatccatatgcttcttgctgttttacatgtacatatgtatatatttgtcactttttttcactcaacagggtgccttaatgctatctttttctgagtgctgtatattttattccatattttattcagctcatttctatgttgaagaggacattaaacattttcaattatagtcaatatttccaatttgccttccagagtgtctgtactgatttaccttctagcctgcagtatgtggtgagac

SEQ ID NO: 20411 - DNA, 601 bp, Human
tctatctatctatctatctatctatctatctatctatctatctatctatttctatcatctatcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctattatcatccatccatcatgatctatctctccaccatctatgaatcattcatttttataaatatatatccatatgcttcttgctgttttacatgtacatatgtatatatttgtcactttttttcactcaacagggtgccttaatgctatctttttctgagtgctgtatattttattccatattttattcagctcatttctatgttgaagaggacattaaacattttcaattatagtcaatatttccaatttgccttccagagtgtctgtactgatttaccttctagcctgcagtatgtggtga

SEQ ID NO: 20412 - DNA, 601 bp, Human
ttccattgtgtatatatatatatatatccacatggaaaaacaacattaaattacaaaatgaatgataaaaaagagttcttcttgtaccaaatgagacattacagataagactagggttttccttgacaatcctgccacctgacctaatcctttctcattctccaaaggtgtttctagagccatagatttgtttatctatctatctatctatctatctatctatctatctatctatctatctatttctatcatctatcaatgtatctatcattgatctatctatcatctatcaatgtatctrtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatctatcatcatccatccatcatgatctatctctccaccatctatgaatcattcatttttataaatatatatccatatgcttcttgctgttttacatgtacatatgtatatat

SEQ ID NO: 20413 - DNA, 601 bp, Human
gtgtttgtctcttctgcacctggcttacttcacttagcatgagttcctccaggttcttccatgttgtggcaaatgagataattttttcttttttaaaggctaaatgggattccattgtgtatatatatatatatatccacatggaaaaacaacattaaattacaaaatgaatgataaaaaagagttcttcttgtaccaaatgagacattacagataagactagggttttccttgacaatcctgccacctgacctaatcctttctcattctccaaaggtgtttctagagccatagatttgtytatctatctatctatctatctatctatctatctatctatctatctatctatttctatcatctatcaatgtatctatcattgatctatctatcatctatcaatgtatctgtcatctatctctattatctgtctatctatctatcatctatgtatctctgtatctatcatctatgtaactatgtctccatcatctattatctatctctctacttatttatctacctattatctatgtatctatctatatcatctatttatctatctatctatctatctatctatctatctatctatctatct

SEQ ID NO: 20414 - DNA, 601 bp, Human
agagagagagagagagagagagagagcagggtcaggacagaaaggaggagaaggggagaaagagggagagactgacttgtggtgagatgataaaactggagatggtagcaggggctggctgtggaagccttggggaaaatgttaatggcttcagttttagcccaagggcaatagggagccatgagaagtgtttgaacaggggagggacaagtcacatctgggtaccaggaagatctttctagggctagtgtggagggtgtactggagaggaccagctatagaatgagagcgcagtggggayattctgaggctcaagccaggccaggggctggaggaaggagaggaagcattggagtggacgggtgtcttggactcagtgtcctcccgtccatgcctttgcccagcacagcagtcctgggaagggaagaaacatttttatgcttctaaaataaagaatatttttgcaattttattttttaaaacacatttttattgatgcataatagatgcacatagttttgaaatacatgtgataatctaatacattcatataattgataaagatcaaatcagtgtacttgggatatccattgcctgaaat

SEQ ID NO: 20415 - DNA, 601 bp, Human
tgtgctctggagacctgggaaggacccaaccagggatctattttccaggtgctcccagcctggtgggggaactgtccctgggcaggacagtcccagcccacgtgggcagggatggggtttacagtaagggaagcaggactaggggggtatagaaagtgtctcagttgaaagcctgaataatgatcagtagataattgggtacagttggggagcagtgctgtaggtcaagaagaccacctggggtcttcgggggaggaagagagagaggagagagagagagagagagagagagagagagagwgagagagagagagagcagggtcaggacagaaaggaggagaaggggagaaagagggagagactgacttgtggtgagatgataaaactggagatggtagcaggggctggctgtggaagccttggggaaaatgttaatggcttcagttttagcccaagggcaatagggagccatgagaagtgtttgaacaggggagggacaagtcacatctgggtaccaggaagatctttctagggctagtgtggagggtgtactggagaggaccagctatagaatgagagcgcagtggggacattctgaggc

SEQ ID NO: 20416 - DNA, 601 bp, Human
agtcctcgttcagcaaatactctcatactgcattccaacccccacatctgtgcacagcatctttctgtgctctggagacctgggaaggacccaaccagggatctattttccaggtgctcccagcctggtgggggaactgtccctgggcaggacagtcccagcccacgtgggcagggatggggtttacagtaagggaagcaggactaggggggtatagaaagtgtctcagttgaaagcctgaataatgatcagtagataattgggtacagttggggagcagtgctgtaggtcaagaagaccrcctggggtcttcgggggaggaagagagagaggagagagagagagagagagagagagagagagagagagagagagagagagcagggtcaggacagaaaggaggagaaggggagaaagagggagagactgacttgtggtgagatgataaaactggagatggtagcaggggctggctgtggaagccttggggaaaatgttaatggcttcagttttagcccaagggcaatagggagccatgagaagtgtttgaacaggggagggacaagtcacatctgggtaccaggaagatctttctagggct

SEQ ID NO: 20417 - DNA, 601 bp, Human
tgttccctaattcctacccttccatccagtccagggatttataagggagacctgggggtaaaattcatccattcttgtccagaacacctgcatcattcatccatccagtcctcgttcagcaaatactctcatactgcattccaacccccacatctgtgcacagcatctttctgtgctctggagacctgggaaggacccaaccagggatctattttccaggtgctcccagcctggtgggggaactgtccctgggcaggacagtcccagcccacgtgggcagggatggggtttacagtaaggraagcaggactaggggggtatagaaagtgtctcagttgaaagcctgaataatgatcagtagataattgggtacagttggggagcagtgctgtaggtcaagaagaccacctggggtcttcgggggaggaagagagagaggagagagagagagagagagagagagagagagagagagagagagagagagcagggtcaggacagaaaggaggagaaggggagaaagagggagagactgacttgtggtgagatgataaaactggagatggtagcaggggctggctgtggaagccttggggaaaat

SEQ ID NO: 20418 - DNA, 601 bp, Human
ctgtacgtgcagcagactttgtaccctaggaaaggcaccctatattatgagtctcagcacattttctatagagagagagagagaggaagaaagagagagggcaccagctttgtgagagattatgtgctttgttctggatgccatattccatagacttacaactcaaatgtctccagggagataagattcatttaccactgtagaatgtgggcaaatatctttgaagcaatacttaatctctaatttccaagacaaattgccatttaattatcctgtaacccaggttgccagtgatttttttctcagaaagttttcatcaagcagaaacatgaaagcattcatgggtcattgagtcttcccattagggaccaaagaaaaggcaaggaagccagggaggaagcccatggggttggggctctggccatggtgaccaagaagggtctaggagagcaagatgggcttgggtttctcgaaagaggatgaatcttcagagactgtctcagattagactcaagagccctcagaggtactgtgactttttatgggggtgggggtggggggttattgccttctctccaggatgaagatgggaagaagttgt

SEQ ID NO: 20419 - DNA, 601 bp, Human
tgtctttgtctatgtgtatgtctgttgtgacagaggcatttaatctctggatcagagcagctcatgtcttgcttatggcaatactatcagccagagtaggattgtggcactgactctccattcccaagtcaaattcctccaagggcaatgcgatgttttcccctgtacgtgcagcagactttgtaccctaggaaaggcaccctatattatgagtctcagcacattttctatagagagagagagagaggaagaaagagagagggcaccagctttgtgagagattatgtgctttgttctggawgccatattccatagacttacaactcaaatgtctccagggagataagattcatttaccactgtagaatgtgggcaaatatctttgaagcaatacttaatctctaatttccaagacaaattgccatttaattatcctgtaacccaggttgccagtgatttttttctcagaaagttttcatcaagcagaaacatgaaagcattcatgggtcattgagtcttcccattagggaccaaagaaaaggcaaggaagccagggaggaagcccatggggttggggctctggccatggtgaccaagaagg

SEQ ID NO: 20420 - DNA, 601 bp, Human
ggaacttgaacctaggtctcctgactcccaatcttgggtcttcatctcttaatagtaacagcttttgcttgcaccataacctggtgctcccgggtaaagggtccctggggagaagatgaagaggcttattctggggcgtgcatattgattgttggggttggagagctgctcaagggagcaagggacctgccccagctctgtccccttctctggctaggccaagtggcagctcctggcctcagagggtagtgcccgtctggacatgtttgagcacatcagcctcatgaccttggacagtctrcagaaatgtgtcttcagctttgacagccattgccaggagtaagttcttgcccagggtctgggatcctgggccgtggacacaaagttggtaggtggggggctggggaggactgagcagggaaatcagacaaaccttcttggaggagttgttatacctgatcgttgaaggactggtatgaattttatcttgaggtttccagggactcattaaaagggtttgaactggtgggtgtggtcaaagtgggtctctctcagggactgactgtaatgtagcactaaatggagttaacactgatgcaaa

SEQ ID NO: 20421 - DNA, 601 bp, Human
tccatgatacgagtatatattgtctaatttgattttaacaactctgcaaaggagagattatgtatttctgccccatggtagatgatgaaactgcaggtctgagagattagggagctaacccaagttcacccagctaatgagtgagcttggcatggtggagcagagtttctaacatgaattatatggctccaaagcacatcatcttaactgttcctgaatatctgacaggtgggatataggggagggtaatgagttgactaatggcacacagagcacagaggacagagctggaacttgaacytaggtctcctgactcccaatcttgggtcttcatctcttaatagtaacagcttttgcttgcaccataacctggtgctcccgggtaaagggtccctggggagaagatgaagaggcttattctggggcgtgcatattgattgttggggttggagagctgctcaagggagcaagggacctgccccagctctgtccccttctctggctaggccaagtggcagctcctggcctcagagggtagtgcccgtctggacatgtttgagcacatcagcctcatgaccttggacagtctgcagaaatgtgt

SEQ ID NO: 20422 - DNA, 601 bp, Human
gatacagatggcctcagcttagacccctggatgttcctccatctgattctctccctccagaaggagtcccatggtttacaatacagatagggttccagggaataagatgaggcttagcttcattagttatcacctcatcatttttaccacattgtattttgacatcaaaagccaatagtccaacacggaatcaatggcagggggtaaaataggctctgtctattattgggagttgctgaaaaagcacattgcaaagggtgtggatatggggagaagggaagaattggggcgaaggttttgygaagtgtttagaattttttaactttaaaattgatgttaagctagttactgtttcataaattattctggaagaacaagaaactcctgggtcagagacaaaggatagttttactactcatgacacagagagcagcatgtgttgcttgttagattgcacttcttctccaagcctctcaaatcccatgggctgacacaagtgggcttctataaatgcctgctgacatcatatattgcattacagggaaggggcattaggcttaggaatctgtttttatagcaagcagaagcagcatatccaggg

SEQ ID NO: 20423 - DNA, 601 bp, Human
atatgaagattttcaatgagagtgtgaacatcatgcatgtgagttatttgaagccaaggtcccagctgcagcctttggttggggggaaccacagacagatctagtctggaattttggctctgctgggtgcctctgggccattgtcttcctctctgagctttggtttcctcatctgtaaaatccctacttaaaagaaggtcaaggtgatgtagtggagtcatgtctctggcgcatagtaggtgcccagaaggtgtctgtttctatgttcgcgtcacccgaaccctgtaaactcaagagggtmatgacaacaattgcataatagctgttgctgataagaaacaacctgaaaactcattggtttaaaccaataaaggtttatgaatcctgataagtctgtgggacagttcgtggattcttctggatgtggatggaagggatcagtcatggtacatgagcagcctggggtcaggtaggcagccttgctggtgttggctgagttctctcacatgtttgggttttggctggcttcagaccgatacagatggcctcagcttagacccctggatgttcctccatctgattctctccctccagaaggagt

SEQ ID NO: 20424 - DNA, 601 bp, Human
atctgggccatgtttgggggttgtgtgaggtctgggacccagggtccctaagtgaactgtctgagacattatttgagtcttgtctgaggcatgtgttgtagtatgtttgggtcatacgtgaggaacagtctgggtcacgtgttggctatgtctgggtcgttaaaggtaccatatttatattcaacctggagcctgtatgtggaacacgcttttaaggtcatgttagaccatctcatgtgcatgttagagcataccatctcatgttaggaattgtcatgtattttgtggccatgtcaggacwtgtgaacacatgtcagtgtcatgtctcatgtctaggtccatgtcagaagatgccatgtgagaatatgtcagagagtgctgggacagacagggtgtcctaagtccttgtgaaggcattctgtagagtgctgagcgtgttcagggtttgcagaacatgttggatcatgtaggaggcatgtcaaggcatgctggagccctgacatagctcctacgtgccatgttaggcagtgtcattgctgtgctgtgctgccgtagcctggtctggtcttccctcccctcccccatcctgccttcttcctct

SEQ ID NO: 20425 - DNA, 601 bp, Human
tctatggtggctgttatatggtcaagtctgctgtacggctacgtcttgtcacctgtatatttacacctgggtcctggttacacctgaaatatgttatacccggttacatctggtatatcattccaactgaggtcatgtagagctggtcatgtgtggagttcatgtgtggccaaggacatttggggcatgtgaggggctgttttgttcttgtcgcaggtgctgtttgacactgccgttttctcctgctggtcacatctgggccatgtttgggggttgtgtgaggtctgggacccagggtccstaagtgaactgtctgagacattatttgagtcttgtctgaggcatgtgttgtagtatgtttgggtcatacgtgaggaacagtctgggtcacgtgttggctatgtctgggtcgttaaaggtaccatatttatattcaacctggagcctgtatgtggaacacgcttttaaggtcatgttagaccatctcatgtgcatgttagagcataccatctcatgttaggaattgtcatgtattttgtggccatgtcaggacttgtgaacacatgtcagtgtcatgtctcatgtctaggtccatgtcaga

SEQ ID NO: 20426 - DNA, 601 bp, Human
tggatgtggacagagacatccccaacttcatggggtcaagaaagggccagagggagatggatgacagcccagagaagagcaagttctctgctggggcaggctggaagccttcctggaggaagagttactggagccatgtctggaacaatgagtagggatgtttgaaaggagagtgcagggtgatgcaattgggcatcgttagtgttcaaggccccttgccaggtctagcgtcaccttgcctgtcacaaaggttagaacaatgaggacttgtggctggtggaggatctggactgttatttcygtgatgtccatctctggtgtgggtcaagtccttttaccccatcctgtagtttgtctgccctaagttcattgcttttctgctctaggccctgggaatctccaaaaggagactccagcctagtttggggccctctccttgacccctgtgcttcccttcttggacaggccaggctgagcagggaaacaggcagcatcctacagagaccatggctctggcctcaaaatgctgagtgactctgggctggttcccagctgtctctggttactgaggtctctttcagttgtgagtggtggaaatcca

SEQ ID NO: 20427 - DNA, 601 bp, Human
gccctgtcctggaggaacccccaagcttaaggaggtggatgtggacagagacatccccaacttcatggggtcaagaaagggccagagggagatggatgacagcccagagaagagcaagttctctgctggggcaggctggaagccttcctggaggaagagttactggagccatgtctggaacaatgagtagggatgtttgaaaggagagtgcagggtgatgcaattgggcatcgttagtgttcaaggccccttgccaggtctagcgtcaccttgcctgtcacaaaggttagaacaatgaggacttgtggctggtggaggatctggactgttatttctgtgatgtccatctctggtgtgggtcaagtccttttaccccatcctgtagtttgtctgccctaagttcattgcttttctgctctaggccctgggaatctccaaaaggagactccagcctagtttggggccctctccttgacccctgtgcttcccttcttggacaggccaggctgagcagggaaacaggcagcatcctacagagaccatggctctggcctcaaaatgctgagtgactctgggctggttcccagctgtctctggttac

SEQ ID NO: 20428 - DNA, 601 bp, Human
agacctcaacccaaggccctgtcctggaggaacccccaagcttaaggaggtggatgtggacagagacatccccaacttcatggggtcaagaaagggccagagggagatggatgacagcccagagaagagcaagttctctgctggggcaggctggaagccttcctggaggaagagttactggagccatgtctggaacaatgagtagggatgtttgaaaggagagtgcagggtgatgcaattgggcatcgttagtgttcaaggccccttgccaggtctagcgtcaccttgcctgtcacaaagsttagaacaatgaggacttgtggctggtggaggatctggactgttatttctgtgatgtccatctctggtgtgggtcaagtccttttaccccatcctgtagtttgtctgccctaagttcattgcttttctgctctaggccctgggaatctccaaaaggagactccagcctagtttggggccctctccttgacccctgtgcttcccttcttggacaggccaggctgagcagggaaacaggcagcatcctacagagaccatggctctggcctcaaaatgctgagtgactctgggctggttccca

SEQ ID NO: 20429 - DNA, 601 bp, Human
attaaccatgacaggaggtgacggcccctgccttgcttgcaggtcacccccacggagcagggcatgagggtcctgactcagctggtggccacctacccccagggctttaaggtctggatgggccccatcttccccgtcatccgtttttgccaccccaacatcatccggtctgtcatcaacgcctcaggtaccacctggaatacttggtggtgggtgctatggtgcatttgaggcctgcaagtccctctatccccaagccgtgtgtggcccctgcagtactctggtctctcctttccttctytctcagccatcttcatctttctttcatgtattcactaattcccatctcagcatctcctctctccattgccatctgaccccctgtcctggtgttctgggctgccctggggccccaagagacctcaacccaaggccctgtcctggaggaacccccaagcttaaggaggtggatgtggacagagacatccccaacttcatggggtcaagaaagggccagagggagatggatgacagcccagagaagagcaagttctctgctggggcaggctggaagccttcctggaggaagagttactggagc

SEQ ID NO: 20430 - DNA, 601 bp, Human
gccagtctcttctggaaacaccctcacagacggatgatcaactatctgggcatcctttagcccagtcaagtggacacctagaattaaccatgacaggaggtgacggcccctgccttgcttgcaggtcacccccacggagcagggcatgagggtcctgactcagctggtggccacctacccccagggctttaaggtctggatgggccccatcttccccgtcatccgtttttgccaccccaacatcatccggtctgtcatcaacgcctcaggtaccacctggaatacttggtggtgggtgctrtggtgcatttgaggcctgcaagtccctctatccccaagccgtgtgtggcccctgcagtactctggtctctcctttccttctctctcagccatcttcatctttctttcatgtattcactaattcccatctcagcatctcctctctccattgccatctgaccccctgtcctggtgttctgggctgccctggggccccaagagacctcaacccaaggccctgtcctggaggaacccccaagcttaaggaggtggatgtggacagagacatccccaacttcatggggtcaagaaagggccagag

SEQ ID NO: 20431 - DNA, 601 bp, Human
gatatatagatagaaaagttagataggatgaatagattagatagataaatgaatagatagataggtaggtagatagataataggctagatggatgaatggatgcacagataggatagatgaatggatagatagacagatatataagatagaatggatggattagatagatggatagatacatagaaacataggtagatagatagattagatagatagatagatagacagatagatacatacatacatacatatatagatacatagataggtagatatgtagagatatatataggtaaatakatagatagatagatagatagatagatagatagatagatagatagatagacagacaggcagacagacagatagatagatagaagagggagtttatttcgggaattggctcacaggattatagaagctgagatgcgtcatggactgctgtctgcaggctggataaacagacactggttgtgtaactgagtccaaaggcctgagacggtggagttctggtgtccaagggcaggagaagatggatgtgccagccccacaacagagcaaattagcctttcctctgcatttttgtgctacctgggc

SEQ ID NO: 20432 - DNA, 601 bp, Human
gatagatatatagatagaaaagttagataggatgaatagattagatagataaatgaatagatagataggtaggtagatagataataggctagatggatgaatggatgcacagataggatagatgaatggatagatagacagatatataagatagaatggatggattagatagatggatagatacatagaaacataggtagatagatagattagatagatagatagatagacagatagatacatacatacatacatatatagatacatagataggtagatatgtagagatatatataggtaratagatagatagatagatagatagatagatagatagatagatagatagatagacagacaggcagacagacagatagatagatagaagagggagtttatttcgggaattggctcacaggattatagaagctgagatgcgtcatggactgctgtctgcaggctggataaacagacactggttgtgtaactgagtccaaaggcctgagacggtggagttctggtgtccaagggcaggagaagatggatgtgccagccccacaacagagcaaattagcctttcctctgcatttttgtgctacct

SEQ ID NO: 20433 - DNA, 601 bp, Human
aacacacccttagagaattgtgtgtgttcaacaaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatratacagctttattttgaacagtgaccaaatgtgttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgg

SEQ ID NO: 20434 - DNA, 601 bp, Human
aaagatctttaactataagagcatttctgagccgccacttcatcctgggaccaaattctaagagcaatttgtattgagctataaacagctaatctgctagtttaagatgttcttttatacagtcatgcagaaaaatggaaattgtgtgttctaatccttggagactggctgataaagtgtcactaggcccctgatgaaatttaatatttaggcttatatccccttaattttccccctaaatttctacagtacgcttttactgcatgatgatacagctttattttgaacagtgaccaaatgygttctttacaaagaatattgacgagttgtgtagtcttgaacacgttgcctgacttctctgtgccccagtttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggta

SEQ ID NO: 20435 - DNA, 601 bp, Human
ttcctaattctttattctattctgtggcagtgtccactttttggtttaaagtttttaacacatctccagttgaggtgaaagattttaggaatacaggtatgtttttgcataccctgctttatacaggactacaagtatcaacttggtaactttttgtactattttgtttacttatcccccttactcccctcttaaatgggattgggcgtggttaggttggatattcaggtatcttttggtacagtgagtgaccattttcagaatgttgtctaaccagttaatagatactggtatcagtagyagtagtaattttgaactgtaaaaataaaggttgtttttatgactaaaataaactacttcatgtgttcattcgttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaa

SEQ ID NO: 20436 - DNA, 601 bp, Human
gttttgctgtttatctatattaatatttcaaattattgcttagtcaaaacctcaaggtattagtcactggtttttgagcttataaaggaagccactggagcaagatataaaattaaccattgatgttagtccagagttcaaaagggtgagtttaaaactttcttaatgatggtacagcaattatttgcttataaactgctgaattaatcctacttgagtatttaaccaagtcttactgtctaattttgctgagattttcagtgatataccaaagcaaaacaaaacaaaacaacagcaacaraaaacaaaaggttgtgactgagacctgtcaaattcatttggctctatatactttgcattcagcaacaaaattttgacttctcaacagcaaaaatgtatttctattttaaaataactgagccttttacttttatccagccacattaagcatttggacattttcttttttatttatttgtttttcattattagtattttcattttttgcagattttaggtgatgggcaagtcagaaagtcagatggatataactgatatcaacactccaaagccaaagaagaaacagcgatggactccactg

SEQ ID NO: 20437 - DNA, 601 bp, Human
tgtgtcattgaaattctaaagggcttcacaggaatttaacaaatttaatttgagtcttggaagttttttacaacaaggatgaaaaaagattgattgtttaatggttaaaaaaatgattaccaagcaaaaacaactgattatttcaatttaataggcctggggcttcgttggtagagaagatataataacacatttttcttcataatcaaaattttaaatttagattttacttattttattttcttatattttttctaaccactgacaatgatatataatgttcagtttttagttcttgctktaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagt

SEQ ID NO: 20438 - DNA, 601 bp, Human
actgacctcaggtgatccaccagccttggcctcccaaagtgctgggattacaggtgtgagccactatgcccagccaagatggtagttttatgccattttacagaagaaaaaaaattaaatgattggcacagaaacctacttctgtagtctccctacccaaaccctgtgttaaagttactgtaagatgttactaagatttgccttcccagcacaggtatattctaacctggctaagactgtctccctgagaagttaagaaatctagccaagtccctcctatcctttgttctctgttctcccstcttctagaagttattttgtagaagaacaatttttgctactttttaacattgaaacaagtaggacaattcaattcattcatttggagcatgaacggtacagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaagataatctagtcaaaaggactttcatctaaattggctgatta

SEQ ID NO: 20439 - DNA, 601 bp, Human
cctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttytctcaactaaaggtaaataaaatgcctttcttttaaaatggatttattgtatttttacaaatgtaaacaatttgatttaggtgtcacctaagactagattaatgactatgtttggaatgtactgaaaaatataaagagtttttctttcttcctttttttttttgtttttttttttttttggtttcctgtgtaagaaattatacaaaaaattgcaggctactgaatcacctaatcatatctgtgtcactattgcataaatctttatggtcgtttttgttaaaatcatgaaaggaattgaac

SEQ ID NO: 20440 - DNA, 601 bp, Human
actaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactastgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttattgattaaacccatcgtcagagtcagtctaggacccacagagttctctttgtcattgcaaacgacaacctgcatccctgactccctatctgcttgcc

SEQ ID NO: 20441 - DNA, 601 bp, Human
tagtagagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccrtgtgctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaacta

SEQ ID NO: 20442 - DNA, 601 bp, Human
agagatgaggtttggccaatctggtctcgaacccctgagctcgagtgatctgccggccacagcctcccaaagtgttagccacaggtgtgagccaccactcttagctggtaaaattccttttaaggcagctatacaataatactagaaactcccataggaaggggtttgaaaaatactaaaactgaaaatctttctgagaggccattatgtagtcatcagacttggacagtcacacaataaaagcactagatttccttttaactccaaaaaaggataatttattcatagaacttcccatgtkctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattga

SEQ ID NO: 20443 - DNA, 601 bp, Human
aaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcrctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaacc

SEQ ID NO: 20444 - DNA, 601 bp, Human
tgaggggagtaggcagtagggattgaggaaggagagactccagcaaacatgttagttggagtcttggaaagaaaataacgtggactgattaaaatttctagtttttatccttaaaaagaaaatgtagacatctttttaaaattaaagaatgcaaaaatgtattgtgctaaatctcccttacttaggttatcctgttattcttaaatttatacacatacaggttctgtaagtactcagagttcagctaaaaccttgaaaagcagtaatgtgttttctcatataccatatttcccccattacrtttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgc

SEQ ID NO: 20445 - DNA, 601 bp, Human
aatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagwttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataata

SEQ ID NO: 20446 - DNA, 601 bp, Human
ccacaagaggctcatggtcaaaagagtttggtgaacacttcttgtaggaaggcttccctcatctcaccctaggctgggttacatgctcctagggtgtgattttattatcatacgtgggagttaatatttatttcactgcttatcattgctgtttacaataagctctttatggttgggggcaggggggcagaaaatactgcctagcattatatcctcagccctttataacatacctggcccttggtagacccttgaaatatattgagtgagtaaattgataaattaatttcccatcctggayatttataataacttatgattctaaccttataatctaacccatttttaattgtaagaagtcctgcaataaagaaacttgcttaatgtttttgcgacagcatttacccgaagtaattcacaataatttttttgtgtgtttactaccttatactttctgtagaatttgtatcctttagaacactctttaaggaaatgtcttacagtaaataaagtatcattaagtgggggctggattgtcatgactgatggcaaacctacaagaaaatgggtttggcctcagtgacttcagtgatacatatga

SEQ ID NO: 20447 - DNA, 601 bp, Human
ttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgcttaaagtcactgcagtgctgatttcagactcaactgaaagtcttgctgctaactctgcagtcaccacaactacatgataccctgatgacagcgaggtgatccttgcccaggtcctgggatgacagtgattcctcattcattgattactagtctagcatggggatttgcaaaccatactgccttcttctctctttccatttgcagaagaaacttgactttttcttttaaatgagctggttatagcttgcaagacccaggggtccttatagcaggagcatagtggctacgaacacagactcaaaaccaagttccttgattcc

SEQ ID NO: 20448 - DNA, 601 bp, Human
tgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaatggtttatcttatttctaaatatttttattttatttctaagtaccttttttaaagtcccttgaatatatctatataaagtcatattgactttaagactcattaagyattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacagacatatatatacattaacacatgaataagttatcatatatgatgaataa

SEQ ID NO: 20449 - DNA, 601 bp, Human
ttatttctaagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcrtaagttcgcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacac

SEQ ID NO: 20450 - DNA, 601 bp, Human
aagtaccttttttaaagtcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcrcttatagtattattacagacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcct

SEQ ID NO: 20451 - DNA, 601 bp, Human
tcccttgaatatatctatataaagtcatattgactttaagactcattaagcattagcttcttaaagtggtttaaggtttcaagagccaacttttcacagatccagtcctcctggcaattctgtatgctggctctgtgagagatgatcctattctatgtcatcttcattcaggaaggctccaaggggtttagaaagttggaatctcaattatattcgattgaatcgtatgaaattgtatttacctagccacaattgatcaaaaaagaaaaaatttcgtaagttcgcttatagtattattacrgacatatatatacattaacacatgaataagttatcatatatgatgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaac

SEQ ID NO: 20452 - DNA, 601 bp, Human
tataaaaagaatgtttagactatgcatggtggctcatgcctgtaatcccagtagtttggaaagctgaggtaggctgattacttgagctcaggagttgataccagcctgggcaacactgtaaaaccccatctctaccaaaaactacaaaaaattaactgggcatggtggtgcatgcctgtggtctcagctacttgagaggctgaggtgggaggatttcctgagcctgaaaggtggaggttgcagtaagctgaggtcacaccactgcacttcagcctgggtgacagagtaagaccctgtttcaaaaaaaaaaaaaaaaagaatgtttaattattttccaccaaaaaaattacttaattgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggct

SEQ ID NO: 20453 - DNA, 601 bp, Human
ttgctgccttaggctacatatgaaatattctaaaattgaattgctagcagccttcagaaaataaaccacagaagttgtgctggggaggcaaaaacagggggaagaggagacatggtcttttgcttcatggcccaatgacttatttaattaactaacttgttgacaatcatgaacataaaaaatgcacaactaagcagttggttataaacaacagttgtgatgcctactaggtaacagcaataaggctagtggggaaaatcctccttacagagatttagctgacaaagtaaaaggggaggtyataattagcaaagttgaacttgaagactaatatttaataagaaccataaaagtcttatcacttgcctgaagaatggcatatcagggtatgattaaagcagcaggatctttgtagttaatatttagtcttgatagcacatttcataacagcattttatataatgggtggattttaatcaaagtacatagtgtgggagatagtattcactttaacttaataaagtactgcacataatttttatactttaaggtaaaaataagttcatggctccatttagctcaggctgctacacgtgaggta

SEQ ID NO: 20454 - DNA, 601 bp, Human
tttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggrgccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaa

SEQ ID NO: 20455 - DNA, 601 bp, Human
aatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagmggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatgaaagatttgcccaaaggtaacaaagataggaactggtagaac

SEQ ID NO: 20456 - DNA, 601 bp, Human
gcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcraatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaatt

SEQ ID NO: 20457 - DNA, 601 bp, Human
aataacattattcccaaagcttcaggagagagtacattgaagcacagcccatcaaggatgtgagagaaaaatgctctacagagtagaaaactgagctagaagaagttaaagttcttcccaaattagaaaatcaaagagaacaatgattgaagagagtcactccaaccaacatttgaatgttaaatcatagatcctatgtatttgtttaagaactgaattcctaatgctacccctttcccatgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgtcatcatcatcatcatcatcatcatcatctagtatttgccctaacatttctttcaatattc

SEQ ID NO: 20458 - DNA, 601 bp, Human
tgtactagaacacttagtcactcatttgctgatcaacaacacctctcaggcaagaaagttaaaaaaaaaaaacctaaaaattttgtagggtagttggaaaatgaaatttgagaacaaaagagaactaatgggctaaatttcaaaagctctacataaaatgaatgtaagcatactgcccagatcatttactcctgggaaaaaacacattcgattatggagaaaaacacatttaattatgaagcaataaagtagttcatttaaaaattaaagaatttattcagcttgctagtatcatcgttgccatcatcatcatcatcatcatcatcatctagtatttgccctaacatttctttcaatattcattcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggctt

SEQ ID NO: 20459 - DNA, 601 bp, Human
attcactcaataactgcttatggtatgcctattatctctgtaatccaagctaaatttagttctgctaagatattcaaattaactgctttataggtaatgagcaacaaaagtgactggattaattcccattgtggtttattcaaaaaacttttagttttaatttttttaaagttgtctttttccttactaaagtgaacttaagctttgaggtaagaaacacttgagttccaaccatggcttcaccatttactagctgttaatgtaacctctgtacctcagtttcttgatatgtaaaataagkattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcagttaagtaaaacgtacataagtatataactgttttctagctccaattttaaactgaaaacaatattttgctataaa

SEQ ID NO: 20460 - DNA, 601 bp, Human
gttccaaccatggcttcaccatttactagctgttaatgtaacctctgtacctcagtttcttgatatgtaaaataaggattaaattatcatgagagttgctagaggattaacgttaatataaatgaagagcctattttgtgtgtgtgtgtttgaaagtccatactaggattatttgtagacaagaggtatgaacagaataagaattcttatgcattttgtaatagttccctatcagtcaaggcttttttggtgctcatttcttatgttctgcacatttcagaatgttagtaactgatcagcrgttaagtaaaacgtacataagtatataactgttttctagctccaattttaaactgaaaacaatattttgctataaattagttaaattatttgtatctttaagtctttattgttgttctggttccaaagatccctcatcgactatttttcattcataacaacagaagcgtgtgtgtgtgtgtgtgtgtgtgtgtgtgtgtgtgtgtgtgtgtgtgtgtgtgtgaagggtaaatggaatgggtaaatggaatgccaaccttttgtcaaggaaattattgttttctctggaggtaaggagatt

SEQ ID NO: 20461 - DNA, 601 bp, Human
cttgggaggctgaggcaggaggattgcttgaacccaggaggtcaaggctgcagtgagctgtgatcgtgcctctacactccaacctgagtgacagagcgagaccctgtctcagaaaaaatagatgatctattcaaagatttgatgtcataaacaccaaatgttaactaagaaagtaagtgaagccctagtgtgttgttgatctattcaggatcaaattaggtagagtctttggatggaaagaggatgggcagaatgggcatggagagctgagtgcacaccaggctgagtatttctgcagtgmccactctctgcggtgttatctgaagacgtttctttcttttaggtgttttttgtttgttgttttaacttaattttgagatttataaatataaatcctaaaaatactttttaagaaaaatatagaattaagtcgtgggtttggacattattaccgaagtacttgttcccatatgataaaatctaagaaaaaatcctttggaaaaaattaataaaataaaaacaaaaacatgcagctcttccagtcagtgatgctgatggcttaccctgtcaaccagggagcttgctccctagtgtgaggaat

SEQ ID NO: 20462 - DNA, 601 bp, Human
ttcatgtccaggttctccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggrgagttgtggtggagagggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagca

SEQ ID NO: 20463 - DNA, 601 bp, Human
ccaacaaccacacgccatgctatcagagggcctctcggggccttgctcagagcaggaagcatcttcttgtcattcacacaacctgccattactggaacctaccccattcttgggaaggccaatcatctccctgacaagtggactaatatataaattccccagcttctgactccacttcacctcaaccctcccacaccaggagattatttttcgtctttaagactcatctaggaatcctaaaaaacaaacaaccagaaaagattacatcctccatgaaagataggagagttgtggtggagasggatagagaagttagttgatgcgttgatgggtgacatattagaaagtcagacttacaaaaaatccatatggatctctcttttctggaatgaggaaagggaaagaaaatgctttctttctcttccagttggtccataatatcaaacaaacaacagaaacactaagtcgtgtttttcttcctaataccctattgcttctctacaggtaatcactgtgaccaaccaggtcacaggttaattcattcagtatgtactgagtcctgtgctggactttgggggtgcagcagtgagcaagacataca

SEQ ID NO: 20464 - DNA, 601 bp, Human
taaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattactygattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactc

SEQ ID NO: 20465 - DNA, 601 bp, Human
agggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgyagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaa

SEQ ID NO: 20466 - DNA, 601 bp, Human
aataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctrtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagt

SEQ ID NO: 20467 - DNA, 601 bp, Human
cttcaacacagaacctggagctgaccccttgacctccctgacccctgatctgtccctgcaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcagtactccaatggttctccgcgggcggttcctccaccagggtcacgtggctgtttggtaaaaatgcagattcctaggccggggcggtggctcacgcctgtaatcccagcactttgggaggctgaggcgggtggatcacgaggtcaggagttcaagaccagcctggccaacatggtgaaactctctctactaaaaatacaaaaaatttagctgtgcgtggtggtgcgcacctgtaattccagctactcaggaggctgaggcagagaactgtttgaacctgggagt

SEQ ID NO: 20468 - DNA, 601 bp, Human
agctgaccccttgacctccctgacccctgatctgtccctgcaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcastactccaatggttctccgcgggcggttcctccaccagggtcacgtggctgtttggtaaaaatgcagattcctaggccggggcggtggctcacgcctgtaatcccagcactttgggaggctgaggcgggtggatcacgaggtcaggagttcaagaccagcctggccaacatggtgaaactctctctactaaaaatacaaaaaatttagctgtgcgtggtggtgcgcacctgtaattccagctactcaggaggctgaggcagagaactgtttgaacctgggagttggaggttacagtgagcc

SEQ ID NO: 20469 - DNA, 601 bp, Human
ccttgacctccctgacccctgatctgtccctgcaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcagtactccartggttctccgcgggcggttcctccaccagggtcacgtggctgtttggtaaaaatgcagattcctaggccggggcggtggctcacgcctgtaatcccagcactttgggaggctgaggcgggtggatcacgaggtcaggagttcaagaccagcctggccaacatggtgaaactctctctactaaaaatacaaaaaatttagctgtgcgtggtggtgcgcacctgtaattccagctactcaggaggctgaggcagagaactgtttgaacctgggagttggaggttacagtgagccgagatggc

SEQ ID NO: 20470 - DNA, 601 bp, Human
gagcagacccacaggctggcccgggccatgatggccttcactgccgacctgttctccctggtggctcaaacgtccacctgccccaacctcatcctgtcacccctgagtgtggccctggcgctgtctcacctggcactaggtaccctggcaccacttgtccagaccaagagagctgggaggccagtaggaactcagtactccaatggttctccgcgggcggttcctccaccagggtcacgtggctgtttggtaaaaatgcagattcctaggccggggcggtggctcacgcctgtaatcccarcactttgggaggctgaggcgggtggatcacgaggtcaggagttcaagaccagcctggccaacatggtgaaactctctctactaaaaatacaaaaaatttagctgtgcgtggtggtgcgcacctgtaattccagctactcaggaggctgaggcagagaactgtttgaacctgggagttggaggttacagtgagccgagatggcgccactgcactccagcctgggtgacagagcaagattccgtctcaaacaacaacaacaacaaatgcagattcctgggcccccacccatctgtctatgtg

SEQ ID NO: 20471 - DNA, 601 bp, Human
attctcctgcctcagcctcccaaatagctgggatcacaggcaccagccaccatgcacagctgatttttgtatttttagtagagacggggtttcaccatgttggccagggtggtctcgaactctcgacctaaggtgatcaacctgcctcagcctcccaaagtgctgggattacaggcgtgagccaccgcgcccggcccctcctggtgattcttatgcaagagtttgctagctacactctttcccactgtgctggagggtctcactgtgggaaacggaagcccagagagggaaggtaacttgyggggggtgaggtcacccagcctgtcagccacaggggtgagagccacgcagaacagatccgtggctgtggaaggatggcgtgtggtcccgtggacgtcctcgtcacgggtatccaggagggactggagtgggcagtgggggtgagaaaggacccgcagccgggcctcagcctgtgcggtgccctccaggtgctcagaaccacacgttgcagaggctgcaacaggtgctgcacgcaggctcagggccctgcctcccccatctgctgagccgcctctgccaggacctgggccccggcgcgttc

SEQ ID NO: 20472 - DNA, 601 bp, Human
cagccaccatgcacagctgatttttgtatttttagtagagacggggtttcaccatgttggccagggtggtctcgaactctcgacctaaggtgatcaacctgcctcagcctcccaaagtgctgggattacaggcgtgagccaccgcgcccggcccctcctggtgattcttatgcaagagtttgctagctacactctttcccactgtgctggagggtctcactgtgggaaacggaagcccagagagggaaggtaacttgtggggggtgaggtcacccagcctgtcagccacaggggtgagagycacgcagaacagatccgtggctgtggaaggatggcgtgtggtcccgtggacgtcctcgtcacgggtatccaggagggactggagtgggcagtgggggtgagaaaggacccgcagccgggcctcagcctgtgcggtgccctccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggtaggcgctgat

SEQ ID NO: 20473 - DNA, 601 bp, Human
atgatcccccatcctacctggcaggaggactgaggctccaggctctttgaggtttagtaattcagtgaaaatatactgggcatttgctgtgttccagatactgttctaagcactagggtttttgtggagcatgagggaggccaggtctctgctcttaggaaggaggatacacagtgcaacagtgaatggacatcaacacaggaattccagacgctgggaagcgctgtggagggaaagctgaaaaagaaggtgattttggccgggagcggtggctcacgcctgtaatcccagcactttgggwggcccaggcaggtggatcataaggtcaggagtttgagaccagcctggccaagatttgaaaccccgtttctactaaaaatacaaaaattagccaggcgtggtggcaggtgcctgtaatcccagctactccagaggctgaggcaggagaatcacttgaacccaggagggaaaggttgcagtgagctgtgattttgaggtcaggagttcgagaccagcctgaccaacatagcaaagccccgtctctactaaaaatacaaaaattagccagccatggtggcgggcgcctgtaatcccagatact

SEQ ID NO: 20474 - DNA, 601 bp, Human
ggcgtggtggcaggtgcctgtaatcccagctactccagaggctgaggcaggagaatcacttgaacccaggagggaaaggttgcagtgagctgtgattttgaggtcaggagttcgagaccagcctgaccaacatagcaaagccccgtctctactaaaaatacaaaaattagccagccatggtggcgggcgcctgtaatcccagatactctggaggctgaggcaggagaatcacttgaacccgggagacggaggctgcagtgggctgagatcgcaccactgcactccagcctgggagacagaytgagactccgactcagaaaaaacaaaggctggccttgaactcctgacctcaggtcatctgcccacctcggcctccctaagtgctgggattacgggcatgagccaccaggcctggccttatttaggcattttagagtggtaagggagaattctgtgaggagggggcattgaattgagactcaggtgaccgttgttgataagggtttattacaagggcccatggactttggggcagcacagggaccaccccacggccatgtagccactcagggtctctgcagcccccagcctgggagattcc

SEQ ID NO: 20475 - DNA, 601 bp, Human
ctgaggcaggagaatcacttgaacccgggagacggaggctgcagtgggctgagatcgcaccactgcactccagcctgggagacagattgagactccgactcagaaaaaacaaaggctggccttgaactcctgacctcaggtcatctgcccacctcggcctccctaagtgctgggattacgggcatgagccaccaggcctggccttatttaggcattttagagtggtaagggagaattctgtgaggagggggcattgaattgagactcaggtgaccgttgttgataagggtttattacaagrgcccatggactttggggcagcacagggaccaccccacggccatgtagccactcagggtctctgcagcccccagcctgggagattccacggggcgctcacacagtgctccttagaaaggaggatctgattggattggatttctcagcatcttgcgtggaacattctgattggataaacttcttttttttttttttgagacagagtcttgctctgtcaccccaggctggagtgcagtggcacgatctcggctcactgcagcctctgcctcctgggttcaagccactctcctgcctcaacctc

SEQ ID NO: 20476 - DNA, 601 bp, Human
tcacgaggtcaggagattgagaccatcctggctaacacggtgaaaccccatctcttctaaaaatacaaaaaattagccgggcgtagtggcgggcacctgtaatcccagctactcgggaggctgaggcagaagaatggcgtgaatccacgaggcggaggttgcggtgagccgagattgcgccactgcactccagcctgggcgacagtgcgagactccaactcaaaagaaaagaaaaaaaaagaaatcttaagccaaatcacaatatatttacacagctggcaaagtcacaagagggaggtgwgggagggtggggcgggcagcactcggcagtggctcacccacagaacccagctgtggtatgacagccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgttgttttttttctttttttgagacggatttttactcctgtcccccaggctggagtgcagtggcttgatcttggctcatggcaac

SEQ ID NO: 20477 - DNA, 601 bp, Human
gccagtgaccctgtctgtggtacatctggagaagctgagacaaagacaggcgattccttacgccgggtcacacggccagctggtagccggtgaagagagaaaaccaccaggtattattgagcaccgtctgtgacagcggacactgctacaatgttgttttttttctttttttgagacggatttttactcctgtcccccaggctggagtgcagtggcttgatcttggctcatggcaacctctgcctcccgggttcaagcaattctcctgcctcagcctcccgagttgctgcgattacaagckcccgtcaccacagaagcccagctcatttttgtatttttagtagagatgaggttttgccatgttggtcaggctggtcttgaactcctgacctcaggtgatctgcctgcctcggcctcccaaagtgctaggattacaggcgtgagcccccatgcccggccacactgctagaaactttaaaagcatctcattcggttacgtgtccgcctgcagtgggacaggtagtatgactccaccccactgtgaggaagtggaggagcagtggggtcagtcacacgcctggcaggatggccaggagcccca

SEQ ID NO: 20478 - DNA, 601 bp, Human
tgcaacacattgaaactccgtccctacaaaaaatacaaaaattagccaggtgtggtgcatgctactggggaggttgaggtgggaggccctcttgaccccaggtggctgaggctgcagtgagccataattgtgccactgcactccagcctcagcaaaagaactaagaccttgtctcaaaaataaaaataaaggccgggcatggtggctcacgtctgtaatcctagcactttgggaggccaaagagggtggatcacctgaggtcatgagtttgagaccagcctggccaacatggccaaacccrtctccactaaaaatacaaaaattagccgggcgtggtggcgcatgcccataatcccagctacttgggaggctgaggcaggagaattgcttgaacctgggaggaggaggttgcagtgagccgagatcacgccactgtactccagcctggatgacagagtgagactccatctcaaaaaaaaattataataactaaaataaataaataaagcatctatccttcagccatttgctaagcagctgctgtattccaggcactgtaccaggcaccgggagcccaccatgtacaaacagctgagtctaa

SEQ ID NO: 20479 - DNA, 601 bp, Human
gagtttgagaccagcctggccaacatggccaaacccgtctccactaaaaatacaaaaattagccgggcgtggtggcgcatgcccataatcccagctacttgggaggctgaggcaggagaattgcttgaacctgggaggaggaggttgcagtgagccgagatcacgccactgtactccagcctggatgacagagtgagactccatctcaaaaaaaaattataataactaaaataaataaataaagcatctatccttcagccatttgctaagcagctgctgtattccaggcactgtaccaggyaccgggagcccaccatgtacaaacagctgagtctaatggggtgggcagacgagcaatcacatacttactacagcataagcgataagacagagagggcttctctccagctcacctgggagaacactgaaaatgtaccttggttggactttagagctggggatcagggaaggcttcctggaggaggtggtgtttaagctgagtcttggaaaccggataggaatgaagcaggtatctgtgagttcaagctgttccctggccaggatctcagacaccctcccaagcagctccaggagcctgtga

SEQ ID NO: 20480 - DNA, 601 bp, Human
agcagctccaggagcctgtgaggccaagggcagctctgaccagccatctctggccctgggcaggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgargaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttc

SEQ ID NO: 20481 - DNA, 601 bp, Human
atagagtatatttatacaaagcattggcaaaaattcagaaattattgtttgagtggcacagcattattttatcttaattattacaggtgcataatagttgcatatttatggggtacatgtgatattttgatacaggcatataatgtgtaatgatcaaatcagaatactttggctatcccctcacctcaagcatttaccaccatttctttgtgttaggaaatattaataaagccaaaaactacatgaactaacagtaattatgtaaccaaatgctatcttccttgtgaggattacagattgyactgctgttatgaaaaacatactttaggcacacattataggatcttcataggttaaaggatataccataccttcacagtataattgaaatatttggctgactgcataaatcgatggaatccatcactttcttttgttgctacagttatgactaataatttatctgcaaagacaaaaggaaacaaaagaaggtttaccaagatatcaaatgctcacattttacaactcactacagtaattgagacctcactaaacccgtgggaatattctggtttacttatctacacaagactaaacaaag

SEQ ID NO: 20482 - DNA, 601 bp, Human
aaaatgctttggttaaaaatacattaacaatcctcccaaatacctctaaatgaaaacaaacaaacaaacaaacaaaaaaagcaaaaacaaaagcaattctcaataatagacagaaaaggcaccctcttcacatttgtttctaattccctgcaaacaaagaatcatcctacgatagcaaaacccattacagaaaaaattatgcagtcagtgaaaaaaatccctgccaaatcttatttacattgtatttgtacatgacctgccagaaagaaattatatatatatatgcaaatacatattaactttttttttgctgttttatagagtatatttatacaaagcattggcaaaaattcagaaattattgtttgagtggcacagcattattttatcttaattattacaggtgcataatagttgcatatttatggggtacatgtgatattttgatacaggcatataatgtgtaatgatcaaatcagaatactttggctatcccctcacctcaagcatttaccaccatttctttgtgttaggaaatattaataaagccaaaaactacatgaactaacagtaattatgtaaccaaatgctatcttccttg

SEQ ID NO: 20483 - DNA, 601 bp, Human
aaaagacttggctgacagatccttctttctattaaaaaaaacaagtaagtaaataaaatggcaggcctctcatagctgagtttaatagttctatcaatttccccaagtttcctctgatcacttgtcaatgagatgttcacctggagataagttttctaaaatgctttggttaaaaatacattaacaatcctcccaaatacctctaaatgaaaacaaacaaacaaacaaacaaaaaaagcaaaaacaaaagcaattctcaataatagacagaaaaggcaccctcttcacatttgtttctaaytccctgcaaacaaagaatcatcctacgatagcaaaacccattacagaaaaaattatgcagtcagtgaaaaaaatccctgccaaatcttatttacattgtatttgtacatgacctgccagaaagaaattatatatatatatgcaaatacatattaactttttttttgctgttttatagagtatatttatacaaagcattggcaaaaattcagaaattattgtttgagtggcacagcattattttatcttaattattacaggtgcataatagttgcatatttatggggtacatgtgatattt

SEQ ID NO: 20484 - DNA, 601 bp, Human
tatgttctttccactacactagtggttgtcaaatttcagtgtgcatctgaatctcatggaagccttgttcaaacacagacttcagggtatcactcccaggatttgtaattcagtcggtctgagggggagcctgattattttttctttcttatcagtagccaggcaatgcagatgttggtggtctggggtccacactttgggaaccactgcattacatgaggagagagcaaaaggatcataaactccagtaagttaagtggggatggggtccaagatctgatattatactttatatagttayttgccttgggacaagttttcctcatccagaaataaagtagtatctaccttacatggttcatatagtgacttaacagcatatcatatataaagttccttacaaggtgccttgcacataagaaacattctactctctctccattctgaaccctaacgattccccaactagatttcagcattattttatcctaattttatttccacagtgtctcctatcagtgcatactgctacattttccatctatcatagtaacatatttctaacatgtttttcatttatcctatattaaacatctagttg

SEQ ID NO: 20485 - DNA, 601 bp, Human
gtttaaaatcagataatattaagtaatacctattcttaaaagctacttgattgcggactgagaataattttttttcaagtaaggaagcttactaaacttattatcctagagcaagaaaattctcaatgtgtcataattaaaggaactggatccatacttttcttcctttaacaacagaatatctctagaagtcacttaaatttgaaaaacatgagtttcctcacttataatttggtaattataacatttatattacctagtgtttttaggaacaccaactcacataatacatgggaaaatsctttgtcaatatactaataataaaataagggttatttaaaacttcatatctaaagttactacatctacaaaaatggttgtttcattagtctttataacttgcattaaacttttcttccagtatctaactcacctcctgaattcagatagcgtttcccaatgtgcacaacaggatacttgtctgctagtcttttatctggccacaaaattccatctgctgcaaagaccactttgtggtttgccttttggaatttttttagaacttcttctggaccaccagcaaatatgacatcaaagctgt

SEQ ID NO: 20486 - DNA, 601 bp, Human
aaataaagtgcaggtgcaaagagctgaaattgaggcattaccaagaaactaaatcacttcctagtggctaagcaaagcctagaacccagatatgctgctacctgaagcagcacttattttaactagcctggatagtactggttatatacacgtagatcacccccaaaatccatttttccaatgtggtttgcaatttgtacccaatttgtttctctaacatgtccttcatcctatttggttatgtcttttgtccctatgtttacattaatctcaaactagtaaaaataaatttgtagccatyataatttccaaggtcaaattttatttaattttctaaaggctggactgaggaatgtggtaattcattcctttaatccgtggtagcacagctaatgcaatattttaagtatacccagacactcaatgttagatatttttcactactgggttcaagacaaatcatttatttaatcccataatgtttaaaatcagataatattaagtaatacctattcttaaaagctacttgattgcggactgagaataattttttttcaagtaaggaagcttactaaacttattatcctagagcaagaaaatt

SEQ ID NO: 20487 - DNA, 601 bp, Human
tatggaggccatgatgtggaagcagcacccatccatgagccgcatgctcaagcagagaagtgatggtgggtagccatattagggagaggctttgacggttcacaagctggaaatctaacagagaaagactgctaaggcaagaagcacagagtaaccaatatgataaaccttgggttctcacttgaatatggaagttaaatccaaaggtggtagatagatttggagaaaagaaaatggtcaagagatcccagaaagcattatctgtagaaatattgagacgaagaggaaaagagatttcaarccaggcagtgcaaactggaatttaaggtttcaaaagtacaaaatctatatgagctatcaaagttccaaggtacaactgtgggaatatgttgataaaataaagtgcaggtgcaaagagctgaaattgaggcattaccaagaaactaaatcacttcctagtggctaagcaaagcctagaacccagatatgctgctacctgaagcagcacttattttaactagcctggatagtactggttatatacacgtagatcacccccaaaatccatttttccaatgtggtttgcaatttgtacccaatt

SEQ ID NO: 20488 - DNA, 601 bp, Human
tggctcactgcaacctatgcctcccgagttcccctccgccttccacctcctgcctcagcctctcaagtagttgggattacaggcacccatcaccatgcccgactaatttttgtatttttagtagagatggggtttcgccatgttggtcagactggtctcgaactcctgacctcaggtgatctgcccgcctcagcctcccaaagtgctgagattagaggcgtgagccaccatgcctggcatcaaataaaaaaattctggggagaagacaatacattttttaaatcccatggccaattttctrtgatgaaaaatgtaccacacagagacactcaacattttccaatggtttatattactgttcttcaaaaattgtttccttattttacagaccccaaatgtcctcaataaatgaaaaaaaaacatctattttcacattacatattttatgtgatttatatttttctattaaaaactctttttgttgttgtttttggagatggggctctcactctgccacccaggctagagtgcaatggtgcactcatggctcactgcagcctcgacctcctgggctcaaacaatctcctcacctcagtctcca

SEQ ID NO: 20489 - DNA, 601 bp, Human
atggaaatgcagccaagctgctatgtttcattgacattcaatacttttaaaaaggaaccaatgttactcctgtgagttgaagaaaaatctattttttaactgtcaaaattaaaattttcttaaaagaattaaaaaaataggtccagggaaattactgttattggagaaaaaagaaaaaatgaaaacatgaccaaaaccaatcaatggttgctcattttttggttcttgccatataaattttttttttttttttttttttttttttggagacagagtctcgctctgtcacccaggctggagygcaaaggcacaatcttggctcactgcaacctatgcctcccgagttcccctccgccttccacctcctgcctcagcctctcaagtagttgggattacaggcacccatcaccatgcccgactaatttttgtatttttagtagagatggggtttcgccatgttggtcagactggtctcgaactcctgacctcaggtgatctgcccgcctcagcctcccaaagtgctgagattagaggcgtgagccaccatgcctggcatcaaataaaaaaattctggggagaagacaatacattttttaaatcc

SEQ ID NO: 20490 - DNA, 601 bp, Human
tttaccatttgccatactatcataaaacctttgtttctgaccactccacattaacacaatataacacacaaaacaaccaaatcaataaaacaaaaaaattgcagctgttacacacccttttcagtggatcaatgtaaactttagtgtaaaagagctgatcatcatcattatcctggagattccattgttgaactatacggttgacatatggagcatagccaataaatcctgcaacacagcagagagaaagtagataatttaggattcaaagaccgaaactggtgtcatgttaatttcactraccagttgaacagagttgtgaagtcatgaagcctaattcttaggctggaatttcacagctcaccatgaaagaaatatgaattattgagtgccccttgttttatatataaactccaatagagtgtttgctaccaactgcaaaacagaaaataaccaaactctttttaaataaatgtgtctccaaaagtaattgacaaaagagggagaactaatgttttccaaggctcctaagggaaacagatttactaggaaaagaatagactgagacaagaattttttctctgaccttctaaaaagctct

SEQ ID NO: 20491 - DNA, 601 bp, Human
tatgttttcaacattttgaaattcagtttaccatttgccatactatcataaaacctttgtttctgaccactccacattaacacaatataacacacaaaacaaccaaatcaataaaacaaaaaaattgcagctgttacacacccttttcagtggatcaatgtaaactttagtgtaaaagagctgatcatcatcattatcctggagattccattgttgaactatacggttgacatatggagcatagccaataaatcctgcaacacagcagagagaaagtagataatttaggattcaaagaccraaactggtgtcatgttaatttcactaaccagttgaacagagttgtgaagtcatgaagcctaattcttaggctggaatttcacagctcaccatgaaagaaatatgaattattgagtgccccttgttttatatataaactccaatagagtgtttgctaccaactgcaaaacagaaaataaccaaactctttttaaataaatgtgtctccaaaagtaattgacaaaagagggagaactaatgttttccaaggctcctaagggaaacagatttactaggaaaagaatagactgagacaagaatt

SEQ ID NO: 20492 - DNA, 601 bp, Human
atagctgccaagatggagtgactacaagaatacacatttctaatgctctatgttaataaatgacagttatttattcaagaatataaaagaagacattgtctagaatctttaggatttcattattgtctctttaaatctccaagctcagaagttttgataatgcaacctattctgttattttaaggcagcctaagtgagtatgcagtggaggtagggccatgacagtggtgtgagggctgccatttcattttagtatcaagtcatttcaatatgtgtttcaatacatatagcactgcattayatagttcttctttccttctgcctgatccaaccaagttcggcaagtttgccaacttggccacaaaagagaagccataaagacatactaagctagtgctgatatccagccaggtgacataaaccaatctcacctattaaaatatgttttcaacattttgaaattcagtttaccatttgccatactatcataaaacctttgtttctgaccactccacattaacacaatataacacacaaaacaaccaaatcaataaaacaaaaaaattgcagctgttacacacccttttcagtggatcaatgt

SEQ ID NO: 20493 - DNA, 601 bp, Human
tgagaaaacaattatagctgccaagatggagtgactacaagaatacacatttctaatgctctatgttaataaatgacagttatttattcaagaatataaaagaagacattgtctagaatctttaggatttcattattgtctctttaaatctccaagctcagaagttttgataatgcaacctattctgttattttaaggcagcctaagtgagtatgcagtggaggtagggccatgacagtggtgtgagggctgccatttcattttagtatcaagtcatttcaatatgtgtttcaatacatayagcactgcattatatagttcttctttccttctgcctgatccaaccaagttcggcaagtttgccaacttggccacaaaagagaagccataaagacatactaagctagtgctgatatccagccaggtgacataaaccaatctcacctattaaaatatgttttcaacattttgaaattcagtttaccatttgccatactatcataaaacctttgtttctgaccactccacattaacacaatataacacacaaaacaaccaaatcaataaaacaaaaaaattgcagctgttacacacccttttc

SEQ ID NO: 20494 - DNA, 601 bp, Human
aggatcaaagaagctcagagaggtacaaagggctttgcaaggctaaagactacaaatgagaatacactgcatttttttaaactgcaaaagttcactctggtatcaaatggctttggtgtagcttttgagaaaacaattatagctgccaagatggagtgactacaagaatacacatttctaatgctctatgttaataaatgacagttatttattcaagaatataaaagaagacattgtctagaatctttaggatttcattattgtctctttaaatctccaagctcagaagttttgataatgyaacctattctgttattttaaggcagcctaagtgagtatgcagtggaggtagggccatgacagtggtgtgagggctgccatttcattttagtatcaagtcatttcaatatgtgtttcaatacatatagcactgcattatatagttcttctttccttctgcctgatccaaccaagttcggcaagtttgccaacttggccacaaaagagaagccataaagacatactaagctagtgctgatatccagccaggtgacataaaccaatctcacctattaaaatatgttttcaacattttgaaatt

SEQ ID NO: 20495 - DNA, 601 bp, Human
gatttcattatcatctctttgaatcttcaggctccaaattctcaaatatttgaaatccacaaattggctataaagtctcctaaaaaggatcacacccatccttacaggctctatccactctgggccaccaaacacttgaacaatgaccagggcttttggcttcaatgttttctcaacacccataatctccaggctccaaatctcagaggaaggtctctgtcctcaagggtatcacaggtaattttcaaattaaaaactgtcttttgagtggctttattcacatgtcatttcaaaataccagaaaatgtgttcttttaaaattgtagccaattaaacacataaagtctatgttatcatcatatgaaacagaaaaaaagtccagattttggttttcagggaaccaaggatccagtccctacaatgtcacagactatgtggtctcagtttctctactgataaagtgtggatacagagtctagcctctagcctatctaggatcaaagaagctcagagaggtacaaagggctttgcaaggctaaagactacaaatgagaatacactgcatttttttaaactgcaaaagttcactctggtatcaaat

SEQ ID NO: 20496 - DNA, 601 bp, Human
attcttatatcttaagtgtctaatcaaaatatttagatgactaaagtatttagctaaaaggtagaaactgcgatagttgcaactcattgcaaaatacacttaaagaaaatcttgtttcctaatgacagcaactacaaacacacaagtaacttttatatctgtatccaatatatacagtaaatttattaaatatcaacttatattggtaaatatgataaaagtattctcaaattagaaaatcttgctttactgtactccagagtttcactcacatcaatttcaggaatattctctctagggyctatggaagactgcttattgtacccaacattccctcaactccccaataagggaactcagatttcaggagcatatatctgcttaaaataaaaaaacagattttcctttgggtattatgagtgggcacatacatacgttctgatcaaagtatgagaaactatttggtaagacttctagaaaggcaacttaaagagagtgatgaaactgagatggcctgtttttactaccgtgcctctcttagctgcccagaatacgaatgcaacgactgaaactcaagtagcaattttggacaaggaagtaa

SEQ ID NO: 20497 - DNA, 601 bp, Human
actcactccaacctggcaccagtaaagtgattgaggtgctaagccagtgagctgtctgtcagaataattcatcttgcaatcctgcctttgccccttcatagtattgttattcttgccaagttaaattagtaactcagtttagtcatctatcaaatggtatccacgtctgtcttttagggttattatgaagataataacaatatatgcatggtgagtagaatattgtctggcataagcaagggttctacaattggctaccaatgataatatttccagttcttaaaaatcagacttagcacaytaagcaagataaaactcaagtcagagaggagcagagccatcgtcttaaaatttcctgagcactccaaactaaacattttgcattgtgggaattttttttttttttttagagactgggtctcactttctggccccggctggagtgcaaggacacaatcacaggtcattgcagcctcgaactcctgggatcaatcaatcctcagcctctcatatagctgggactataggcacgcaccaccatgcctgactagattttaagaatctttttactaaatggactgacttgaagtattgattgaat

SEQ ID NO: 20498 - DNA, 601 bp, Human
tgtgtaaaagatgaagtctttattttagcaccaaaataaagtctttgaaagaaatttttaaaaataaaatagatgacattccacatatcaatccatagtctatctccaagaattggccaaataaaagtaactgttacttaccttggtgggtccatttccattaattgccactggtaatgtttcataaaatgtattcttagctctggctttgccattttcaaattttaaaacaacttcatctgggttaaaaagagaaaataggctttagtaatttaaaatacgtgtgtgtgtgtctgtattygtgtgtctgtgtgtgtatgtgtgtgtatcatcattacaaaatttctcatggatgtaatattccaagtgctacaacacttctagtaacttcatctactccaagccagcagatacccaaaatgaaggatgacagtgacaacagatacagataccaaactcactccaacctggcaccagtaaagtgattgaggtgctaagccagtgagctgtctgtcagaataattcatcttgcaatcctgcctttgccccttcatagtattgttattcttgccaagttaaattagtaactcagtttagtcat

SEQ ID NO: 20499 - DNA, 601 bp, Human
aaaaccagatgatatactgtgtaaaagatgaagtctttattttagcaccaaaataaagtctttgaaagaaatttttaaaaataaaatagatgacattccacatatcaatccatagtctatctccaagaattggccaaataaaagtaactgttacttaccttggtgggtccatttccattaattgccactggtaatgtttcataaaatgtattcttagctctggctttgccattttcaaattttaaaacaacttcatctgggttaaaaagagaaaataggctttagtaatttaaaatacgtrtgtgtgtgtctgtattcgtgtgtctgtgtgtgtatgtgtgtgtatcatcattacaaaatttctcatggatgtaatattccaagtgctacaacacttctagtaacttcatctactccaagccagcagatacccaaaatgaaggatgacagtgacaacagatacagataccaaactcactccaacctggcaccagtaaagtgattgaggtgctaagccagtgagctgtctgtcagaataattcatcttgcaatcctgcctttgccccttcatagtattgttattcttgccaagttaaattag

SEQ ID NO: 20500 - DNA, 601 bp, Human
cttgggatttaactacctacacaattttaatttttatatccctattgaaaaacagctgtatatagcacgtaattttattatgcataatggaatgaatagttttcctttctatcacattttaacaagctgtaagacaaaacagcttaagtattaaattacatactcctacatgcaaaaagaaaaaatgttaatataaatatttttctatctttgcaccagaaagtttatacaaaaggaaacgaaacagataaaaagtattaactcgccctccagaagacaacactactttcggcaaaaaaakatcaggataaatttttaaacatcttcatgatgcagcttcattcagaaatattctggcattctttgcagataggaaacagtttgctatctgagagactggccaaaaaccttactttcaagtaaaatagggctctattcataagctcctacatgtacacaagttactctttatactcctttcagacaatgataagaatagaaactatttaattcaggagcttgaacatattacagtaaaagtattttgcatttgcatgggttcaggagttagtagtactatattcctaagagctttattttt

SEQ ID NO: 20501 - DNA, 601 bp, Human
atataaagaaacttgcctatggcccacatctaacattatgataggcttgggatttaactacctacacaattttaatttttatatccctattgaaaaacagctgtatatagcacgtaattttattatgcataatggaatgaatagttttcctttctatcacattttaacaagctgtaagacaaaacagcttaagtattaaattacatactcctacatgcaaaaagaaaaaatgttaatataaatatttttctatctttgcaccagaaagtttatacaaaaggaaacgaaacagataaaaagyattaactcgccctccagaagacaacactactttcggcaaaaaaagatcaggataaatttttaaacatcttcatgatgcagcttcattcagaaatattctggcattctttgcagataggaaacagtttgctatctgagagactggccaaaaaccttactttcaagtaaaatagggctctattcataagctcctacatgtacacaagttactctttatactcctttcagacaatgataagaatagaaactatttaattcaggagcttgaacatattacagtaaaagtattttgcatttgcat

SEQ ID NO: 20502 - DNA, 601 bp, Human
gttaacatttattgaatactgaccactttgtgtatgtatattaaatttatacaaatagaatatcatttatatatttgttatgtatattcatatatatatgtgggtaaaatttcatttaacattcctaccaacactctgagataatcactatgactttacatataaagaaacttgcctatggcccacatctaacattatgataggcttgggatttaactacctacacaattttaatttttatatccctattgaaaaacagctgtatatagcacgtaattttattatgcataatggaatgaayagttttcctttctatcacattttaacaagctgtaagacaaaacagcttaagtattaaattacatactcctacatgcaaaaagaaaaaatgttaatataaatatttttctatctttgcaccagaaagtttatacaaaaggaaacgaaacagataaaaagtattaactcgccctccagaagacaacactactttcggcaaaaaaagatcaggataaatttttaaacatcttcatgatgcagcttcattcagaaatattctggcattctttgcagataggaaacagtttgctatctgagagac

SEQ ID NO: 20503 - DNA, 601 bp, Human
acaacaacattataacagttaacatttattgaatactgaccactttgtgtatgtatattaaatttatacaaatagaatatcatttatatatttgttatgtatattcatatatatatgtgggtaaaatttcatttaacattcctaccaacactctgagataatcactatgactttacatataaagaaacttgcctatggcccacatctaacattatgataggcttgggatttaactacctacacaattttaatttttatatccctattgaaaaacagctgtatatagcacgtaattttattrtgcataatggaatgaatagttttcctttctatcacattttaacaagctgtaagacaaaacagcttaagtattaaattacatactcctacatgcaaaaagaaaaaatgttaatataaatatttttctatctttgcaccagaaagtttatacaaaaggaaacgaaacagataaaaagtattaactcgccctccagaagacaacactactttcggcaaaaaaagatcaggataaatttttaaacatcttcatgatgcagcttcattcagaaatattctggcattctttgcagataggaaacag

SEQ ID NO: 20504 - DNA, 601 bp, Human
aggtgtttgcataaatacttaaatccttagtaatataaaatgtttccaactggagaagaaaaacacggcctgtagcctagaaatcttagatatatgttgtgaaatatctagaaaaaatgtctactaagcataatagccatcaatctgagttataaacttaaataatcacattttacaaaataccctttgaaaccagagagtaaaataaatggtcatatataaaaaaattttacttaacaaaaaaaggaaaaatttaacacaattctatggacagattaatgggaaaaccatcaacataaargttaccaattttagtgtgattcgactgtgctaaaattcaggtaagattatctgtctccatcattagagcatttcagagatttttatttgtcaagtctctaagttttctgaaaagctgttgctttttgcagatttttaaaataacttatcacataaaagcaacatagagttaatactaaataaccaaagataagacaaaaacgtccgccatcaaggattttaaggccccatgaaagcagggaaaatataaacaaaagacaatacataaaaacaaaatactttagtgaaagtatatatatta

SEQ ID NO: 20505 - DNA, 601 bp, Human
actgctagacaagtctttgtataaatacttaaatctttaataggtgtttgcataaatacttaaatccttagtaatataaaatgtttccaactggagaagaaaaacacggcctgtagcctagaaatcttagatatatgttgtgaaatatctagaaaaaatgtctactaagcataatagccatcaatctgagttataaacttaaataatcacattttacaaaataccctttgaaaccagagagtaaaataaatggtcatatataaaaaaattttacttaacaaaaaaaggaaaaatttaacamaattctatggacagattaatgggaaaaccatcaacataaaggttaccaattttagtgtgattcgactgtgctaaaattcaggtaagattatctgtctccatcattagagcatttcagagatttttatttgtcaagtctctaagttttctgaaaagctgttgctttttgcagatttttaaaataacttatcacataaaagcaacatagagttaatactaaataaccaaagataagacaaaaacgtccgccatcaaggattttaaggccccatgaaagcagggaaaatataaacaaaagaca

SEQ ID NO: 20506 - DNA, 601 bp, Human
agagaagatgcttcaaaattctgtcaatatctactgctagacaagtctttgtataaatacttaaatctttaataggtgtttgcataaatacttaaatccttagtaatataaaatgtttccaactggagaagaaaaacacggcctgtagcctagaaatcttagatatatgttgtgaaatatctagaaaaaatgtctactaagcataatagccatcaatctgagttataaacttaaataatcacattttacaaaataccctttgaaaccagagagtaaaataaatggtcatatataaaaaaawtttacttaacaaaaaaaggaaaaatttaacacaattctatggacagattaatgggaaaaccatcaacataaaggttaccaattttagtgtgattcgactgtgctaaaattcaggtaagattatctgtctccatcattagagcatttcagagatttttatttgtcaagtctctaagttttctgaaaagctgttgctttttgcagatttttaaaataacttatcacataaaagcaacatagagttaatactaaataaccaaagataagacaaaaacgtccgccatcaaggattttaaggccc

SEQ ID NO: 20507 - DNA, 601 bp, Human
acacttttaccacacacaaccttcagagtgtacatttaaatttaagtcactgctatgaaagtcatactattcatttatctgcatttaaaaaaaattgatcttaccttgattcatcatttgattaaatatgtggactcgtagccattaaaagaaaaacataagtaacttctacagccctttatgtataaatacgtacaaacatagacacagtctaagttggctactgcatacgcaaacaaatagtttgagacacccaaatttggcataacaattttaatttaaaagtttattttttcttaamgtttccttagtaaaataatttaatttaattttaatttattaaaacatacattcccatgtttctggcttccgcttgacttagattttcttctggtcctactatttttatagttttgatttcatgcttagctttatcaaaaaataccttgatgtccttttcatgataaacttcctgtaacatattttaaaaatcaaaaattagagaataagacaatcagatgactgaagtattcatattagagagtgcttcacattcaaggtcatgaattctacaattcagatattcaattacatataaaat

SEQ ID NO: 20508 - DNA, 601 bp, Human
tattagctgtagaacataactaagttccctcaatttactaaatacacaattactacagtatgttcacatcaatatgaaaaataatcattttaacaataaattgatatcgaattttagaaagtacctgttttgttcaatcaaaatttttaaagtccttggatttgtcaaaacaacatctgcatccacactaaagtaataatcacacttttcatcctgacggcaaaagtccctaacagtgaaaaagaaaatgaaatgggcatgacataaaataaatatctgctgactgaaaaatgttaatatrtatatccttatatgtaaaatatggttctctagcatacttttctgatcaaaatagtggaacaatatctgaaacgatatatatattgtcttaaatttcaaaatggtcaatttaacacggatattcacagggagctcacctctaaaattttaagccagttaaaatatattttcaagccagtaaatattttaaggcataaaacatccacaaatcaaaatgtttctgcatacatacatacatacatacacatgcacacaaatgcaacttacatatcccacaactcagttttaaatgaatgttgga

SEQ ID NO: 20509 - DNA, 601 bp, Human
gatctcctgacctcgtgatccacccaccttggcctcccaaagtgctgggattacaggcgtgagccaccacacccggccgggaattttttttcttttagaagatttaaaatgtttaatattaagagggatatatgtcaaatacatagtgtaaattcattaaatagttcactaagagaataattaataaatatataaattatagtcataaaatgaaaatatctaattattaaaaagcatatgggcattacacactatagcatttcaatcaaattaagagaaaacaatgcaaattcaagaaaayagtactgaattaaactaggttttaagagttacaaatcatacactatttcatatctctagggtgtcacaactgcttttccttgccaaatgatcaaaacctcattcatatgctttggaaaattacctacgatgtatatagatagttaacttagatactgagtatctataacacagctatacagttgggctgtatatacaggttgctacagagaggtcttagatttttgaagtaagaactaaattctcaaatttacaaattctagtgatatatatatatagatagatattatatatagggtgg

SEQ ID NO: 20510 - DNA, 601 bp, Human
atgtaaggatggcagctgaggaatgattcatattattatacaatttaaggagtaaaatttagagcaagggagcaaatagagatagggagagaagaggaaaaaagagagctgatgagaagctagaaagccacatgcccaagatgtgtcaaatctctttctctacccttcagtccaatctactaaatcttgcaacattcctggcatatgtcaatagactatagaaaccacatgtctagatacagaagcaagaaccataggtattacataaacctaaacctttgattaactaacagaattccayggagacacagcctgagttttactctttaaggggcaagggccccagatggcaggtaagtcttttttctttctttttttttttttttttttgagacggagtctcgctgtgtcgcccaggctagagtgcagtggcgcaatcttggctcactgccagctccacctcctgggttcacaccattctcctgcctcagcttcccgagtagctgggactacaggtgcccgctaccacgcccggctaattttttgtatttttagtagagatggcgtttcactgtgttagccaggatgatctcgatctcct

SEQ ID NO: 20511 - DNA, 601 bp, Human
caatatgaatatcaaacatttaatttaaaaagaacttgtaatttataatcccagctgcctcctgaaaaggtttaaaccaacaaatttgggaaaccaaaattcatctgctgtatacctcaatgtttttgtgaataaaaatgtaaggatggcagctgaggaatgattcatattattatacaatttaaggagtaaaatttagagcaagggagcaaatagagatagggagagaagaggaaaaaagagagctgatgagaagctagaaagccacatgcccaagatgtgtcaaatctctttctctacycttcagtccaatctactaaatcttgcaacattcctggcatatgtcaatagactatagaaaccacatgtctagatacagaagcaagaaccataggtattacataaacctaaacctttgattaactaacagaattccacggagacacagcctgagttttactctttaaggggcaagggccccagatggcaggtaagtcttttttctttctttttttttttttttttttgagacggagtctcgctgtgtcgcccaggctagagtgcagtggcgcaatcttggctcactgccagctccacctcc

SEQ ID NO: 20512 - DNA, 601 bp, Human
ataacatgaattagaatctacatacattaatttgggaaataattcaatatgaatatcaaacatttaatttaaaaagaacttgtaatttataatcccagctgcctcctgaaaaggtttaaaccaacaaatttgggaaaccaaaattcatctgctgtatacctcaatgtttttgtgaataaaaatgtaaggatggcagctgaggaatgattcatattattatacaatttaaggagtaaaatttagagcaagggagcaaatagagatagggagagaagaggaaaaaagagagctgatgagaagstagaaagccacatgcccaagatgtgtcaaatctctttctctacccttcagtccaatctactaaatcttgcaacattcctggcatatgtcaatagactatagaaaccacatgtctagatacagaagcaagaaccataggtattacataaacctaaacctttgattaactaacagaattccacggagacacagcctgagttttactctttaaggggcaagggccccagatggcaggtaagtcttttttctttctttttttttttttttttttgagacggagtctcgctgtgtcgcccaggct

SEQ ID NO: 20513 - DNA, 601 bp, Human
tgaacaacagcccctggtgcatttaagatattcaatgaatatttgttgaatttgtaaaaaatgaatgaagatgaactgagatgtttgtaaacaggcaaagctttcctgtaattaagtctcaaattacttaagtatgtttccagttttccatgactttaaaaaatgacttgtgattacagtaagctagtcctggcaacactgaactttcctttaactattttagaaagcaaatttatggaacaactattctttatatgaaaaaagaaaacctatttcacctctatcttgtgaagaccagccrggccctttctattacatgcacaaaagtgaaataaataaacacacatcgggcccggcgcagtggctcatgcctgtaatcccagcactttgggaagccgaggcgggcggatcacaaggtcaggagtttgagaccagcctgaccaacatggtgaaatcccatctctactaataataccaaaaaaagttagccaggcatggtggcacgcacctataatcccagctaatcaagaggctgacacaggagaatcgcttgaacccgggaggcggaggttgcagtgagccaagatcatgccactgcact

SEQ ID NO: 20514 - DNA, 601 bp, Human
agagtatactgcccctttttaatcaggctgacatgtttgagaactaaggcaaagcatgtaatgtcttagtcactctggtccatcatatgtatgaaaaaaagaatgacattcttctccaatattaccttagcaaaactatttcaattgtgattatttttagtaatcaaccattgtctctgaaataaatataaatcatgcacacacttttcagcaaatatattcttttcaatctctagaagtgaaaatctaatattggtaaaaaaaacttgtatttaaagcagaataatagctatttcacacaaaaaaactcatgcaatcaggaatactggaatgttctggctgttagtgttactgttggcttaattataaattttaaaacctatcaaaacaacccttaattataaccattaaaaagttagtaaactaaatcccctttccaagcttttaaataaagagtattactcttctatcaaccataatgtgagtatggtaaacatatattatctcttagtattccccacagcaatgagcttgttcctttgaagatttgggactttaaaaacatttttttaaaatattagttttatactagtatttcagg

SEQ ID NO: 20515 - DNA, 601 bp, Human
accctcatttgtgatgtgcccaaagatacaatcaggtatattgtctatacaactcacccagagtcaatacaactgcacagaaacaacagaatacgatcttaatagtcttttctcctccactgtgcattttaattgcagctaacaaaaacctttattgtatttacatcattcagattgaagctttccacaccaattactatttccacaagcaacacatctttttaccactcaactgtttgaacagaaacgtgtgcctttttttttctaaatgtaagggcacatccttttagtcctgagagtrtactgcccctttttaatcaggctgacatgtttgagaactaaggcaaagcatgtaatgtcttagtcactctggtccatcatatgtatgaaaaaaagaatgacattcttctccaatattaccttagcaaaactatttcaattgtgattatttttagtaatcaaccattgtctctgaaataaatataaatcatgcacacacttttcagcaaatatattcttttcaatctctagaagtgaaaatctaatattggtaaaaaaaacttgtatttaaagcagaataatagctatttcacacaaaaaa

SEQ ID NO: 20516 - DNA, 601 bp, Human; identical to SEQ ID NO: 20395

SEQ ID NO: 20517 - DNA, 601 bp, Human
taataactcaataaggtgcacctaaaccttactgtaatcaaattctattttatacctacttctaccctcttctctccctttaaaaagaaataaaaacctaaaaaaagaatgaaagggacttaggtttaactttctcacctgtcagccataaaatataaatcagctcaaagaaccaagagttgactatcacacaagacccatgcccaagtcacacaaaacacgcaaacacacagatgactgatgaaaatcaacattttaccaagctaaatgcaagtaaggcccttaaagaaactttactackaggcaatatactatatcaaatattaaataaacaaaaataaataaaataagtaaaaataacacctttggggggctgagcatttggaatgtttccggagtaggggagtctttttccctttgtaaagtctaaaatgaagagaagcattgggtaagttgacctgtacacccgctctctcaggtattctttggtaaataaaaataatagcagctgttgatcaaaagctaacattctgaaatgtccttcatagacaacatgcagaacaagcaaagcttatagcacacacaaagaaacatctccagc

SEQ ID NO: 20518 - DNA, 601 bp, Human
tgttttaatagtaaaagagttagtgattaataactcaataaggtgcacctaaaccttactgtaatcaaattctattttatacctacttctaccctcttctctccctttaaaaagaaataaaaacctaaaaaaagaatgaaagggacttaggtttaactttctcacctgtcagccataaaatataaatcagctcaaagaaccaagagttgactatcacacaagacccatgcccaagtcacacaaaacacgcaaacacacagatgactgatgaaaatcaacattttaccaagctaaatgcaartaaggcccttaaagaaactttactactaggcaatatactatatcaaatattaaataaacaaaaataaataaaataagtaaaaataacacctttggggggctgagcatttggaatgtttccggagtaggggagtctttttccctttgtaaagtctaaaatgaagagaagcattgggtaagttgacctgtacacccgctctctcaggtattctttggtaaataaaaataatagcagctgttgatcaaaagctaacattctgaaatgtccttcatagacaacatgcagaacaagcaaagctta

SEQ ID NO: 20519 - DNA, 601 bp, Human
ttctttttctaatgtttaaaggctaacacgcaaatgagtcatacattataaaggcagataaagaaaaccagtctcatattcttgccccaaaccagacaaatgtggcaaacaccactaggtaatgtgtttctttttggacctgttttaatagtaaaagagttagtgattaataactcaataaggtgcacctaaaccttactgtaatcaaattctattttatacctacttctaccctcttctctccctttaaaaagaaataaaaacctaaaaaaagaatgaaagggacttaggtttaactttstcacctgtcagccataaaatataaatcagctcaaagaaccaagagttgactatcacacaagacccatgcccaagtcacacaaaacacgcaaacacacagatgactgatgaaaatcaacattttaccaagctaaatgcaagtaaggcccttaaagaaactttactactaggcaatatactatatcaaatattaaataaacaaaaataaataaaataagtaaaaataacacctttggggggctgagcatttggaatgtttccggagtaggggagtctttttccctttgtaaagtctaaaatg

SEQ ID NO: 20520 - DNA, 601 bp, Human
tgtgattaaaactggatggtgcttttgaatacacaaaacaaaaataatagaatattggaagagaacaaattgataattcccttccccaaagctaataagtgtcttaataaaaacaagttattggtcaagtttagatctactctatagatcatgaaatacaattaattatgtcgttttaatttttttctttttatttactttttaaaaacaatttcagcttttggattcagggagtatatgtgcaggtttgttacaagtgtataatgcatgatgctaaggtttagggtatgactgatcccawcaccaaggtagtgagcacagtacccattagttggtttttcaacccttgtccccctccctactccctcactcctctagtgatccccagggtctactgttcctatatttatgttcacaagtacccaatgtttagctcccactcataagtgagaacatgcagtatttggttttctgtgccattaattcacttagggtaatggcctccagttctctccatgttgctgaaaatgacataatattgttcttttttatggctgtatagtattctatggtgtgtatgtaacacattttctttatccaa

SEQ ID NO: 20521 - DNA, 601 bp, Human
gtacattcacaaaactgtcaaaaaataattttaaaaaatgtattttcctaaacaaaactttttgaattttcttctaaaaaatcaaactattataatatgtgaactatttgtaaacatgtttctaaaattgtgattaaaactggatggtgcttttgaatacacaaaacaaaaataatagaatattggaagagaacaaattgataattcccttccccaaagctaataagtgtcttaataaaaacaagttattggtcaagtttagatctactctatagatcatgaaatacaattaattatgtcrttttaatttttttctttttatttactttttaaaaacaatttcagcttttggattcagggagtatatgtgcaggtttgttacaagtgtataatgcatgatgctaaggtttagggtatgactgatcccatcaccaaggtagtgagcacagtacccattagttggtttttcaacccttgtccccctccctactccctcactcctctagtgatccccagggtctactgttcctatatttatgttcacaagtacccaatgtttagctcccactcataagtgagaacatgcagtatttggttttct

SEQ ID NO: 20522 - DNA, 601 bp, Human
ttccaaagacttgaattcttacacaaatatctacaattcaggatataattcaggatatctgaccaggaacctaatgtcacccaagaaatcaaataattctatccctcaagacaccaagagattcaatggtgaagtgaaatatggaattctaccctcacgactagaaaacacctcttttcagctttatttctgtgaaagaggaaggtatgtggttaaaatggaacaaaagtacttttaaaataacaaaatgtcaaaagataatattttcctattcagaatattcaaagactactacatttastatccccatatctcaactattcctacaaaataaaggacaattctcatcaggtggattgagtctgcaatttaaaacttttactattggcaaggggaaaatcattacagcagtgttacaggtttgattgttgaagacagcattttcccttgaataagtgtgccacttgcctaacaaaaagatgtccctgtaaaacacaaaaggagctaattactgtaccactcaaatctgtaaaaaaaaaaaaaaaaaaaaaaagaagaagaaaacagattttaaaaggaaattgtttcttcaagttaagac

SEQ ID NO: 20523 - DNA, 601 bp, Human
attttcattgcttactttccaaagacttgaattcttacacaaatatctacaattcaggatataattcaggatatctgaccaggaacctaatgtcacccaagaaatcaaataattctatccctcaagacaccaagagattcaatggtgaagtgaaatatggaattctaccctcacgactagaaaacacctcttttcagctttatttctgtgaaagaggaaggtatgtggttaaaatggaacaaaagtacttttaaaataacaaaatgtcaaaagataatattttcctattcagaatattcaragactactacatttagtatccccatatctcaactattcctacaaaataaaggacaattctcatcaggtggattgagtctgcaatttaaaacttttactattggcaaggggaaaatcattacagcagtgttacaggtttgattgttgaagacagcattttcccttgaataagtgtgccacttgcctaacaaaaagatgtccctgtaaaacacaaaaggagctaattactgtaccactcaaatctgtaaaaaaaaaaaaaaaaaaaaaaagaagaagaaaacagattttaaaaggaaattgt

SEQ ID NO: 20524 - DNA, 601 bp, Human
tttaggggctgaatatttataccataatttatgtcactggttttgcatatctgtttatatgtaactcaaacattttttatgtggaggaaacaaaggtatcttcaaaattttaataaatttcatgtttatatagtatatatggatcagatttctatattatctcattattccctctaatattaattagctttctgattctaaaatgtggcaagaaattgaataatcatccataagatttaagaacttttacctatagcatttttcctgtgcatcaatactgatttttcttcaagttaaagtaaaaaaaaaatcccctaagattttattttagggcattagtattcacatttcattttagatcacctttcaaatcattgagcaaactgtgactttattaatttcttagaaattctgataatgggataatcaataagcattttgctatggggtatccctcacaaggcatattaatcaggctgctttaacaaagaaagccatggaaagaaaacttgttcctactcagttctgatattttcattgcttactttccaaagacttgaattcttacacaaatatctacaattcaggatataattcagga

SEQ ID NO: 20525 - DNA, 601 bp, Human
ataattccaatcaaaagatgttttaaaagatatttgccttaaatacatcttttgaggctagattttaggggctgaatatttataccataatttatgtcactggttttgcatatctgtttatatgtaactcaaacattttttatgtggaggaaacaaaggtatcttcaaaattttaataaatttcatgtttatatagtatatatggatcagatttctatattatctcattattccctctaatattaattagctttctgattctaaaatgtggcaagaaattgaataatcatccataagattwaagaacttttacctatagcatttttcctgtgcatcaatactgatttttcttcaagttaaagtaaaaaaaaaatcccctaagattttattttagggcattagtattcacatttcattttagatcacctttcaaatcattgagcaaactgtgactttattaatttcttagaaattctgataatgggataatcaataagcattttgctatggggtatccctcacaaggcatattaatcaggctgctttaacaaagaaagccatggaaagaaaacttgttcctactcagttctgatattttcat

SEQ ID NO: 20526 - DNA, 601 bp, Human
tgcacttctttcagttactaaaattaagggttagggctctatattaaaaaatggtttctctttattctaatccatgaatttgattctttttgaccaatctctggcataaaatccacacacaaagatatctcaacttttttcaacaaaagctaaagaattattttattgggacaagttctttattcaaatatggatatttactaaaatattattaatacatggagtaatataaatatccaaaaagatatcttctgaaatttagaatatttctagaaattattaattttctctttacaaagtrcaaatacagagagccagcagggaggaagtgagacacagactcaaaataattccaatcaaaagatgttttaaaagatatttgccttaaatacatcttttgaggctagattttaggggctgaatatttataccataatttatgtcactggttttgcatatctgtttatatgtaactcaaacattttttatgtggaggaaacaaaggtatcttcaaaattttaataaatttcatgtttatatagtatatatggatcagatttctatattatctcattattccctctaatattaattagctttc

SEQ ID NO: 20527 - DNA, 601 bp, Human
cttcacttcagttattaatatttatcaaggaataatcatgagtttactagcacttgcacttctttcagttactaaaattaagggttagggctctatattaaaaaatggtttctctttattctaatccatgaatttgattctttttgaccaatctctggcataaaatccacacacaaagatatctcaacttttttcaacaaaagctaaagaattattttattgggacaagttctttattcaaatatggatatttactaaaatattattaatacatggagtaatataaatatccaaaaagatmtcttctgaaatttagaatatttctagaaattattaattttctctttacaaagtgcaaatacagagagccagcagggaggaagtgagacacagactcaaaataattccaatcaaaagatgttttaaaagatatttgccttaaatacatcttttgaggctagattttaggggctgaatatttataccataatttatgtcactggttttgcatatctgtttatatgtaactcaaacattttttatgtggaggaaacaaaggtatcttcaaaattttaataaatttcatgtttatatagtatat

SEQ ID NO: 20528 - DNA, 601 bp, Human
acatcttctgtgaaagtagtattaataatatttcttctggaaaataacagcaaaattttctatactttgtaatcattaatacaaacctgttcaactatattttcagtgaaaatctttgaataatcacggtttatatacttttccttccagtcctataaaaagaagtacatattaaaacaaatatctttataaatacttcactgaaaagtataaagcatatgcattttagaaattattcaacttataaatgattatgtatagtggacaaaatagtaattttcagaaatcacagtatatagcytaatctttgcctggttctgaatatgcttatgtcattctatgaaatacaaaatttttatttatgaaatattgtacctcaggattttaaaacttaagtaatcttacagtgaatagatttacacattttacagatgctccttgactcacgatggggttatgtcccaataaacccgtgggaggttaaaaacacacagtaccccgataaatccaacataaagctgaaaattcctaagtaaagccaccgtaagttggggaccatcagtattttaatatatacacagagtaggtaaataaaggtgtg

SEQ ID NO: 20529 - DNA, 601 bp, Human
ggctagccaatttatctaagtctagaactcagagacatatgagaaaaagtatataacccctccgaattctctgagtatctacttaacccccacatacattttagttcttagtgtgaaattacaacttacatgatgttttcccccagaccatttgccgtaatgttccatttcttctaccaattcatcacaggctttttcagaaaatatggggaaccaaaagacatctggacagggctataaaatatgcatcatcgttagaagacataataacttctgtgtcttaatagtctaaaatagttawtttaatatgtgtaaaataaaaaatcctgtatgactaggaaacatagttttctgtcatggtttattgacagtattttttttctcatggtacataaataatggtgcacctcagaattgatgacatcttacattctcaaaaattaggtattaacaatagttttgaacactaagctaaaagagaattcatgtttcaaagatgtctctgagaaaagactcttccagaaagacagcccagtttcttccaaagataagctttcactgcaagagttctacatcagagatctgtcaacagtttctattt

SEQ ID NO: 20530 - DNA, 601 bp, Human
caatgacgaaacaaagtaatgtaaggtcagtagactcctttcctacttcttaaatgtatatgtgaagtttagctataaagtaaataaaattgacttcctaagccctcacatcctttcttaaaaatgagtctttttttacagtgaccctttaggcagtctcagctgcttgatgagcatacacttggcatatctgctgtctgtattaccaaacaccaaaaacaagctttccccgcccttcctcacttctatttgtaacactcaaaagtttttgaatgattgcttttcattatttcatcacccrctgacttaagttcttccttatactttaagcttccctctcccttatcagctcattacctgggggacataaccgtgcagaggcagtaatattccagagtattctgctaaaatggcatgtctgttctcagaggaaaagaaacacatctaaccactggcagtagtatttcctgccaagtctttgacactgaatgcaaatgcaaaactgaattacacctaaggcactcagatccctccttcctatctttacacacaaaaacagttttcagagccagataacatttgccttagaattttcaccaca

SEQ ID NO: 20531 - DNA, 601 bp, Human
atatcatctgctttaactgtaaaattatcaaaataacttaggtaacagctttgtcaatgatacaatgacgaaacaaagtaatgtaaggtcagtagactcctttcctacttcttaaatgtatatgtgaagtttagctataaagtaaataaaattgacttcctaagccctcacatcctttcttaaaaatgagtctttttttacagtgaccctttaggcagtctcagctgcttgatgagcatacacttggcatatctgctgtctgtattaccaaacaccaaaaacaagctttccccgcccttcytcacttctatttgtaacactcaaaagtttttgaatgattgcttttcattatttcatcacccgctgacttaagttcttccttatactttaagcttccctctcccttatcagctcattacctgggggacataaccgtgcagaggcagtaatattccagagtattctgctaaaatggcatgtctgttctcagaggaaaagaaacacatctaaccactggcagtagtatttcctgccaagtctttgacactgaatgcaaatgcaaaactgaattacacctaaggcactcagatccctccttcct

SEQ ID NO: 20532 - DNA, 601 bp, Human
aaaataacagttgttccaatgtggtatatcatctgctttaactgtaaaattatcaaaataacttaggtaacagctttgtcaatgatacaatgacgaaacaaagtaatgtaaggtcagtagactcctttcctacttcttaaatgtatatgtgaagtttagctataaagtaaataaaattgacttcctaagccctcacatcctttcttaaaaatgagtctttttttacagtgaccctttaggcagtctcagctgcttgatgagcatacacttggcatatctgctgtctgtattaccaaacacyaaaaacaagctttccccgcccttcctcacttctatttgtaacactcaaaagtttttgaatgattgcttttcattatttcatcacccgctgacttaagttcttccttatactttaagcttccctctcccttatcagctcattacctgggggacataaccgtgcagaggcagtaatattccagagtattctgctaaaatggcatgtctgttctcagaggaaaagaaacacatctaaccactggcagtagtatttcctgccaagtctttgacactgaatgcaaatgcaaaactgaattacacc

SEQ ID NO: 20533 - DNA, 601 bp, Human
cttagggatctataaatgacactgcaatgtatcttgttccatttttaacaggaagtccttcatgcaaatgtgtgagtctcccaggatgcatgaagctccagccttttcgtggtgactcaatagagcaattgtaccttagaaatttgcaaccacctccctaaaaaagttaaaatgaagaaatacatcagattatatttaaccagtggcaaaattcaaattatgtcatttgagcaaaatttaaaaaagaaactaaggcctaaggcaaagtccttttcataatgatatatttcttttgaaaaayctaaaaacacaagagtcataattacctgaaagtcttctcccacgttattaagtgcaatgtttatggtaaatgtagaagcatcatgatgaggacgaagagaacgctgtcgttcaggggagtattttactacaaaattcagtagtgcaaatccctgaaaaagcaaagtaagccagtggatttgcttattaataaaaacattaaaaagaacacctgtgtaaaaatgggtaagaaataggctggaggggtgagaggataactaccttcgtataatagcctgcaaagaccttcagtgtaactggt

SEQ ID NO: 20534 - DNA, 601 bp, Human
aatattattagtcttgttatttgtacctaaatattttatcaatttgaaacacaaattcataaattgtcattattctcagaggcaacaaagcatagaaataaatatttaagttttttctttcttttcttcttcaatctgtgttttaaggctcagagcagacattaagaaatatcaaacaattttttataaaaagtttttcaaatgtttggcccaaagtgaagttgttctgttgatgttatttaaatattcctctcatcttctcagccacaacttcaaagacgtgttcatgccagtcattcayccaaaataaatttcaattcaatgaaaagtaaataacttagggatctataaatgacactgcaatgtatcttgttccatttttaacaggaagtccttcatgcaaatgtgtgagtctcccaggatgcatgaagctccagccttttcgtggtgactcaatagagcaattgtaccttagaaatttgcaaccacctccctaaaaaagttaaaatgaagaaatacatcagattatatttaaccagtggcaaaattcaaattatgtcatttgagcaaaatttaaaaaagaaactaaggcctaaggcaa

SEQ ID NO: 20535 - DNA, 601 bp, Human
gttgcatacaaatccagttagaatctgattttcaaggttttacaacatggtaattttcatttatatccattttgtctacatttcctctatattttgataaataaaaatcttcccatgctttttttaaataagaaaatattattagtcttgttatttgtacctaaatattttatcaatttgaaacacaaattcataaattgtcattattctcagaggcaacaaagcatagaaataaatatttaagttttttctttcttttcttcttcaatctgtgttttaaggctcagagcagacattaagmaatatcaaacaattttttataaaaagtttttcaaatgtttggcccaaagtgaagttgttctgttgatgttatttaaatattcctctcatcttctcagccacaacttcaaagacgtgttcatgccagtcattcacccaaaataaatttcaattcaatgaaaagtaaataacttagggatctataaatgacactgcaatgtatcttgttccatttttaacaggaagtccttcatgcaaatgtgtgagtctcccaggatgcatgaagctccagccttttcgtggtgactcaatagagcaattg

SEQ ID NO: 20536 - DNA, 601 bp, Human
acatacaccctgtggtgacctggagggagctcctgcctgatgcaaagggccttcacatgctctggaaagactgtagaggaacacagcagaaggccagtcctccagaataaacatgagacatttggcaccaattaaagaaaaaaaaaaaagggcccctggtttttccttcttccagagatgatttgaagaactacctggctggttttgcaaccggtagtagataaaagggtaagaaatatggaatgaaaatggcaagtgatatgagcttcttaaaaaggaatagtttgggaagctaaagatktaaagtacagaatagattgaggggtccattattgctcttatagcaccatctctagcttaaagggttcaaggtctccataaaagatggggcaagaagtaaggataaccaagcagaaattgtggactcaacccctctccctgaagctgcttccttccctgatttcttctcccatttcttacttcactgcaaagttttgctcctgccctggattgaatcacgcctatcactgggaatgaatttccctttccccacacccttttcttttgagctttcccagctccagtcccatctaatgtctaa

SEQ ID NO: 20537 - DNA, 601 bp, Human
ccctgtgccttcacccaaactatctgatccctcgaagatccatttgggggtgggggcaggaagcacattttcctttcacgctcactaagtcctgtgaaatatcctaccgcatggaaaccactgtgctcctccgatccatgctgctgttatttgacggctacgtatttttactttattcacacagtttacattcaaagtcagaggtggatgtgaaatttgaaaggttttatttcctaactacaggcagctttaagaggctgattatctgccacgaccccccaggctgggaggcggcagcagrgcaggggagagcaaggggctttggggtcgacctcctgggggagggtagccctggggccccgctgtgccctcactcgcccttcttgtaggcgttcttgatgatggcgtttttgaacagcgtcaccaggggcgtctggctcttctcggaggtcatgaaaccgccgtagcgcttgtccttgggcgggctgccccagcggaagtgctccatcctgtaggggccctcgtccttcttctcggccgccaccagcaggctgtgctccaggtcggcctgggcccctgcgccgtcatcggcagggccgtc

SEQ ID NO: 20538 - DNA, 601 bp, Human
caaaggttggttgtggacatccacctctttggtgctctcaacagccctgccagagagatgcgttagacccagtctacagaaggggactctgaggcccagagggagtgaagccacttgtctgaatcctcacagtgagctggtggtggggagtagaaggggctcttcaggttgcctcgctgacccatcttgtcagtccctggatcagcccagcacttcctctgaggccccatctggcctcatccaggcactcttggtatacaggtcccacccgtctgtattcttttttagtccattcactaaygcacaatgagccatggtctgtgctattttgttttttgccttttctgtttccttttgtataataaatgtttacacggaattgtttttttttatccccaagggttatttatgccagtctttggctggggcctggagacacggagctgggaggagctgacaggctgatggtggagccagaaatgccaacagactgtcatccaaggggaccagggctgtgcggagctcatgggagggagcaggggtatagggagcccagggaagggagcaggggtgtgcggagctcaggggagggagcagctgc

SEQ ID NO: 20539 - DNA, 601 bp, Human
tggagccagaaatgccaacagactgtcatccaaggggaccagggctgtgcggagctcatgggagggagcaggggtatagggagcccagggaagggagcaggggtgtgcggagctcaggggagggagcagctgcctctcagtgcgaagaattgagggaggcttcttggatctgatgacttttggactggacctcgaaggaggtggcgggtgggggaaacactaagagactcgaccaggaaacaccgtaagggtaatgtggagcaggaggctgaggttggatgcgtaatgtggggatgagacyggaggccagaaaactggtaccgaggctcctgcaaggatctaggaaagaacgaatgactggtggagtgcaggggcagaaggtctgggttgccctcatatttccaagtctgcgagtaaactgagggccaagctacttgggcatctgccccaggaagccaaagcctgtcttttgcctctagaggcaaaggagatgaagagatgagggctgcactcacctaagagggcaggcggagggagagaatgctgcttttgcctctctggtgggtgaggagatggaggccagcctggaggcaaggctgtg

SEQ ID NO: 20540 - DNA, 601 bp, Human
gaggccagaaaactggtaccgaggctcctgcaaggatctaggaaagaacgaatgactggtggagtgcaggggcagaaggtctgggttgccctcatatttccaagtctgcgagtaaactgagggccaagctacttgggcatctgccccaggaagccaaagcctgtcttttgcctctagaggcaaaggagatgaagagatgagggctgcactcacctaagagggcaggcggagggagagaatgctgcttttgcctctctggtgggtgaggagatggaggccagcctggaggcaaggctgtgcygggggcgccctgaatgctcaagtacttcccctctagtctctggacttgactcagtgcccatcttctagatggggatagggcatgacctggcaaccagagctgcatgccaggcagaggagccccaggccagctgacccgggcacatggggcaagatgccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttagg

SEQ ID NO: 20541 - DNA, 601 bp, Human
aagcctgtcttttgcctctagaggcaaaggagatgaagagatgagggctgcactcacctaagagggcaggcggagggagagaatgctgcttttgcctctctggtgggtgaggagatggaggccagcctggaggcaaggctgtgccgggggcgccctgaatgctcaagtacttcccctctagtctctggacttgactcagtgcccatcttctagatggggatagggcatgacctggcaaccagagctgcatgccaggcagaggagccccaggccagctgacccgggcacatggggcaagatsccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttaggtgtggggactggggcccaggccaaaccagtcagggttccccaccttttttttttttctctctggctgccaggtccccagagactctctaaatattactctttaggggatttgggtcctgcctcttcactgggcaatcttgcagcctgacacctctg

SEQ ID NO: 20542 - DNA, 601 bp, Human
gagctgcatgccaggcagaggagccccaggccagctgacccgggcacatggggcaagatgccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttaggtgtggggactggggcccaggccaaaccagtcagggttccccaccttttttttttttctctctggctgccaggtccccagagactctctaaatattaytctttaggggatttgggtcctgcctcttcactgggcaatcttgcagcctgacacctctgcatcctggaggacttggtgttccctggctgtgcctgtcccctagtcacgctcagtcctggacctggagccctgacttttgggctagggggtgttccttgcccaaacccttggaaaggtcctggaaccaggcagttctggacagtcctcatctgtggggatggggactagcagcttggcctttgggctgcgtgtgtctggtatgcagcgtggtgtgctgatcatctctgcctccgcgtgtct

SEQ ID NO: 20543 - DNA, 601 bp, Human
cccgggcacatggggcaagatgccagctgtgccaaggctgcccgggtgcctgcacctgctctcgccagcaccagttgggtctgtgggccgggagagggcttccccaccagcaggctcttccagctgctgggcccagttgtctggatctggtgcggtggtgcttaggtgtggggactggggcccaggccaaaccagtcagggttccccaccttttttttttttctctctggctgccaggtccccagagactctctaaatattactctttaggggatttgggtcctgcctcttcactgggcartcttgcagcctgacacctctgcatcctggaggacttggtgttccctggctgtgcctgtcccctagtcacgctcagtcctggacctggagccctgacttttgggctagggggtgttccttgcccaaacccttggaaaggtcctggaaccaggcagttctggacagtcctcatctgtggggatggggactagcagcttggcctttgggctgcgtgtgtctggtatgcagcgtggtgtgctgatcatctctgcctccgcgtgtcttggggactcagtgagagcaaatgggaaggttctctgct

SEQ ID NO: 20544 - DNA, 601 bp, Human
ctctacccagagtagagggcctggacgtcgaaaggaaggcctcctttagcccgcctgctaaacccccttcatgggatatacagaaaaatgaggctccagaggtgggagggactcacccaagaatgcacagccagtaagagcagccactctctaatacagctctcccaagcaactacttggtgcctggccctgtgctgagtatgggggactcaaagtgaattagacttggtacctgcatctccttggttttctttcttgatgaacaggggtgtcctccactgagcatagaactgagttggcrtgaaaacatgcaggattgaagttagaccgaaggaaggccttcctgtacgaatacttcctaaagatctggttgtggcaggagatggtgatccccctggggtcctggtttcattcgttctggattttcaaggttcactttgaaggaatgtgacaaatccaactcaactgggtcatcctcagtctgcatcaaagcgactctccctttccatcccttccccaaatccagtcctgggtacctccaggagtaggaggaggagggagattaagtcttggctccgcaacttcaaagcagtggggtctg

SEQ ID NO: 20545 - DNA, 601 bp, Human
tgttctgtttccttggccaagttatcacctgtccctgaacctcagtttccttcactgaacagggtggtgggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcktctggatcctagagcccagaccccaccctgatgtgggccaagtctgattccatcaggaatgggggctgaggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctct

SEQ ID NO: 20546 - DNA, 601 bp, Human
gggggtgatggtggatcctactgaacctgaggagtctgtaactttgctgctaaagaatcactgaggcagatttagcaagggggtggtggtctgagggatctgggttagatgccaagagggatttccttatagagtttctccaggaggcagcagggcggatgccagagctccatgcaccctcccaggagattttctagccctatctctcctattcccttggtctgtgaccttcttctggatcctagagcccagaccccaccctgatgtgggccaagtctgattccatcaggaatgggggctraggcagctgagaccttggagtccccctcctcctgcacacccaccctctgtccccagggttctggaaaacttctttccttagacttggctgctgaggctgtgggggtggagtggaagtgaagggatgggcatttggtctggtgagacttgtggggtgataggtctggctttccctttttctggcttcaatttccccatctgcaatgtggacattatgatacctgctcttctctaccttctgcagaaatggaggaatggtgagggatctcgttttcctagtgttcatggggtggtggtctgg

SEQ ID NO: 20547 - DNA, 601 bp, Human
cccagcactttgggaggttggggtgggtggattgcttgagctcaggagttcaagtccaacctggatgacatggtgagacaccttgtctacaaaagaatacaaaagttagctgggtgaagttgtgtgtgcctgtagtcccagctactcaggaggctaaggtgggtggatcaattgagcccaggaggtcgaggctgtagtgagccataattgcggcactgcactctggcctgggcaatagagtgagaccctgtctcaaaaataaataaataaataaataaataaataaataaataaataaattggttggcaaactacagcctgcaggccaaattcggcccacctctccatttttgtaaataaagttttattggaacacagccacacacatttgtttatgtgtcatctgtgactgctttcccgctacaatagcaaaaactgaatagatgtgacatgtctgtatggtctgcaaagcctaaaatgtttactatctggctttttccagaaaaagcttgctgacctatgatttaaaaaattctacccactggttctctgccatgcttacattatctctcgcagtcctcagattcactgtatcaaatgg

SEQ ID NO: 20548 - DNA, 601 bp, Human
taaagttttattggaacacagccacacacatttgtttatgtgtcatctgtgactgctttcccgctacaatagcaaaaactgaatagatgtgacatgtctgtatggtctgcaaagcctaaaatgtttactatctggctttttccagaaaaagcttgctgacctatgatttaaaaaattctacccactggttctctgccatgcttacattatctctcgcagtcctcagattcactgtatcaaatgggtatcatttgcccctttttaaagatggagaaattgacacccagagagatgagatgayttatctgtattcacacagctagcaaatagcatagtcagttgcaaacacaggctaccttgactcagggcaagggagttcatgtttgtttttttctgtttctttatttctttttggtgaaatgtttcattatggaaaaattgcaaagatacacaaaagttgagagaaaagcagaatgaactatgtacccatctttcagtttcaacatttacccacagtttcttcatcttatttcatttctcccctctcatatttttataaagtattttaaatcaaattctaaaaatcatgccacttaaaatt

SEQ ID NO: 20549 - DNA, 601 bp, Human
caaatgggtatcatttgcccctttttaaagatggagaaattgacacccagagagatgagatgatttatctgtattcacacagctagcaaatagcatagtcagttgcaaacacaggctaccttgactcagggcaagggagttcatgtttgtttttttctgtttctttatttctttttggtgaaatgtttcattatggaaaaattgcaaagatacacaaaagttgagagaaaagcagaatgaactatgtacccatctttcagtttcaacatttacccacagtttcttcatcttatttcatttstcccctctcatatttttataaagtattttaaatcaaattctaaaaatcatgccacttaaaattctaaaaatcatgccacttcacccataaatacttctagggtcttttggtagagagtgggttacttggtggtggtggggaggtggtcctgaggaggccactctgggcttcctgcttgggccagtttgcctggtgagcccagatgtccccagggcagcaagatccagataggagaagctactgctgtttcctaccccccaaccagggaagaagcagttgccagatgcccagctcctggcc

SEQ ID NO: 20550 - DNA, 601 bp, Human
cgctctgggctgaattgtggctcttttaaagttcgtatgttgaaatcctaaccgccagaaccttagtatgtgactgcatttggagacaaggtctttaaagaggtaattaagtttaattgaggtcattaggctgggccctaatccagtgtgacttataagaagaagagattaggtcacacacacagagggaaggccacatgaagatgtagggagaagaaagccatctacaagccaaggaaagaggcctcaggagataccaaccctgctgacaccttgatcttgaacctctggtctccagacrgaggaaataatttctattgtttgagccactcattctgtggtacattgtcatggcagccctagcaaacaaacacattctctttccctggaattcccagccaacgccttcctcaatctccccttctccacattcggaagctcccatctgcttcatcgcagtctctggctcccctgttgcctcacagtcctctgcttctctctaatccttgtccctaaaccctgtcatgaagctgtggcacacatggatttccatttccttctggtaatttgactgaaattagcatttgctgccccggtgggc

SEQ ID NO: 20551 - DNA, 601 bp, Human
gtgctgggattataggcgactctcaggatattaagaagagtgagtgatgataagacagggcttcccctgataaccattgtccatggctaccctctcaggggttcccatgtgaccaatactgagataacagctttgcatagtttatcccatttaaattgaccacagccatatcaggtagatgctcttcccttccccatttttacatatgcgggaactcaaacttagcttgaatagctgcccaaggtccctatattagtttcctcaggctgctgcaacaaagtaccacaaactgggaagctcrgagcaacagatggaggctagaagtctgaattcaaggtgtcagcagtgccatgttctctctcaaggctctatgcctccttggcatctggtggtggccgacagtccctggcattcctcagcttgcagaggcatcgctctagtctctgcctttatcatcctgtggtgctctccctgaacttgtctttcctcattttataaagacaccagttattggattggagcccaccctaatccagtaggatctcatcttaacttgattacttttgcaaagacttcatttccaaataaggatgcattcacg

SEQ ID NO: 20552 - DNA, 601 bp, Human
aagacttcatttccaaataaggatgcattcacggatgcagagagttagggcttcaacacatatttaatattttagggaacacaattcaaccctcaacagccccacagcttgtaaagctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacartcttgctctcttgcctgggctggagtgcagtggtgtgattttggctcactgtaacctctatctcctgggttcaagtgattcacctgcctcagtctcccaaatagctgggattactggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatg

SEQ ID NO: 20553 - DNA, 601 bp, Human
agttagggcttcaacacatatttaatattttagggaacacaattcaaccctcaacagccccacagcttgtaaagctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacaatcttgctctcttgcctgggctggagtgcagtggtgtgatttyggctcactgtaacctctatctcctgggttcaagtgattcacctgcctcagtctcccaaatagctgggattactggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatgcgccttaactgttagtaatcagaatctttttctgcagctttt

SEQ ID NO: 20554 - DNA, 601 bp, Human
caacagccccacagcttgtaaagctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacaatcttgctctcttgcctgggctggagtgcagtggtgtgattttggctcactgtaacctctatctcctgggttcaagtgattcacctgcctcagyctcccaaatagctgggattactggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatgcgccttaactgttagtaatcagaatctttttctgcagcttttttatcttgccaggttacctgggctttgagttctattttccctcccttcaca

SEQ ID NO: 20555 - DNA, 601 bp, Human
gctgtaattggcaccatcctctgcttgctttgctcatattatttcatccaaccatgcctttcttttttgcccaattatagttgttgatcaaaatgactatctcttaagcatgaacgttattatttcatcctaagcaccagagctttcttttctttccttttttttttttttttttttgagatacaatcttgctctcttgcctgggctggagtgcagtggtgtgattttggctcactgtaacctctatctcctgggttcaagtgattcacctgcctcagtctcccaaatagctgggattacwggcacctgccaccacgcccagctaatttttgtatttttagtagagacgagtctttgccatgttggccaggctggtcttgaactcctggcctcaagtgatccacccgcctcggcctcctaaggtgctgggattacaggcacaagccactgtgcctggtcagcaccagagctttctttagactaatgcgccttaactgttagtaatcagaatctttttctgcagcttttttatcttgccaggttacctgggctttgagttctattttccctcccttcacagggggttacactacctcttggt

SEQ ID NO: 20556 - DNA, 601 bp, Human
atgtgtgtgtatatatatactatatatatacatatatatatatacatatatatatatacatatatatatacatatatatatacatatatatatatatatacatatatatatatatatttcccccaatatcctcagatgttgggcagccaagtttccagcccttgtcacatacaatggggagccactgaagcaggtgtgacatggcccatgagagttcccagtggaggatggatttgaggaactgggcagggaagcagggaagctccatatttgtctccccttggccacatgaacatgtggrtattgcagagtggagcagattctgtgcatgagctccttgtgatcctggaacagcatcttattctttactctcccatgacaaatggtccccgggggcagaaggaacactgccactgaatttctgtgtgagctcggacatgttacatctttgagctctagtagtaaaagggcttggcccaggctaaggtcttgaaatctgtctgtgaaggaagccagatggggagcattctcccttctgtgatgatcaggtaattagggcccagagttgctcaaggttataggctgtttggtggcagatcta

SEQ ID NO: 20557 - DNA, 601 bp, Human
ctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggargtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatcctt

SEQ ID NO: 20558 - DNA, 601 bp, Human
aggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtg

SEQ ID NO: 20559 - DNA, 601 bp, Human
ttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaaggtgtgtgggagcttttactacacctttatcttcagtaaagagacagagaacacagttccatttttaatgtttaaatttcatttcaaaaagcaggtctgtagtttgtaaccatgacaattaaaatctgtgctaatgcacggcagtctataacaat

SEQ ID NO: 20560 - DNA, 601 bp, Human
cagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcckggcaaagaataaaatatatttattttaaaggtgtgtgggagcttttactacacctttatcttcagtaaagagacagagaacacagttccatttttaatgtttaaatttcatttcaaaaagcaggtctgtagtttgtaaccatgacaattaaaatctgtgctaatgcacggcagtctataacaattctacaagccaatcagacagtacgtgacatttcaatgagtaaaaaagagcataaaactgtatgtgtaagaacaaaatgttaaaaggcctaccacaataataaaaaaccgtcaatta

SEQ ID NO: 20561 - DNA, 601 bp, Human
agtacaaagcatcgcgagtctttagtgctctttggcgctataagcccgtgggaacgagcattggagacccttttcacaagatggcgccgaaagcgaagaaggaaggtgtgtgttggtgatggggccgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagt

SEQ ID NO: 20562 - DNA, 601 bp, Human
taatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctcccaggcttgaccactatgctatcatcaagtttccgctgaccactgagtctgccatgaagaagatagaagacamcaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctga

SEQ ID NO: 20563 - DNA, 601 bp, Human
cccaggccaggtgaccccattttgcctctcccaggcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttargtagtcctggtaatgcaggactacacgtgtagtccgagctatgcaggaggatctcttgaggccaggaatcacccatgattgccccattgtactccagcctgagcaaccaagcaaggccctttttaaaaaaaaaaaaaaaaaaaatcccctggacctttcagcaggggaaaaaggttccttgacttaaacttggtgtaggtttagcagtgtgtgtgagccttgaggcaggaattacaggctgctttagttacagacctttgtgtggacctgaggctttctaggacttgattgggggttggt

SEQ ID NO: 20564 - DNA, 601 bp, Human
tgcccatcagcaccacagccttcccgcgaagggacatgcggatctgctgcatctgcttggagcccacattgtctgctcccacaatgaaacatttcggataatcatccaatagttgctacaaaaaacaagccagaggagccaagtttaacaggaagagagagggaaaaaatgccagaagaaactgaaccccacaatttgtttccatcccactccctttcttctaagcttttgaagtcagagggagattgggagctacgttgtaacactgccaaactggatgattggctagctgggtatgaaygctgaaaattaggtttctacattcaatcaaggagttttttctttttttacttagtttttaatttttcccaattaccaggcatgcttctgattcactaaaatggttaacaggataaaaaaggaatgttccaagtaagttggtcaagaggagggctagattcacagcattaaaagcaccacgttaagcaaatatagcaacattattatttgtaaaaacaatctaggcgtgtttatccggattgttacacaattcctttgggttttgtgtctgaaaaccttctaagtgtgggaaaatgtaata

SEQ ID NO: 20565 - DNA, 601 bp, Human
agccaacccaattgtccccttaccttattggccagcaacatgtccctgatctcagtgaggtcctccttggtgaacacaaagcccacattcccccggatatgaggcagcagtctgcaaagagaagtttatgggagacaatcacctttcagcaccattctccaggaagagggagacgggcactggggagaaaggacaaaactgccaggggaactgacttctccagagctgggttgttttccaggtgccctcggatggccttgcgcatcatggtgttcttgcccatcagcaccacagccttccygcgaagggacatgcggatctgctgcatctgcttggagcccacattgtctgctcccacaatgaaacatttcggataatcatccaatagttgctacaaaaaacaagccagaggagccaagtttaacaggaagagagagggaaaaaatgccagaagaaactgaaccccacaatttgtttccatcccactccctttcttctaagcttttgaagtcagagggagattgggagctacgttgtaacactgccaaactggatgattggctagctgggtatgaacgctgaaaattaggtttctacattc

SEQ ID NO: 20566 - DNA, 601 bp, Human
ttgcgtctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcmgcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtctttgttagaaaagtaaaaatgctgaagaagcccaagtttgaattgggaaagctcatggagcttcatggtgaaggcagtagttctggaaaagccactggggacgagacaggtgctaaagttgaacgagctgatggatatga

SEQ ID NO: 20567 - DNA, 601 bp, Human
atttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgayccgagaggtgcagacaaatgacttgaaagaagtggtcaataaattgattccagacagcattggaaaagacatagaaaaggcttgccaatctatttatcctctccatgatgtctttgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggca

SEQ ID NO: 20568 - DNA, 601 bp, Human
ttccatggtcaaaaaatggcagacaatgattgaagctcacgttgatgtcaagactaccgatggttacttgcttcgtctgttctgtgttggttttactaaaaaacgcaaaaatcagatacggaagacctcttatgctcagcaccaacaggtccgccaaatccggaagaagatgatggaaatcatgatccgagaggtgcagacaaatgacttgaaagaagtggtcaataaattgattccagacagcattggaaaagacatagaaaaggcttgccaatctatttatcctctccatgatgtcttygttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaacgtgctatttgtaaaaaaaaaaaaaaaaaaaaatcccagcatttcggcataagaattctccctgtttagttttgtctaatttataaaacagaagcgaataaaagtttg

SEQ ID NO: 20569 - DNA, 601 bp, Human
atgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgtaagtgtttctttgcttcctcacacaacacaaccttgagtattggattattcctgagatgagagaacgcatatgagacaaggtaaaggtctgtkgaaatcctgtctgtgaatccttctagctatatctctttaagtgaaagagtgttaagtactcagtaaatatgattattattactattattatttgagtcagagtcttgctctgttgcccaggctcgagtgcagtattgtgatcctccttggctcactgtaaccactgcttcctgggttcaagcagttcttgagcctcagcctcctgagtatctgggaatacaggggactgccaccatacccagctaatttttttaaatttttagtagagatggggtttcatcatgttggccaggctggtct

SEQ ID NO: 20570 - DNA, 601 bp, Human
gtcctgggcttttttttttttttttttaagtacaatttccattttatttttctccagagaatagcctgtcttcagtctttaagaactcagctccttacatgggctttggtgggggacgtggggcagcacccgcaggtctaaatcgaggtgggggtgttcggtccttgcgggcttcacgagatcgattcctgactactttgctgtgaattgcacaactcacacagtaatgtagcttcacatacagcttgggaagcacataggcatcgaagacgctcgcttcagaaatgtccctgactgctgyggcctccactatgtttcgaatgacgaatttcttaatggcgttgtccttgggcacgcatcgggcacagttagtgcagcgaataggctgcacgtggccgcggccctttttggcacgaccattgttccttcttttctttgtcatcttggaggcacggaccggagagagagtgggcttttcttttgggggagatttttgactgctgcttcagtctctttactagttgtaggtctgttcagtctcagtaggttgtgtctttctaggaatttgtccatttcatctaggttagacaatttgttggca

SEQ ID NO: 20571 - DNA, 601 bp, Human
tttaagaactcagctccttacatgggctttggtgggggacgtggggcagcacccgcaggtctaaatcgaggtgggggtgttcggtccttgcgggcttcacgagatcgattcctgactactttgctgtgaattgcacaactcacacagtaatgtagcttcacatacagcttgggaagcacataggcatcgaagacgctcgcttcagaaatgtccctgactgctgcggcctccactatgtttcgaatgacgaatttcttaatggcgttgtccttgggcacgcatcgggcacagttagtgcagygaataggctgcacgtggccgcggccctttttggcacgaccattgttccttcttttctttgtcatcttggaggcacggaccggagagagagtgggcttttcttttgggggagatttttgactgctgcttcagtctctttactagttgtaggtctgttcagtctcagtaggttgtgtctttctaggaatttgtccatttcatctaggttagacaatttgttggcataattgttcataatattctcttggcctttttatttctgcaagatgtgttgttctgtaggacgtgatgttttctcgtc

SEQ ID NO: 20572 - DNA, 601 bp, Human
caggtgaggagacggcttgctgtagtggggaaagcactggacctcaacagttggaaaatgttgtagtgttagctgtctcgtatccttgaagctgtgcagcagcttcagtttcttcgcctgtggaaaatattttccctgatactcttaaaatttgaatgtatgagactggcaaagttttgcatcttaggaggagtgattcatttcaccgtgatctctcatcacatttcacatacaacccctacgtttttttgtgttgggaaacaatgtaatggatgatgagttgggcataagtgcaggaaaaacgggtgtaatagaggaaaaaaatgttatctgcttttctttcaggatgctataaaatcaccacggtctttagccatgcacaaacggtagttttgtgtgttggctgctccactgtcctctgccagcctacaggaggaaaagcaaggcttacagaaggtaaatggtttactaatgtgatttggggctttgagtttgatttttagaaatggaaacatttcttaggatttttcggtcttaacagtgacagggatcatctataatgtaaatttttagacaagaagtgttggatttggttgtttta

SEQ ID NO: 20573 - DNA, 601 bp, Human
aattcagtaaagctgtggcatacaatatgaacacataaaaatcggtagcatttctatatgccaagaatgaagaatctgaaaaaaatttaaaaagtaatcctgtttacaatagtcacaaatacaattatgtatctagcaattaacttaaccaaagaagtgaaagagctctataatgaaaactataaaagactgagaaaggcttttccggcagtgacgacctacccacacgagaacatgcctctcgcaaaggatctccttcatccctctccagaagaggagaagaggaaacacaagaagaaasgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggattaaaaaaaaaaagactgagaaagaaattgaagaggacaccaaaaatatggaagaatat

SEQ ID NO: 20574 - DNA, 601 bp, Human
cgagttcctttcccttcatgggaagagatgctgaatcagagaagggtggctgagacatcttctgacaagatggggactgggaagagtcaggaactcgtattctttctcaacagttctttttcattagacttgccaagtgcccgctttgtgcccagccctttgcttggctttgtgagattgtaggaggagacagtccctgccttgggaacaggcttcatcgggttggaaaaacaagagcaacatacttttaacaaccgcatgagatacgtatgaacaagttttgagttgaacctacttgccyttgttaaagcaatacaatgatttcaaaattgtaggcacttagtaaatactggttaatcgactggttgtttctattttgtcctctaggctgtgaacatttcaaagatggagacttgtttgagacagagtcttgctctgtcacccaggatggaatgcagtggtgtaatcatagcttactgtaaccttgaagtcctgggctcaagcgatgctcttgcctcagcctctcaagtagctgggactataggcatgcaccaccatgagtggctaatttttaaaaatttctggtagtaaaggagtcttg

SEQ ID NO: 20575 - DNA, 601 bp, Human
ccatgagtggctaatttttaaaaatttctggtagtaaaggagtcttgctgtgtttcccagtctggccttgaattcctggcctcaaaccatcctcccttccttggcttcccaaagtgctgggaatacaagcaagatggagacttttctgttcacgtttagcacaggacctgacatgaacagattcttaaagaatgaatgaaaatagttgtatcaaaatgtaggacacgatgaatgctgtgaataagcaggtagttgatttggtttaactacagccaatgtccagattggtttaactacagasaagagttggaaaggtggacagtagtggcctttcttgtttttggtatcttgagaacatcattctgtgaattttcctagctcacattttagctgaccaaagagcaaaataacatagtgcacttttattgatccattcataagagtgagagctgagcatctatttttgtatttttatttttttacattattatttatttgtatttttttagagaaggagtctcgctatgttgcccaggcttgtcttgaactcctgggctcaagcattcttcccacttcagcctcccaaagtgcttggattaca

SEQ ID NO: 20576 - DNA, 601 bp, Human
acagttgaagagatctggggccaaactaagaaaggctttgcttgagagaagaggataatgtaggcagtgagaagcagggattagtgatgtgataaaatcaacatctggcttgaaaaactaaccaagtggaatgacagaatagagaactgtgtgtcattggacctttagatctttagtctgcctcctattttcaagtgtgagttaagataattaccaatgcacttttttttttttgtcagtttcctgattgacttcagaacttctggcagttgtagaattttctttttgctaagttgctttcccccccccactgcatgtataattgcagaacgctaatgttgctttgcagttacctgcctgcttagttatccaattgctagagcactgaggtttcagtcccagtgccagccagttaatttaccccatttcagagttaaatgctgcagatgtgagcctgatgagaaaattatcacaatggtgatcagaaagagaggggctaacatatcagtgtagaagaaaaagcaacttgttctagtgataatgggttaatagtgatgtcttattgttcatttattcttcatcaaatgtttgagaacttgcc

SEQ ID NO: 20577 - DNA, 601 bp, Human
gttggaggtgaaattgggaagtgggtgcacaggacaagtggtataggattctgtggatttttttttttttttagttggagtttcattcttgttgtccaggctggaatgcaatggcgtgatctcagctcactgcaacctccgcctcctgggttcaaacaattctcctgccttagcctcccgaatagctgggattataggcccctgccaccatgcccagctaattttttgtatttttagtagagacggggtttcaccatattgatcaggctgatctcgaactcctgacctccagtgatccacmcccccaccccgctcccttggcctcccaaagtgctgggattacaggtgtgagccactaggcctggcctgtggattgttataacaattttgacttttattctggagatcataagccactattaggagttttgaaggaggtaatgatatgattctgagtttaacttttaaagggtaattttggctgccatgtgggatgggggaaaaatttaggaaattatccgtaaacgtctgtctgtatagaattcatactctttgaaggtgacatcagagaagacaatctcttcatgaatcttttgagggg

SEQ ID NO: 20578 - DNA, 601 bp, Human
ttcattcttgttgtccaggctggaatgcaatggcgtgatctcagctcactgcaacctccgcctcctgggttcaaacaattctcctgccttagcctcccgaatagctgggattataggcccctgccaccatgcccagctaattttttgtatttttagtagagacggggtttcaccatattgatcaggctgatctcgaactcctgacctccagtgatccacccccccaccccgctcccttggcctcccaaagtgctgggattacaggtgtgagccactaggcctggcctgtggattgttatamcaattttgacttttattctggagatcataagccactattaggagttttgaaggaggtaatgatatgattctgagtttaacttttaaagggtaattttggctgccatgtgggatgggggaaaaatttaggaaattatccgtaaacgtctgtctgtatagaattcatactctttgaaggtgacatcagagaagacaatctcttcatgaatcttttgagggggcctcaatcttttctgtgaaatagcacttcatgttggtcaatttacatgttaattacatttgattctttgacattgtagtc

SEQ ID NO: 20579 - DNA, 601 bp, Human
ggtgacatcagagaagacaatctcttcatgaatcttttgagggggcctcaatcttttctgtgaaatagcacttcatgttggtcaatttacatgttaattacatttgattctttgacattgtagtcttaataattgctaacatgaatttaataattgctaacatgatttgattctttagatggccgccaagaacgagtcatgtttgacaaaattacatctcgaatccagaagctttgttatggactcaatatggattttgttgatcctgtaagtaaatatggtttttatcttgggttccttstttcatgtgtttctttccatttgtctcttatccctggaccttcattcacctgatatactttggtattctggctatgcccttcgatataaaatttgaattcattgcttaaaacatttttttttccttaattttggttctgtcctgtgagttctcacttttcagagaactatgaatgtgagtaaagaggaaaatttgatattaacatttaatatcagatatttccttgagtaaattgttttattcattagtggaaaagcctaggccaggcgccgtggctcacgcctgtaatcccagcacttt

SEQ ID NO: 20580 - DNA, 601 bp, Human
tctattgcctcatgcagtagtacattttagagcgcaagaatgttgcagcatcctcaaacttcctagggtagattctgttgaaaaactgtcggtgcacatctgtaatcccagcactttgggagactgaggtaggcagattgcttgggctcaggagtttgagaccagcctgggcaacatggtgaaactgcccaggtgcagtggctcaatcttggcccactgcagcctccacccctggggatcaaatgattcttgtgcctcagcctccctcagctgggattacaggcatgtgccaccacgctatttttttttttttttttttgtatttttagtagagacagggttttgctatgttggccaggctcgtcttgaactcctgacctcaagttatctgtccgccttggcctcccaaagtgctgggattacaggtgtgagccacactgtgcctgccctcaaccctgtttctacaaaaaaaaaaaaaaaaaaaattggttgggtgtggtggcgcataccagtagtcccagctacttggtggtgggaggatcgcttgagccctggaggttgaggttgctgtgagctgagattgtgccactgtactccagca

SEQ ID NO: 20581 - DNA, 601 bp, Human
tacattttagagcgcaagaatgttgcagcatcctcaaacttcctagggtagattctgttgaaaaactgtcggtgcacatctgtaatcccagcactttgggagactgaggtaggcagattgcttgggctcaggagtttgagaccagcctgggcaacatggtgaaactgcccaggtgcagtggctcaatcttggcccactgcagcctccacccctggggatcaaatgattcttgtgcctcagcctccctcagctgggattacaggcatgtgccaccacgctatttttttttttttttttttgkatttttagtagagacagggttttgctatgttggccaggctcgtcttgaactcctgacctcaagttatctgtccgccttggcctcccaaagtgctgggattacaggtgtgagccacactgtgcctgccctcaaccctgtttctacaaaaaaaaaaaaaaaaaaaattggttgggtgtggtggcgcataccagtagtcccagctacttggtggtgggaggatcgcttgagccctggaggttgaggttgctgtgagctgagattgtgccactgtactccagcacaggccacagaatgagaccc

SEQ ID NO: 20582 - DNA, 601 bp, Human
cattgaggtgggttgagatgacaaaaagggttgagaaccactgttttcaactattacctaaagattgaattagctgttaagtggtcttgatatattttcattttttgttgtattttttagatgtgatggaagacctctataactacataaatccacataatggcaaacactctcccatggtggccaagtcaacattggatattgttctggccaataaagatgtatgtataacacttatctggtggaaattttttgagagtcttttttaataatgcacacattttagaaaatttaaacactrcaaaagatacaggtaaatactaattctgtttcctaccctgattcctgattttcctctctagaaacaactttatcattttaaaatgtatttttccagagctattttgtacatacgtgtgtgcatacatgtgtatgtgtgtacatacatatttttcttctcagtggtactgtactgtgcatacagttttcattgatactttcttcacttgtaagtatatcttgtttgttctatatcagcctttatgaatttacccttttttataacagttgtataacgttccattttgtagatatattgtca

SEQ ID NO: 20583 - DNA, 601 bp, Human
acacattttagaaaatttaaacactacaaaagatacaggtaaatactaattctgtttcctaccctgattcctgattttcctctctagaaacaactttatcattttaaaatgtatttttccagagctattttgtacatacgtgtgtgcatacatgtgtatgtgtgtacatacatatttttcttctcagtggtactgtactgtgcatacagttttcattgatactttcttcacttgtaagtatatcttgtttgttctatatcagcctttatgaatttacccttttttataacagttgtataaygttccattttgtagatatattgtcattgtatgtatgtgtaagaattcctttagtgatcaatatttgtttttcatcttttcactgcagtgaatattcttgtatggtaggtgttttgctcatagatgaatatatctgtaagataaatcccttcagtagaattgctgagccaatgtgtatatgaattcaaaattttgataggcattgccaaactgactcccaaaaaggttgctcaggtaaaattttacaagctcatgctcagcaacttaaaaattatccacttgtgtttgaacctgtttctta

SEQ ID NO: 20584 - DNA, 601 bp, Human
tagctcacgcctgtaatcccagcactttgagaggctgaggcgggtggatcacggggtcaggagatccagaccatcctggctaacacggtgaaaccccgtctctactaaaaatacaaaaaattagccaggtgtgggagctggtgcctgtagtcccagctactcaggaggctgaggctagagaatggcgtgaacccgggaggcggagcttgcagtgagccgagattgggccactgcactccagcctgggcaacagagtgagactcagtctcaaaaaaaaaaaaaaaaaaaaagaatgattaaytgactatctctctaaacatgtatctgatgttaaagagactaggagaaaactgagttgtttgtgtgttgttaatttgtgtaatctcgaagacaagttgaagacaaaaatacagcagcagcaacagcaaaacctgtgtctaaaaatatacctattgatagtcaagtatttcagttctctaatattcacactgggcccatacctgcctttggcaacaaagatgaccttaaaattttaagagaaaaggaaagcaagctttcgtataggtttttctagtccttagatatggatcattatgtagaa

SEQ ID NO: 20585 - DNA, 601 bp, Human
gaatgactttgtagcctacaaaaactctgtaacaaggaccagttatgctctaaaatcttactgttacaatagttctttgttggaaacttgttaaaggactatagattttgaagagcctcagaattaacataagcctgcttcctgtcattgtttattatatatactgttatatacagtttgaagtaggctagcttttaaaataaatatatatatatattagtaaatatgtggtaccaatacttttggattaatagccaatctaaaaacatgtttaaggatgataatatagtcccatttatgstcatgttttttccctctttcaaaacatactataaacataatagtaaaagtttggaaaatcacatttaatctcacaacatatatttatgtattatcttctagtgttttcatatacatgtttttaaacctaattaggatacttaatttatatgtattgtttcttttttttagaatgttagatggacttctattctacagtaataatgcttagtgttatctcattgtatcctgtgttgattttagttctggagtcagggccgagagataagagattttgtgaaaataagtaattattttaatt

SEQ ID NO: 20586 - DNA, 601 bp, Human
ggcttattttagcagtaataagagcagttatcattgattgattgcttactgtatgttaagtttgttataaatgttttacatgaggtactcatttgacccttactacaacgctatgaggtaactatgattatagactcatgccaggaattttattccttaaaataaccttgtgaataaaggtaccattgtctaattttacaagtgaggaaattgagacttagaaagttgttactttctgagatcaatcacttaatatgtggtagagccaggattcaagatttatgcattgacactttatgaygtaaactttagccctttgttagtttactgttcaatgggagtcaagataatagttttggatttaaatcctagctccactacttaactagtaatgtggcctagagttagttattttgtgtctgagtttgtttccttttctgtaaggtgaagaaaatatctaactctgtagaataaagttccagaaggaaattattccattatgttgtgttttggaggtgctgtgatatatacagcactttacacagtggtagagtgagctattgctcacttatctttctagactgtttaaaggcttgtgttg

SEQ ID NO: 20587 - DNA, 601 bp, Human
tgttacatctcattataaattagaaatgccatgaggtaacttagtacataattgtaatttattcaacattttgttgattttatttgggcatttttccaaagcagaagtagagatggagagcaggtaaaacttcatagattgctacctagaaattaggcatcttttttgataaaagaatggggccatttttttcttttctttgctgagtgccctctgtcatttctatcatggtctctcttttagactaatggcaattccaatggccttgtaccgatgctgagagtatataacaacacagctmgatatgtggatcaaggtgggaacaaggtatgctccatgaattgaaagtactggaaatcagaactaaaggtgatttagtcatatacacttaagatggttcatttatgtgtagtttctaattaccttttttttacttgtaaaatcaatttgaggaggtataattattttaatatgcatatactttaaatgtacagtttgatgggttttgacaaatgtatacacttgtgtaatcaccacattgataaagaggtagaacatttccattaccccaaaatcttttctccctcatatacctttacat

SEQ ID NO: 20588 - DNA, 601 bp, Human
attttttgtagaggcgggggtctcactttcttgcctaggctgatctcaaactcctaggctcaagcaatctacctgccttggcctcccaaagtgttgggattatgggtgttagccactgcacctcgcctaggttgttcttaaaacaaaaacaaaaactacctggaataacaaaactctccctaattggctggatgcagtggctcctgccagtaatcccagcactttgggaggctgaggtgggctgatcgtgtaagctcacaagttcaagaccacgagttcaagctcacgagttcaacatgaygcaaccccatctccacaaaaaatacaaaaattaaccgggtgtggtggcgaacgcctgtagtttcagcttctctggaggctgaggtgggaggatggcttgagctcggtaggcaggaggttgcagtgagccgagattataccactgcactccagcctgggcggtagagctagaacttgtctcaaacaaaacagaacaaacaaacaaaaactctccctaattgatagaagaaacagtaaagttgagagaattgggttgtttaccttattttatcaacaggatggtttacaactagagtctgcc

SEQ ID NO: 20589 - DNA, 601 bp, Human
agaagaaacagtaaagttgagagaattgggttgtttaccttattttatcaacaggatggtttacaactagagtctgccttttgtgactgtaggcacactaatcgcttgttggtttatgaatttctctctgatggactttggggaccttgataagacagatcaactttttgacctacaataagagcatggcttatactgtcaaagcaacttcctttgggctttatgtacatgtcatgtggtgtaaagagagctgggctgttgctgaagaggaggctccatctgtagttcatcatgtcacttyagaaaagttaatcttgtttcacattttgtttatatcattcgttcgtttttactcatagaattgtaaaatattacttttacaattatatatggaaaacttacacttttataatacttttatttatgttatttaattcattgtagtgaaaatcaaaggagatactataaaagtgctttgggagacatgatgtttctttgtttcatttttattctgaagagaattatgatttatttaccactagcgtcctggggcatttgctatttacctggagccttggcatttagacatctttgaattcct

SEQ ID NO: 20590 - DNA, 601 bp, Human
gatttgcttcctgactcttcaccaaaattgagttgtgtcttcttctttcttaaaactttggaatgtataaataggttcttgggatttttaattgatccttttaaaaattaagatgactagtagggttattattttgctctgtcatatagtacttttgataagctatgctttatgttgcataaaggaatcatgagtgactaggacacatatgtcagtagtttattaaaattaaataggtcaggtgcagtggctcacatctgtagtctcagcactttgggaagatgaggcaggtggatcattkgaggtcaggagttcaagaccagcctggccaacatggtgaaaccctgtctctagtaaaaatacaaaaattagctgggcgtggtggtgcacacctgtagtcccagctacttgggaggctgaggtaggagaattgcttgaacctgggaggtggaggttgcagtgagctgagattgtgccactgcactccagcctgggtgatagaacgaaactccgtctcaaaaaaaaaaaaaggaaaaaaatttagcacagtcttaagagatttggcttccttagtttttactcctttttattatgaaagata

SEQ ID NO: 20591 - DNA, 601 bp, Human
aaattaagatgactagtagggttattattttgctctgtcatatagtacttttgataagctatgctttatgttgcataaaggaatcatgagtgactaggacacatatgtcagtagtttattaaaattaaataggtcaggtgcagtggctcacatctgtagtctcagcactttgggaagatgaggcaggtggatcatttgaggtcaggagttcaagaccagcctggccaacatggtgaaaccctgtctctagtaaaaatacaaaaattagctgggcgtggtggtgcacacctgtagtcccagmtacttgggaggctgaggtaggagaattgcttgaacctgggaggtggaggttgcagtgagctgagattgtgccactgcactccagcctgggtgatagaacgaaactccgtctcaaaaaaaaaaaaaggaaaaaaatttagcacagtcttaagagatttggcttccttagtttttactcctttttattatgaaagatattattggtttagtgggattgcgatcatctgaaggcacctaaaactgcctcattttcccctatggctttagctagagtaaaataaatatcatattcctttttttc

SEQ ID NO: 20592 - DNA, 601 bp, Human
agcttataaagagagtcctttcagtgaatggtgagatcaaattctaatctcaagtctgtaaagagacttcacagaagaatcaaggctagaaatgggacatggatttggtgttttaaaaaaaagtttgagagaggagctttccatttggaaagagtggtctgtatgatacaccagagacagggctgggttttatgcagtgtggcaagtaagtctgttttgatggtgcaagtagattaattattggaatatggagagatggctatggctgggggaagggagatagaaggtagaagctgacacktcacggataggtagcccttgtaggtttctgagaggaaaatagcatcaaaatgttaagatgaaaaggaaggttcttgcttctggttacagagtgtcttgctgtgagaagggattagaggttagcctagggagattgttgtactagttggatgacaggctgctttgatcttggatgtaaactatggaaacgaggaaggagtagatcctcaattctaggaccttaaaaaaaaagacaaatgaaaagtcaggaagtaaatggaaagtgagttaaatatactgctaaggttacagtttaattcaa

SEQ ID NO: 20593 - DNA, 601 bp, Human
gtgagatcaaattctaatctcaagtctgtaaagagacttcacagaagaatcaaggctagaaatgggacatggatttggtgttttaaaaaaaagtttgagagaggagctttccatttggaaagagtggtctgtatgatacaccagagacagggctgggttttatgcagtgtggcaagtaagtctgttttgatggtgcaagtagattaattattggaatatggagagatggctatggctgggggaagggagatagaaggtagaagctgacacgtcacggataggtagcccttgtaggtttctragaggaaaatagcatcaaaatgttaagatgaaaaggaaggttcttgcttctggttacagagtgtcttgctgtgagaagggattagaggttagcctagggagattgttgtactagttggatgacaggctgctttgatcttggatgtaaactatggaaacgaggaaggagtagatcctcaattctaggaccttaaaaaaaaagacaaatgaaaagtcaggaagtaaatggaaagtgagttaaatatactgctaaggttacagtttaattcaaaatttattgtgcagtagctatatgtaaaac

SEQ ID NO: 20594 - DNA, 601 bp, Human
agggagatagaaggtagaagctgacacgtcacggataggtagcccttgtaggtttctgagaggaaaatagcatcaaaatgttaagatgaaaaggaaggttcttgcttctggttacagagtgtcttgctgtgagaagggattagaggttagcctagggagattgttgtactagttggatgacaggctgctttgatcttggatgtaaactatggaaacgaggaaggagtagatcctcaattctaggaccttaaaaaaaaagacaaatgaaaagtcaggaagtaaatggaaagtgagttaaatrtactgctaaggttacagtttaattcaaaatttattgtgcagtagctatatgtaaaacacaatgttaagtgctctgagaatataaataaatatgctgccctctggaaacttctaatttagttggaagacatcgacatatattgaggtaactattatgcaagacagattatattatagaggctagagtgacatttttaaaataaaaatcagataatgtcatttgtctgcacaaaactactctttggcttgctaacccatgcagaattccttttttttcggggggcgtcaagatttcactctg

SEQ ID NO: 20595 - DNA, 601 bp, Human
tttttaaaataaaaatcagataatgtcatttgtctgcacaaaactactctttggcttgctaacccatgcagaattccttttttttcggggggcgtcaagatttcactctgttgcccaagctgggctgtggctcactgcaacctcaacagagttctttctttttgcaaattgagctataattcactctttttaaaatgtacaattcagtgttttttttcttttcttttcttttcttttttttagtatatctgcaagtctgtgcaaccattaccactatctaattgtagtatttatttattttatttttttttttttgagacagagtcttgctctgtcaccaggctggagtgtagtggctcgatctcggctcactgcaacctccgcctcctggattcaagcgattctcctgcctcagcctcccgagtagctgggactacaggcgcgtgccaccacacccagctaatttttgtatttttagtagggacgaggtttcactatgttggccaggatggtctcaatctcttgacctcgtgatccgcccacctcagcctcccaaagtgttgggattacaggcgtgagccaccgtgaccggcctgtagta

SEQ ID NO: 20596 - DNA, 601 bp, Human
taaaataaaaatcagataatgtcatttgtctgcacaaaactactctttggcttgctaacccatgcagaattccttttttttcggggggcgtcaagatttcactctgttgcccaagctgggctgtggctcactgcaacctcaacagagttctttctttttgcaaattgagctataattcactctttttaaaatgtacaattcagtgttttttttcttttcttttcttttcttttttttagtatatctgcaagtctgtgcaaccattaccactatctaattgtagtatttatttattttattattttttttttgagacagagtcttgctctgtcaccaggctggagtgtagtggctcgatctcggctcactgcaacctccgcctcctggattcaagcgattctcctgcctcagcctcccgagtagctgggactacaggcgcgtgccaccacacccagctaatttttgtatttttagtagggacgaggtttcactatgttggccaggatggtctcaatctcttgacctcgtgatccgcccacctcagcctcccaaagtgttgggattacaggcgtgagccaccgtgaccggcctgtagtacatt

SEQ ID NO: 20597 - DNA, 601 bp, Human
atcagataatgtcatttgtctgcacaaaactactctttggcttgctaacccatgcagaattccttttttttcggggggcgtcaagatttcactctgttgcccaagctgggctgtggctcactgcaacctcaacagagttctttctttttgcaaattgagctataattcactctttttaaaatgtacaattcagtgttttttttcttttcttttcttttcttttttttagtatatctgcaagtctgtgcaaccattaccactatctaattgtagtatttatttattttatttttttttttttgagacagagtcttgctctgtcaccaggctggagtgtagtggctcgatctcggctcactgcaacctccgcctcctggattcaagcgattctcctgcctcagcctcccgagtagctgggactacaggcgcgtgccaccacacccagctaatttttgtatttttagtagggacgaggtttcactatgttggccaggatggtctcaatctcttgacctcgtgatccgcccacctcagcctcccaaagtgttgggattacaggcgtgagccaccgtgaccggcctgtagtacatttttatcactg

SEQ ID NO: 20598 - DNA, 601 bp, Human
gataaggagatttacctggattatccaggtgagccctaaatctaatgacagttgtcctgcaagaggcacagaaggggaagcaacgtgactatggaggcagaaattggagtgttacaaccacaagccttggaatgctgataaccactagaagttataagaggcaaggaacagaatctcttctagtgcctctggagggagtgtggccctcccaacatgttgattttgggcttctggtcttcagaactatgagagaataaatttttgttaagttaccaagtttttagtaatttgttgcaccagycataggaaacttaaatacctttgtcctctggagtaaaaaggatactctgttttaatctcttatttagaactagtcattgctaaaataatgtaagagggatgctgccaatgttagttttctgtgggttaaaacatggcattcgttatctcacagtttccacaggtcaggagtccagacttagcttagctgggccttcttttctgggtctgtgttcaagatgttggtaagggctgtgatctcgtctgagacacagagttctcttccaagcttacctggttgttggcagaatatatttcaagg

SEQ ID NO: 20599 - DNA, 601 bp, Human
aagttaccaagtttttagtaatttgttgcaccagccataggaaacttaaatacctttgtcctctggagtaaaaaggatactctgttttaatctcttatttagaactagtcattgctaaaataatgtaagagggatgctgccaatgttagttttctgtgggttaaaacatggcattcgttatctcacagtttccacaggtcaggagtccagacttagcttagctgggccttcttttctgggtctgtgttcaagatgttggtaagggctgtgatctcgtctgagacacagagttctcttccawgcttacctggttgttggcagaatatatttcaaggactcatggcatcttgcttctttaaggccagtgggagagaccatctctcgtttcaaaaggggcacagtctagtctcttttgagggttttcacctgataagttaggtccacataggataatgtcctcaccacccccctgtcccgcttttttttttttttttttgagacagagtctcactttgttacccaggctggagtgtgtggtgtgatcttagatcactgcaacctctgcttctcaggttgaagcagttctgctgcctcaagtctc

SEQ ID NO: 20600 - DNA, 601 bp, Human
gtttttagctaagtaaacagatcaagggacagatgaaggcactgaagaaagtaacatttttagtgttaaaaaaagagaatgtgtcagccacacccttttatgaatgttagagttttctggtttgtagatatgacatgggataatcagttttcttagcctgcttctgatcaatatgactacatggaattttgtccaggaaaatctctggagcttgtattcctcatagaggttgattagaagacagcatttgttgggatgtggggacatggcagctagtcatttgtgggttttttttttttttggtcatagttttaacttgctgtagaataaatttgagttgtgtattccttagattcttcagtatgatatgtggaatgttactcctacagacctatgggactggaaggttctcaaggagaagattgcaaagtaagtgaaaagatgtaaagtagctttgaaggcagaagggtttaggttcaccttctggatcttcagaagttagatatgtcattttaacttcttaaactcatttattacaaatggggctaaaatggcctatctcacaaaactattttgggaaaaaacttcgtaagataatata

SEQ ID NO: 20601 - DNA, 601 bp, Human
gttgcttggcacaatgaaagcatttcagtacctggtaggaattactattattagttgatcttattttagggacttaacacacctagattaggtaattttctttctcattaaggcttttttccaactatgatttttttttttaaatgtttttcattcttatttatttcccaatttagttacatcgggcatataaatggcttttgtttgaattgattgtcataggaataatggattttggaagagtttttggagggtaatgtgtttagactatatgaaaaaaaatttttaaattgagtttttrtaggcctttcaaactaataagcataagggattcgaaggcagacagaatgttttgcagagtgaataacaaagcaaattgtttttgttttctatcgtgatgactttgtcatttatgggttaatgcatatgcaaagtgattaatatttggagaatgaagcagtagctttaaaatgctctttaaaaaaaataaccgtttgccttaaaattgttaaattaaaattgttttcctactcaaataatacatgttagaaaatttaggaaaacatagatttggaaagagaaaatgaaaattatactaata

SEQ ID NO: 20602 - DNA, 601 bp, Human
gtccattgaaccttacaccagcaacatctatactcgcagagtcttgtcaggagaatttcaggtgagcagttcacaaccagccttacagggagatctttcaaaagcctgatgttgggagtaaatgctcactcatgtttaatttgcccattttcttagtttgggtgcaaactttgatagagacagtcatcttcatctctaatattattatttgttattaatatttcagcacaataggcatttaataaataatctgttgaaagaatgagtgaatgagggtcgagtatgaaagtaagttgttgayagttaaacatgatgtttaaccattatgtaatcatagtgatatattctataacttctcccagatgcttaagttaggatactcaaaatgtataaagaagtatcatttaaggcagtggttctcagacttggttaccaattagaatttatggtgggtgagaccagtggttttttctttgtttttaaggttcccaggtaattcttatgtgtagctagggttgagaacctcaatttaaaagactatttgtgaatttccagatatcttgaagtaaagttctgtaaagttcgagaaggatacgtttcc

SEQ ID NO: 20603 - DNA, 601 bp, Human
ttctcagacttggttaccaattagaatttatggtgggtgagaccagtggttttttctttgtttttaaggttcccaggtaattcttatgtgtagctagggttgagaacctcaatttaaaagactatttgtgaatttccagatatcttgaagtaaagttctgtaaagttcgagaaggatacgtttccaatttttttaacctaagtatttatagatttacccatcttaggcgctattcttttcacttttgcaaacgccatatgtttcttttttaatgaaaatattttttcagctttattaaggyataattgacaataaaaattgtgtataaatccaaggtatacagtgtaatgattagatatgtgtatatattatataacgattaccacaccacaatgtttttgttgtcgatactgtttttgagaaaatgtctcactttgtcacccaggctggagtgcagtggcatgatcttggctcactgcagcctctgcctcctgggttcaagcaattctcatgcctcagcctcctgagtagctgggattacaggcatgctgcgccaccatgcctggctaattatattgtttcttgaataacagatgtcaag

SEQ ID NO: 20604 - DNA, 601 bp, Human
gatgaagagtcctataacagttccatatttaatgacagaaactgtagcattagccagtctgtgtgttttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaawtaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaa

SEQ ID NO: 20605 - DNA, 601 bp, Human
tttaatgaaagttaaccctaggcctaagaaaacctgattttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattratatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagagg

SEQ ID NO: 20606 - DNA, 601 bp, Human
gcattggaatgattttatgttttagccacctattaaatattatcacctagaagttctttaagttcaaatccagaacgttaaaaccaacccatggtttttgtaccagaacaaggtcttgccttggattttcttgtttctgttaggtttatttccttcttaggtttgaaaccttgtagttacctgtgatgctttccttcctttactgtccgtacaattaccaagttgtgttgattgttcctttgtattatttcttaaatatcttccttccttttctgctgctgttattctaaactgaccttaytgcttctaggatctctgctcccagccattttgtgtgcattaccaccattcctcagataaaactttgcacacgtcaacccgctattcaaaaacatccattgttttctcactttataaagtgaaagccagcttacttagctagtcgttgccagctgtaaagtctggtgattttggattatgttcttattccctgataatgtattgggtatttaagtagaattataaatttgttttttaatttaacatttattgaacatctagtatgtgccaggactgaggatactgaatagaagatgatgat

SEQ ID NO: 20607 - DNA, 601 bp, Human
agaacgttaaaaccaacccatggtttttgtaccagaacaaggtcttgccttggattttcttgtttctgttaggtttatttccttcttaggtttgaaaccttgtagttacctgtgatgctttccttcctttactgtccgtacaattaccaagttgtgttgattgttcctttgtattatttcttaaatatcttccttccttttctgctgctgttattctaaactgaccttattgcttctaggatctctgctcccagccattttgtgtgcattaccaccattcctcagataaaactttgcacaygtcaacccgctattcaaaaacatccattgttttctcactttataaagtgaaagccagcttacttagctagtcgttgccagctgtaaagtctggtgattttggattatgttcttattccctgataatgtattgggtatttaagtagaattataaatttgttttttaatttaacatttattgaacatctagtatgtgccaggactgaggatactgaatagaagatgatgatctttatctttgaagtcttatagtctgttgttacacagagacacagtctagctctctaaacagttataacct

SEQ ID NO: 20608 - DNA, 601 bp, Human
ttacaggtgtgagccactgtgcctggccaggaatgtattttattttattttaatattattgttttattttattttatacttttttagacggagtctcgctctgttgcccaggctggagtgcaatgatacagtcttggctcactgcaacctcagcctcctgagtagctgaaatttataggcatgtactacccctcttgggggattacaggcatgagccacagcgcccagccaggaatgtatttttttgtttgtttgtttgttttttctttttatttatttatttatttatttttattgatcrttcttgggtgtttctcacagagggggatttggcagggtcataggacaatagtagagggagggtcagcagataaacaagtgaacaaaggtctctggttttcctatgcagaggaccctgcagccttctgcagtgtttgtgtccctgggtacttgagattagggagtggtgatgactcttaaccagcatgctgccttcaagcatctgtttaacaaagcacatcttgcaccgcccttaatccatttaaccctgagtggacacagcacatgtttcagagagcacagggttgggggtaaggtcact

SEQ ID NO: 20609 - DNA, 601 bp, Human
gcagctggccgggcggggggctgacccccccacctccttcccagatggggcggctggccgggcagaggacctcctcacttcccagtaggggcggccgggcagaggcgcccctcacctcccggacggggtggctggccgggcgggggctgacccccccacctccctcctggacggggcggctggacaggaatgtattttaaatattggtgtggaatgtctagtattctcacagagtttctcctaataattgtctttactttccttgtagggtttgaagactgggatgtattatttaaggacragaccagcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgtta

SEQ ID NO: 20610 - DNA, 601 bp, Human
gcagctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgwtaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtc

SEQ ID NO: 20611 - DNA, 601 bp, Human
cagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccatttagcactgcttttctgaagacttcagttttgttaaggagatttagttttactgctttgactggtgggtctctagaagcaaaactgagtgataactcatgagaagtactgataggacctttatctggatatggtcctataggttattctg

SEQ ID NO: 20612 - DNA, 601 bp, Human
gagaccagcatgtcttcagtagccaaactacttcttgagcatagataggtatagtgggtttgcttgaggtggtaaggctttgctggaccctgttgcaggcaaaaggagtaattgatttaaagtactgttaatgatgttaatgatttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccmtttagcactgcttttctgaagacttcagttttgttaaggagatttagttttactgctttgactggtgggtctctagaagcaaaactgagtgataactcatgagaagtactgataggacctttatctggatatggtcctataggttattctgaaataaagataaacatttctaagtgattgtatgagattaattttgtcatttactttcatataaaagtcaaatttgaaaaacacattttctgttctttgagaattcagggaggaaattatatgcctttttcttttcttttcctttctgta

SEQ ID NO: 20613 - DNA, 601 bp, Human
gggctgctggagtagtctagatacaaaggtcagctttagggtggcgcgcggtggttctcgcctgtaatcccagcactttgggaggctgaagcgggcggacaatgaggtcaggagatcgagaccatcctggctaacacggtgaaaccccgtctctactaaaaataaaaaaagtggtggcgggcgcctgtagtcccagctgcttgggaggctgagacaggagaatggcgtgaacccgggaggcggagcttgcgctccagcctgggtgacagagcaagactccgtctcaaaaagcaaaaccaarcaaaaaaaacaaaggtcagctttggggaccagaaccttgtatggagtggaagtggtgaagctgcaacctaaagtagccgttgtagactttgaagtacatgaagaggaaaagtggtaacttgaaaggactgaggaaacattgggagtaaagagatttgaacatgtttataggtggaaattgagaaaagaaggcaaagattaggggtacgatcgggggcaaatgcccagaaggggaacaggaaggtctgctggggaagcctcaaaaacaagggagaggcagacccaggtctcagagagaggg

SEQ ID NO: 20614 - DNA, 601 bp, Human
aatgggctgctggagtagtctagatacaaaggtcagctttagggtggcgcgcggtggttctcgcctgtaatcccagcactttgggaggctgaagcgggcggacaatgaggtcaggagatcgagaccatcctggctaacacggtgaaaccccgtctctactaaaaataaaaaaagtggtggcgggcgcctgtagtcccagctgcttgggaggctgagacaggagaatggcgtgaacccgggaggcggagcttgcgctccagcctgggtgacagagcaagactccgtctcaaaaagcaaaacmaagcaaaaaaaacaaaggtcagctttggggaccagaaccttgtatggagtggaagtggtgaagctgcaacctaaagtagccgttgtagactttgaagtacatgaagaggaaaagtggtaacttgaaaggactgaggaaacattgggagtaaagagatttgaacatgtttataggtggaaattgagaaaagaaggcaaagattaggggtacgatcgggggcaaatgcccagaaggggaacaggaaggtctgctggggaagcctcaaaaacaagggagaggcagacccaggtctcagagaga

SEQ ID NO: 20615 - DNA, 601 bp, Human
ttttagtagagacagggttttaccatgttggccaggctggtctcgaactgctgacctcaggtgatccacccaccttggcctcccaaagtgttgggattacaggcgtgagccaccacgcccggctctgctccctcctttttgtggctttgctgttttaataataatttggttgtatctcttattgcgaatggatctttcttgacataaattaattaggaaatcgagcgctcacaaatcctattttatatgtatctatttcctgatatgtaagttgagcatatgacataaaatatcaaagaaytgtgacaaattggatgaaatatatatagaaataaaccttataatggtacaaagagtgcgatgctgccagtatccgttgacagttgctgctgttggttttttctcaagcttaactttgatgtgttttgccactaggtggagcgatttagccaagaagttcagattacagaagcccgctgtttctatggcttccaaattgccatggaaaacatacattctgaaatgtatagtcttcttattgacacttacataaaagatcccaaagaaaggtgagtattcaagtggtatgccaagattttta

SEQ ID NO: 20616 - DNA, 601 bp, Human
gtcccggggggcgtccacgggggtgtccccgggggtctccggaaggcgccggcggaggctcccgcgctgcgcttgaaaatcgcgcgcggccccgcggccagcctgggtaggggcaaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcckccactatgctctccctccgtgtcccgctcgcgcccatcacggacccgcagcagctgcagctctcgccgctgaaggggctcagcttggtcgacaaggagaacacggtgagcccgcggggagggcgctgcgggcaggggagggaggcagggaaagcgaagccgctcctcactcacacgcgtctccccgcagccgccggccctgagcgggacccgcgtcctggccagcaagaccgcgaggaggatcttccaggagcccacggagccggtgagtggcgggcgtggggcagaggggccagggacg

SEQ ID NO: 20617 - DNA, 601 bp, Human
ctcagtaataaagagcaaaatttatataagcaaaatcagccactgtaaagagagtttagacataaccatcacaactgcttcctcaaaaagtgtctgtacaagccacatccacctagggcaggtggcaccaccccgcgtgagagagctgggcggaggatggacagggcttcatcgcgggaactagctcctgggccagcagggtaacccgggaaatcctgtccaaacggctacataaacccccctgcaacgctgagcaggagagcaggagcgtctacaccgccccagccagggcgacttctgkcatttggatccagcagcagcgtgtttcagtcgagcgcacgcacacacagacacacagacacacacagactcacaaacacacatacacactcacacacacacaggcgagcacatacacttacacacatacacactcacactcacacaggtgcgcacacacacacaacgactgaagcaggtcgcaggtggaggctctaacaggcaactttccctgcatccaagtttgcacaaaacctcacccatgagctatcacgagctatgccacgcacccggtgacaacctcaaccggcacgacccctcc

SEQ ID NO: 20618 - DNA, 601 bp, Human
tatcacttccaccttcccccacacttccagagagcaattttacaatcttctaagagcattcaataatgtcttcatgactgttcatctgtattcttttttcttttttttttcttttttaacatgaggtctcgctctgtcacccaggatggaatacagttgtgattacaactcactgcctcaacctcctaggttcaagtgatccttgcacctcagcctcctgagcagctgagactacaggtgtgcaccacagcaccggctaagttatttttgtgtgtgtttttttgttgttgttgttgttttyttgtagagacagggtctgactattgttgccaaggctggttttgaactcctggtctcaagcgatcctcctgcctcagcctcccaaagtgctgagatgacaggcatgagccaccaagcctgggcttgtattgtttatactcagtaataaagagcaaaatttatataagcaaaatcagccactgtaaagagagtttagacataaccatcacaactgcttcctcaaaaagtgtctgtacaagccacatccacctagggcaggtggcaccaccccgcgtgagagagctgggcggaggatggacag

SEQ ID NO: 20619 - DNA, 601 bp, Human
tactaacaatgcatggatatcacttccaccttcccccacacttccagagagcaattttacaatcttctaagagcattcaataatgtcttcatgactgttcatctgtattcttttttcttttttttttcttttttaacatgaggtctcgctctgtcacccaggatggaatacagttgtgattacaactcactgcctcaacctcctaggttcaagtgatccttgcacctcagcctcctgagcagctgagactacaggtgtgcaccacagcaccggctaagttatttttgtgtgtgtttttttkttgttgttgttgtttttttgtagagacagggtctgactattgttgccaaggctggttttgaactcctggtctcaagcgatcctcctgcctcagcctcccaaagtgctgagatgacaggcatgagccaccaagcctgggcttgtattgtttatactcagtaataaagagcaaaatttatataagcaaaatcagccactgtaaagagagtttagacataaccatcacaactgcttcctcaaaaagtgtctgtacaagccacatccacctagggcaggtggcaccaccccgcgtgagagagct

SEQ ID NO: 20620 - DNA, 601 bp, Human
ctggtgcggagggcagagccccgaggcattcacgggcattcctctgggaagggatgggtgcgttctcagcgcctgagatggtacagctggggcacgggagctgggaagtgccagccctcaccacagggctggggcactggcccatggaggcctcaagacagacactctggtttgctcctccttcccctgcacccctccccactcctatcaaagtgcaaggctgtgtgagctctagcgtggctttctactaacaatgcatggatatcacttccaccttcccccacacttccagagagcaatyttacaatcttctaagagcattcaataatgtcttcatgactgttcatctgtattcttttttcttttttttttcttttttaacatgaggtctcgctctgtcacccaggatggaatacagttgtgattacaactcactgcctcaacctcctaggttcaagtgatccttgcacctcagcctcctgagcagctgagactacaggtgtgcaccacagcaccggctaagttatttttgtgtgtgtttttttgttgttgttgttgtttttttgtagagacagggtctgactattgttgccaaggctgg

SEQ ID NO: 20621 - DNA, 601 bp, Human
ttactcatgggcacactgggagttgaggaattctgtgcttcttccctcttggtcttcagccaatatgaaaaataaacacacaacaggaacgcaacaattcagcagccagggctagggacatacctggtgcggagggcagagccccgaggcattcacgggcattcctctgggaagggatgggtgcgttctcagcgcctgagatggtacagctggggcacgggagctgggaagtgccagccctcaccacagggctggggcactggcccatggaggcctcaagacagacactctggtttgctcctccttcccctgcacccctccccactcctatcaaagtgcaaggctgtgtgagctctagcgtggctttctactaacaatgcatggatatcacttccaccttcccccacacttccagagagcaattttacaatcttctaagagcattcaataatgtcttcatgactgttcatctgtattcttttttcttttttttttcttttttaacatgaggtctcgctctgtcacccaggatggaatacagttgtgattacaactcactgcctcaacctcctaggttcaagtgatccttgcacctcagcct

SEQ ID NO: 20622 - DNA, 601 bp, Human
ctcttactcatgggcacactgggagttgaggaattctgtgcttcttccctcttggtcttcagccaatatgaaaaataaacacacaacaggaacgcaacaattcagcagccagggctagggacatacctggtgcggagggcagagccccgaggcattcacgggcattcctctgggaagggatgggtgcgttctcagcgcctgagatggtacagctggggcacgggagctgggaagtgccagccctcaccacagggctggggcactggcccatggaggcctcaagacagacactctggtttgctcctccttcccctgcacccctccccactcctatcaaagtgcaaggctgtgtgagctctagcgtggctttctactaacaatgcatggatatcacttccaccttcccccacacttccagagagcaattttacaatcttctaagagcattcaataatgtcttcatgactgttcatctgtattcttttttcttttttttttcttttttaacatgaggtctcgctctgtcacccaggatggaatacagttgtgattacaactcactgcctcaacctcctaggttcaagtgatccttgcacctcag

SEQ ID NO: 20623 - DNA, 601 bp, Human
cgttctgctccttgacaaggatgagctccacctccttcgggcccacggcattgggctccttagccggggccaccacggaagacatgagtcccacggagcatttgctcttactcatgggcacactgggagttgaggaattctgtgcttcttccctcttggtcttcagccaatatgaaaaataaacacacaacaggaacgcaacaattcagcagccagggctagggacatacctggtgcggagggcagagccccgaggcattcacgggcattcctctgggaagggatgggtgcgttctcagcrcctgagatggtacagctggggcacgggagctgggaagtgccagccctcaccacagggctggggcactggcccatggaggcctcaagacagacactctggtttgctcctccttcccctgcacccctccccactcctatcaaagtgcaaggctgtgtgagctctagcgtggctttctactaacaatgcatggatatcacttccaccttcccccacacttccagagagcaattttacaatcttctaagagcattcaataatgtcttcatgactgttcatctgtattcttttttcttttttttt

SEQ ID NO: 20624 - DNA, 601 bp, Human
ccagacctagcatagaggccaatgagggaggccaggcagggaggctgggaggcccaaagaggctcctgggaagggatcaccaatgttcttggacgtccccggtggccctgcctcgatcttcgctttctggctctgtggctgggttctggagggtgcaggggacacagtcactttccaggggcctcctctgccactccaggctccagggcctccacatgctttgcaaaggctgccaaagtcagccgcaggctgttctttggacctttgagaattttctttccaaagcgaagatagcctctgsaaacaggaggcagagccaagctgccccgtctgccgccccccaccccccagcttcttcgcgggcctccctttcctaaactctgaaatgcaggcgtgggacaaggcagctccgagtcctgctcaatggttttgtgacatcctctgggaggatctgcaccggccgtgagctctcacagggagctccgtcttcacgcatgggaacagcttcatctcgtttccgtacgtgccttggccccggctgcccctacgacccccgcccggccagcatgctcagggaggctgagatgggacttaccgccac

SEQ ID NO: 20625 - DNA, 601 bp, Human
ggacaaaggcacatgtatcagggtgccgggggtgcatggtgtacatctgatttcataagcaatgtcagtctcctctaaactggcatcctgcgcttgacaggtaggcagaacaaacgggacgctggcaccggaacctgcagcgttactgagattcaacaactcaaggtgtctcgtctctaaaaagaagtccagctttcttgcactgattcatctatcccttcgtgggtcgaacagttcactttctgtgatttgcaattttccttcctcaccaggactaggtgagtgtgaacaagctcttccmaagatccgcccgcagggccacgagccttccttcctgcggccacactttgcagccctcctctgggactagtcttcagaacgaagctggcggcatggaatgcgggattgtgggcacagggtctgtgacacagaggagacgactgcccagcttaccccggctgcgcattgtggagaacacgatgatatgcccacatccgccggctgcatttcttcagaacgaggtgccactgctcacgctgatggaagtcagaggttctctactagcccaagttgagttggtgctctgaaattcttagaaatt

SEQ ID NO: 20626 - DNA, 601 bp, Human
agagggccgggcacggtggctcactcctgtaatcccagcactttgggaggccaaggcaggcggatcatgaggtcaggcaatcgagaccatcctggctaacacgatgaaaccccgtctctactaaaaatacaaaaaattagcggggcgtggtggcacgcacctgtagccccagctactcgggaggctggggcaggagaatcgcttgaacccgggacgcgcaggtgacagtgagccaagatcgcgcctttgcactccagcctggtgacagagcgagattccgtctcacaaaaaaaaaaaaaaagaaaagaaaagaaaagaaagaggggagaggacgcctctctgtgtcagtctgggtgtctttagtatgtgcttgctgtgtgtgcatgtacccgagagacagagaggagaagagacagaacaggagagagacagagaggagaagagacagaacaggagagacacagagaggaaaggagggagagagacagaaagagacacagggagagggaaagagagcgaggggaagggaggagacggagagttttaaagacccacctctcaggaccctggggtgcactgcggggctgaaggccccagaggc

SEQ ID NO: 20627 - DNA, 601 bp, Human
cttctcagtttactgacatgattagtttgggtacaactttgatttactttattaaaacccagtaggcaccatgccgtcttgcctgttcatggccggggtaggagcataccttcaaggtgacttttgcagggggtggcctgggttgctttttatagtctcaatccttaggagaagctgttctcatgctcagggcacctcagtaaagttctcttcctaccttgaaagcaaaaagaagactcaaaactttgttttaaacaaatctaagatcaggagtgcgggtaatcccccttggaaagcatgytcagtagtggtgacgatgaaagccaagctgctgcctttggaaggtcttctcctatgtggatctggtccatattaaataattctgtattgcagtctgtcatggattgcctttgaaaagccttctcccatatggatctggtccatattaaataattctgtattgcagtctgtcacggattgcctttggaaggccttctcccacgtggatctggtccatattaaataattctatattaccgtctgtccggagtcccttaggagagaggctgggttgtgatccacagtgaactcacccaggcag

SEQ ID NO: 20628 - DNA, 601 bp, Human
tcatttccacatttcttctcagtttactgacatgattagtttgggtacaactttgatttactttattaaaacccagtaggcaccatgccgtcttgcctgttcatggccggggtaggagcataccttcaaggtgacttttgcagggggtggcctgggttgctttttatagtctcaatccttaggagaagctgttctcatgctcagggcacctcagtaaagttctcttcctaccttgaaagcaaaaagaagactcaaaactttgttttaaacaaatctaagatcaggagtgcgggtaatcccycttggaaagcatgctcagtagtggtgacgatgaaagccaagctgctgcctttggaaggtcttctcctatgtggatctggtccatattaaataattctgtattgcagtctgtcatggattgcctttgaaaagccttctcccatatggatctggtccatattaaataattctgtattgcagtctgtcacggattgcctttggaaggccttctcccacgtggatctggtccatattaaataattctatattaccgtctgtccggagtcccttaggagagaggctgggttgtgatccacagtga

SEQ ID NO: 20629 - DNA, 601 bp, Human
ggccatgcaagaccatcaaggaccagccagggccatccatggccatgcaatgccatccacggtcttttagagtgtcctttccaggatcacagacctggaatttgggatccatcatttatggggtctcctggtaaactggaacagaactcagtggtcagcagtctttggagtggtgtcagcctgactggtgggcagatgggcctggtggtcagatgacttcctccttgttcactgctggatgggcaccatcacgttcttgctactggggttcactttactaagctccaggaagaatttttttcatttccacatttcttctcagtttactgacatgattagtttgggtacaactttgatttactttattaaaacccagtaggcaccatgccgtcttgcctgttcatggccggggtaggagcataccttcaaggtgacttttgcagggggtggcctgggttgctttttatagtctcaatccttaggagaagctgttctcatgctcagggcacctcagtaaagttctcttcctaccttgaaagcaaaaagaagactcaaaactttgttttaaacaaatctaagatcaggagtgcgggtaatcccc

SEQ ID NO: 20630 - DNA, 601 bp, Human
ttccagggccatgcaagaccatcaaggaccagccagggccatccatggccatgcaatgccatccacggtcttttagagtgtcctttccaggatcacagacctggaatttgggatccatcatttatggggtctcctggtaaactggaacagaactcagtggtcagcagtctttggagtggtgtcagcctgactggtgggcagatgggcctggtggtcagatgacttcctccttgttcactgctggatgggcaccatcacgttcttgctactggggttcactttactaagctccaggaagaakttttttcatttccacatttcttctcagtttactgacatgattagtttgggtacaactttgatttactttattaaaacccagtaggcaccatgccgtcttgcctgttcatggccggggtaggagcataccttcaaggtgacttttgcagggggtggcctgggttgctttttatagtctcaatccttaggagaagctgttctcatgctcagggcacctcagtaaagttctcttcctaccttgaaagcaaaaagaagactcaaaactttgttttaaacaaatctaagatcaggagtgcgggta

SEQ ID NO: 20631 - DNA, 601 bp, Human
ccacccatggccatccagagccatccatagccatctatggccatctgtggccatctatagctgctcatgcctctcctgcaagactactcagaagagtcatctgagctcatttacagccatgtggagccatccaaggtcacactacccatgcatgaccatccagggtttcctagaatcacccagggccacgtaagaccaccagggtccacccagggcaggtaagatcatccagggcttccttgggccacccagagccttgcatgactatgaaggactactcagagccatgtttgaccttccraggccttccagggccatgcaagaccatcaaggaccagccagggccatccatggccatgcaatgccatccacggtcttttagagtgtcctttccaggatcacagacctggaatttgggatccatcatttatggggtctcctggtaaactggaacagaactcagtggtcagcagtctttggagtggtgtcagcctgactggtgggcagatgggcctggtggtcagatgacttcctccttgttcactgctggatgggcaccatcacgttcttgctactggggttcactttactaagctccagg

SEQ ID NO: 20632 - DNA, 601 bp, Human
ccggccatccacaacaatccattgccattcaaaaccatccacagccatctacagacatccacagccatccacagccatctgcatttgcccataactatctacggccacccatggccatccacagccacccatggccatccagagccatccatagccatctatggccatctgtggccatctatagctgctcatgcctctcctgcaagactactcagaagagtcatctgagctcatttacagccatgtggagccatccaaggtcacactacccatgcatgaccatccagggtttcctagaatyacccagggccacgtaagaccaccagggtccacccagggcaggtaagatcatccagggcttccttgggccacccagagccttgcatgactatgaaggactactcagagccatgtttgaccttccgaggccttccagggccatgcaagaccatcaaggaccagccagggccatccatggccatgcaatgccatccacggtcttttagagtgtcctttccaggatcacagacctggaatttgggatccatcatttatggggtctcctggtaaactggaacagaactcagtggtcagcagtctt

SEQ ID NO: 20633 - DNA, 601 bp, Human
gtcacccagagctatggcgagtatccagggccacccttatgcacccagagacccccagggacaccaaggtcacccccagccacatatggtcatccatccccaccacagccactcaggatccataagagtcatccaggatcattgaggccatctagggggtactctgggtgacccagggcaacccaactcatggttaaccagggctatcaggcccatgtgaaaccatcagaatcatccacggccacccagaagcacccagggctacctagggagcccatgcaaatagggccatcaaaggtcrtctagggttacccaggaacacccagtgtctcccagagccatcaagactgccaatagtcactaagggacacctggggtccttgacagccatccacagccaccaggctcattcaggactatggagggcacccaggaccacatatggccacccaggctaatccagggccactttgagtcgcaaagggccatccatggccatccacagccatctccattcatccacaactatccacggtcagctatagccatcctcaaccattcatggccatccacggccatccacatccatccgcagccatcc

SEQ ID NO: 20634 - DNA, 601 bp, Human
ttggggctgttccaggagttgttgcagtggatccaggggagctccgtggtgaaggaggagaagagatagtgcagcgcccaggcgatgatgacgttgtagaagaagccgacatacagtgagatgaggatgaccgtgaagcccacacctagcgggaagggggaggccatggagcccacgcaggtggagcacagagccaccatcagcaacgtgtcccttccacctcccctcacgggagacattaccctgagcccacaactcctggacagccctgatgccagacagcatcttcaaacatgcagggaaggcccgtgaaaggcctgagaccagatttcacactgtgaccacagagaagaagctgcccactccccaaaaccatgcactcctacacaaggactttcagggtgtctctgagagacatccagagccagcaaggtcacccagagctatggcgagtatccagggccacccttatgcacccagagacccccagggacaccaaggtcacccccagccacatatggtcatccatccccaccacagccactcaggatccataagagtcatccaggatcattgaggccatctagggggtactctgggt

SEQ ID NO: 20635 - DNA, 601 bp, Human
aaagtactcggcagcaggtgtggtcccaaaagtgtcgttgaggcccgagctgtctccactggagtcaccaggatgggcatccgagcagttggggctgttccaggagttgttgcagtggatccaggggagctccgtggtgaaggaggagaagagatagtgcagcgcccaggcgatgatgacgttgtagaagaagccgacatacagtgagatgaggatgaccgtgaagcccacacctagcgggaagggggaggccatggagcccacgcaggtggagcacagagccaccatcagcaacgtgtcycttccacctcccctcacgggagacattaccctgagcccacaactcctggacagccctgatgccagacagcatcttcaaacatgcagggaaggcccgtgaaaggcctgagaccagatttcacactgtgaccacagagaagaagctgcccactccccaaaaccatgcactcctacacaaggactttcagggtgtctctgagagacatccagagccagcaaggtcacccagagctatggcgagtatccagggccacccttatgcacccagagacccccagggacaccaaggtcacccccagcc

SEQ ID NO: 20636 - DNA, 601 bp, Human
tactcaaagtactcggcagcaggtgtggtcccaaaagtgtcgttgaggcccgagctgtctccactggagtcaccaggatgggcatccgagcagttggggctgttccaggagttgttgcagtggatccaggggagctccgtggtgaaggaggagaagagatagtgcagcgcccaggcgatgatgacgttgtagaagaagccgacatacagtgagatgaggatgaccgtgaagcccacacctagcgggaagggggaggccatggagcccacgcaggtggagcacagagccaccatcagcaacrtgtcccttccacctcccctcacgggagacattaccctgagcccacaactcctggacagccctgatgccagacagcatcttcaaacatgcagggaaggcccgtgaaaggcctgagaccagatttcacactgtgaccacagagaagaagctgcccactccccaaaaccatgcactcctacacaaggactttcagggtgtctctgagagacatccagagccagcaaggtcacccagagctatggcgagtatccagggccacccttatgcacccagagacccccagggacaccaaggtcacccc

SEQ ID NO: 20637 - DNA, 601 bp, Human
gggggacctggctgcgccatctctcccgttcccgaggacccgactcccacttactcaaagtactcggcagcaggtgtggtcccaaaagtgtcgttgaggcccgagctgtctccactggagtcaccaggatgggcatccgagcagttggggctgttccaggagttgttgcagtggatccaggggagctccgtggtgaaggaggagaagagatagtgcagcgcccaggcgatgatgacgttgtagaagaagccgacatacagtgagatgaggatgaccgtgaagcccacacctagcgggaagkgggaggccatggagcccacgcaggtggagcacagagccaccatcagcaacgtgtcccttccacctcccctcacgggagacattaccctgagcccacaactcctggacagccctgatgccagacagcatcttcaaacatgcagggaaggcccgtgaaaggcctgagaccagatttcacactgtgaccacagagaagaagctgcccactccccaaaaccatgcactcctacacaaggactttcagggtgtctctgagagacatccagagccagcaaggtcacccagagctatggcgagtatc

SEQ ID NO: 20638 - DNA, 601 bp, Human
acaccctccccagggatggaaagggaagaacaacttggcagggaaagcacattccttttctgcattcggtccgccagagtagctgggagtggctgatgggggttttctgatgcgtgggacgtgagtggattcacactggtgaacggcactgtggcacgatgaagggctgctctgggctgtgtccctgcgggaggctcccgtggctggtgccatactacacgcacttttccaagggaggagtcgtatcttggtcaaaactggttttggcccatataacaaccaaagttttttttttttttttgagatggagttttgctctttttgcccaggctggagtgcagtggcatgatcttggctcactgcaacctccgcctcctgggttcaagcaattctcctgcctcagcctcccacgtagctgggattataggcacgtgccaccgtgcctggctaatttcgtatttttagtagagatggggtttcatcatgttggccaggctgttcttgaacccctgacctcaggtgatctgcccgtctcagcctcccaaagtatttttatcaacaaaaaaatcatcttgtgtgtgccttcctgccagaaacactg

SEQ ID NO: 20639 - DNA, 601 bp, Human
ccttgtggtatttttctttgattctgtaacatgccatggtcctgcaaacacaccccttggcttcattttggcctttctggggtccagacgccctgctgacttcatggtttgtctggctccagctctgcacttgtgggcccccggccacagctgattttgctgccctggttgtcctcctctctcttccttggctcccgtgggccacacgcctgctgcacccatggctcctgtctccacagggcttccccttcagtgctgcaggcacacttccacccccacccccacccaactgctttgcagsctcataggtgccatgtccaggtgccctctctcactgcacctgtcagctgctgcctccctggggcttcctgggaggcttgcagccatgcccgcccatcccttctccccttccttcccacttctgccttgggtttacacttgcctcatgacccccagacctggctccaccggcccacccacacagggcagcacctctcaacggcctcctgcctcataccccagctgagatggcccttcccctcttgctgcattgtcctcccacagcaacatggatgcccctgggcggctttggggcctgcca

SEQ ID NO: 20640 - DNA, 601 bp, Human
gcatgtcagagcctcaaggcaaccccagttcctgggacagtgtgtttggaggcagatggccaggccccgcagtcaggactctgcaggtggccagtgtttcagcatgaggggaggagccaagccgagagtggctgggtgggcagtgggtggagaggctcataccctgatgtggctcccatgctggtcatcagccacctgcctggccaggtagctgcaggctggatcaggtgtcacaggggagcgcctgcctcctcctcaccctgatctgtgtgtgcagctcaggcctctgcccagtgccacmccagagccagtgcccatggctgcctccctgggcctcacctcatgcactttcactccaggacctgcaattgtcctttccttccatttctttcctgatttctcttcactatacatcaatccatcatctattatctatcaatcaatcatctatctatctatcatctatcactgtcatctatcaatccatcaccaatctatcatctatctgtcatctctataatctatcaactgtctatcatctatgaatatatgaagtacatgtgtgtgtatgtatctatctccatccatcctattgtatatc

SEQ ID NO: 20641 - DNA, 601 bp, Human
ccctcagaaagtcatgaactcatccacacacaacatgaccgcggcgccctgataaccctcagaacagcatggacttatccacactcacaccagccctagcggggtctccatcctcccttgatcagggtccagcttcacaaccccctgagtgtgtccccccatcccatgtgcgccctgctgcatgatggcagtgccctgaaaccctcagaacagcacagactcaaccacaggctacatgatggcggcttcctgataaccctcagaacatcatggatcatccacaagctgcatgatggcggcrccctgataaccctcagaacaacataaactcatcctgaggctacatgatggtggcgccctgacaaccctcagaacagcatggatcatccacatgctgcatgatggcagcaccctgataaccctcagaaaggcatggacccatccacatgctacatgatgatggtgtcctgattggacgcacaccagcaatgcctgctttgtatccttcccaaaacatgagcagtacaggtgcacagtggcacctgggcatggccaggagcccacctgcagcttagacactggtgctgtgcctgcccaactc

SEQ ID NO: 20642 - DNA, 601 bp, Human
ccacacacaacatgaccgcagcgtcctaatagccctcggaacagcacggcctcatccacacatgacatgaccgcagcgtcctaacaaccctcggaacagcacagattcatccacatgctgcataatggtggcaccctgataaccctcagaaagtcatgaactcatccacacacaacatgaccgcggcgccctgataaccctcagaacagcatggacttatccacactcacaccagccctagcggggtctccatcctcccttgatcagggtccagcttcacaaccccctgagtgtgtccccycatcccatgtgcgccctgctgcatgatggcagtgccctgaaaccctcagaacagcacagactcaaccacaggctacatgatggcggcttcctgataaccctcagaacatcatggatcatccacaagctgcatgatggcggcaccctgataaccctcagaacaacataaactcatcctgaggctacatgatggtggcgccctgacaaccctcagaacagcatggatcatccacatgctgcatgatggcagcaccctgataaccctcagaaaggcatggacccatccacatgctacatgatg

SEQ ID NO: 20643 - DNA, 601 bp, Human
ctcccaagggcgctggtgctgcgggcctgggggccccactctgagggctgagaaaccagagagctggaggcaagcgaaggacgaagagggagggtcctggggtcggtcagggcaccagcgtcctcctcctgggttcctgtgtggcctgtcactggggtggaaggaccacacacttcatctgcagagcacctggacccaggtggacgcaggtgggctgcgggcaggcgctgcctcaggacctgccttccagcgcccactctcagtgaagcctgcttgtggtctgcctggccattctgctgcwcacactgtccttgtatttttaccgtgtttctagcctcatgatgtgaaagaaagtaagcacaagtccataaaggtcaaagcaagcagatcccggataaaattctgtttctgtttttagaaggatttggggtccggcacggggcttcaggtgcctgccagtaagtaacacggggtgcatatgggatggggggacacactcagggggttgtgaagctggaccctgagcgagggaggacagagaccccccggggctggtgtgagggaagagggtgtgtccttgtggagggaggggctggccttg

SEQ ID NO: 20644 - DNA, 601 bp, Human
tgcaacatacacactcagacacacataccatgcaacatacacactcagacacacataccatgcaatatacacacacagacacatgcgcgcacatgcacgaacactcatttgtgcattcaaactcatacatgcaagaacacatccacatgcacgcacacaaacagaaacatgcacgtgcatgcacaaacatacacacacaaacacacacaaatcacacacgtccacactatttagtagcctaatttctaaaattagcaaaacatttagggatacattcctgacctccgccttccaggcacaygaggaagctgaggtcctcccaccctcccgtgaggttagacgtggctgcacttggccaatgtgctgtgaacccacagtgagcgggtccctgcgagtgaagcttggtagaggagtgtgtggctccttcaccacctcccctgccacggggtcccgcaggccatattgagacaggctcctgtcagctggggccctgagggctcagaggagcagcacatcctgatggatacaggggcccagatggtggcttcggagataagagacaaacctgctaccttgctatccctgcaagcgaggggcacgc

SEQ ID NO: 20645 - DNA, 601 bp, Human
ggacatctgctaatgtccttcgagttagtttttcctgcacataccatgcaacatacacactcagacacacataccatgcaacatacacactcagacacacataccatgcaacatacacactcagacacacataccatgcaacatacacactcagacacacataccatgcaacatacacactcagacacacataccatgcaatatacacacacagacacatgcgcgcacatgcacgaacactcatttgtgcattcaaactcatacatgcaagaacacatccacatgcacgcacacaaacagwaacatgcacgtgcatgcacaaacatacacacacaaacacacacaaatcacacacgtccacactatttagtagcctaatttctaaaattagcaaaacatttagggatacattcctgacctccgccttccaggcacatgaggaagctgaggtcctcccaccctcccgtgaggttagacgtggctgcacttggccaatgtgctgtgaacccacagtgagcgggtccctgcgagtgaagcttggtagaggagtgtgtggctccttcaccacctcccctgccacggggtcccgcaggccatattg

SEQ ID NO: 20646 - DNA, 601 bp, Human
cagtgcccatgccgaccagacagccagtcaggcccgaagccaacatcctgacggtccccttaaagtctagcgcagagcagaacatcagcatttgagcactcgcttgaaaataaaacgtggtcctggagatggctcttgagtctaagctaccacgtgtgctgggctctgagtaagaaagtgcccacacccaggtgggctgcctcggggccacctgcagctgacatattccgggagcacttgctttttgtcacctgcagctcttgggagagtgaacgctgaacgtgccttccttccactgccygctgcggcagctcctggggcctggacagcaccaagtcctcccagagcaggcagcatcttcaggagctcaccctctcgggcctggatgcctgtatctggatctctgaggccaggtgacctctcacagggacccctgtgcgtggccccaccccacgtcatcaccacaattccacttgtacctggctcagctgctgaggttttacttggcttacgttcagagtttggccatgcgaggggtaagggcgctggctgttcaggtccgccgggctgtaggcatcctccagctctgcgctgacctggg

SEQ ID NO: 20647 - DNA, 601 bp, Human
cttagatttccttggtttgttcgtgtctctcccattgcaggatgacttcctggggtcttcgtctctgctccctctacaccttgagccagtggcggagctggaaagaaaacaggtttagtcagaaaccctggggcgatgccccatttaagagcagctgaaggtggctaagagcagctgaaggcagtgagcagacagtttgcagcctcctggccatgtgccctgggagaaggggaggctcactgggggcctggaccaacacacccttgacaggtgccggggatccgatgcctcactcaaactyctacaaatcaatcattacttgattttttaaaaagccgcgagactgtggttggcgtggtggccatggtggcctctggggcgtattgatcagatgctgagtctgagagatgccgggcaccctcagtccggggctggttccagattgtaccccagcgacttgggtgtgacgtggtgatgtcacctctcccccacgtccctccaccttcctgggggcctcagatgctccatctgagtgacacgctacctctgcagctccatcttgctctctgcgacccgcgcgggcgcaagtgcagcgtgtact

SEQ ID NO: 20648 - DNA, 601 bp, Human
tcagagccgggagcagggagcagggagggagggagcctcacacagacagcatgaagttagacgtttttctgccctgcagggacaacaacggggtggacctcgctgcacagatctacgtcgttattacagcaacacaagacacggcgaggtgcgctcccggcacggaaaggtgtaaacagtcagaagagaggagtcttctgctttgttgtttgtgttttcagtagaggttgaagagtagaagttgccctcctttctctcgaaacttagatttccttggtttgttcgtgtctctcccattgcrggatgacttcctggggtcttcgtctctgctccctctacaccttgagccagtggcggagctggaaagaaaacaggtttagtcagaaaccctggggcgatgccccatttaagagcagctgaaggtggctaagagcagctgaaggcagtgagcagacagtttgcagcctcctggccatgtgccctgggagaaggggaggctcactgggggcctggaccaacacacccttgacaggtgccggggatccgatgcctcactcaaactcctacaaatcaatcattacttgattttttaaaaagccgc

SEQ ID NO: 20649 - DNA, 601 bp, Human
gctggctgctcaaggggaaatgtatgtgtctacatgcctgactctccaagggcaggaaccatgtgctgatgtggcccagcaatgaggggcctggggagggtgagaaggacttgggacttctcctgtgggaactggcagatccctctgctcccactgcactacccagctgcctcaatctcttgctgcatctccttctcccagctttagccaggttctatcactccccgtgcaggcctccaacaagagcaatacagtgggatccatagttcactggacagccaagcccttaaccgccctggtmctcagcagcagcaggtgcccttccacacatgttcacagctgtgcccaggccctcggtcatcagctacctgcccagagcacaacgcctaccacagagttggtcaatgtgttgcgtggattattctcagggcattagttcaaggccagagccctaagctcacatgtacacctgcctacaggtgtacattgggaagtcccataaatacatcagactcaaccccagaattggactcaccatcccctcacccccaccctatggaggaccttctcactgtgtccttacatggtctttcctccatgt

SEQ ID NO: 20650 - DNA, 601 bp, Human
atgaggggcctggggagggtgagaaggacttgggacttctcctgtgggaactggcagatccctctgctcccactgcactacccagctgcctcaatctcttgctgcatctccttctcccagctttagccaggttctatcactccccgtgcaggcctccaacaagagcaatacagtgggatccatagttcactggacagccaagcccttaaccgccctggtcctcagcagcagcaggtgcccttccacacatgttcacagctgtgcccaggccctcggtcatcagctacctgcccagagcacracgcctaccacagagttggtcaatgtgttgcgtggattattctcagggcattagttcaaggccagagccctaagctcacatgtacacctgcctacaggtgtacattgggaagtcccataaatacatcagactcaaccccagaattggactcaccatcccctcacccccaccctatggaggaccttctcactgtgtccttacatggtctttcctccatgtgcacacatccctggtgttgccttgtgtgtcctaatctcctctcattacaaggataccagattggaataggtctcatcctag

SEQ ID NO: 20651 - DNA, 601 bp, Human
aatacctgaggctgggtaatttataaatataagaggtttattttgaatcatgattctggtggctgaaaagtccaagagcatggtgctggcatctgctcagcttctcgtgagggccatgctgcatcaagacatggtgaagaaatagaaaggcaagcaggcatgtataaagggaccaaactcacccacttctgggagatggcattaatctactcatgtggaatccacccttatggcccaaacacctctcacaagaccccgtgtcctagcactgccacactggcagttaaacttcaacagagarttttggtggggactaaccacatccaaaccacagcagtatccaaaaagtgttttgtagttttatgtttatatatatgtatactttttgttcataactatgtataaacagttttctatcactatcactgccataacaaattatcaaaaatttagcagcttaagacaatacaagtttattatctcacacctctgtaagtcagaagtccaaacaggtgtctctgggtaaaatcaaggtgttggcagggctgcgttcccttctggagggtctgaagaagaatcccttccaagctcattctggttg

SEQ ID NO: 20652 - DNA, 601 bp, Human
cagcttctcgtgagggccatgctgcatcaagacatggtgaagaaatagaaaggcaagcaggcatgtataaagggaccaaactcacccacttctgggagatggcattaatctactcatgtggaatccacccttatggcccaaacacctctcacaagaccccgtgtcctagcactgccacactggcagttaaacttcaacagagagttttggtggggactaaccacatccaaaccacagcagtatccaaaaagtgttttgtagttttatgtttatatatatgtatactttttgttcataactmtgtataaacagttttctatcactatcactgccataacaaattatcaaaaatttagcagcttaagacaatacaagtttattatctcacacctctgtaagtcagaagtccaaacaggtgtctctgggtaaaatcaaggtgttggcagggctgcgttcccttctggagggtctgaagaagaatcccttccaagctcattctggttgttggcagaattcagattcatgtggctgtaggatggaggtcccatttgcttgttggctgaggttcattctcagcttctggaggtcatgccttgtcttg

SEQ ID NO: 20653 - DNA, 601 bp, Human
gtgagggccatgctgcatcaagacatggtgaagaaatagaaaggcaagcaggcatgtataaagggaccaaactcacccacttctgggagatggcattaatctactcatgtggaatccacccttatggcccaaacacctctcacaagaccccgtgtcctagcactgccacactggcagttaaacttcaacagagagttttggtggggactaaccacatccaaaccacagcagtatccaaaaagtgttttgtagttttatgtttatatatatgtatactttttgttcataactatgtataaayagttttctatcactatcactgccataacaaattatcaaaaatttagcagcttaagacaatacaagtttattatctcacacctctgtaagtcagaagtccaaacaggtgtctctgggtaaaatcaaggtgttggcagggctgcgttcccttctggagggtctgaagaagaatcccttccaagctcattctggttgttggcagaattcagattcatgtggctgtaggatggaggtcccatttgcttgttggctgaggttcattctcagcttctggaggtcatgccttgtcttgtgttcccct

SEQ ID NO: 20654 - DNA, 601 bp, Human
gaaaaactggaacccttgtgcactgcttgtaaaaatgtaaaatggtgcggctgctgtggaagatgctgtaacatttcctcaaaatattaaacatagaattaccagatgatctagcaatttcacttctgagtatataccaaaaaaaattgaaagcaataattcaaagagatatttgtacatcgatgttcacagagacctaattcatgacagccaaaagtttccatcaatagatgactgggtaaacaaaatataggctgggcacggtggctcacgcctgtaatcccaacactttgggaagccraggtgggtggatcacctgaggtcaggagctcaagaccagcctggccaacatggcgaaactcggtccctactaaagtcacaaaaattagtcaggcatggtggcgggcacctgtaatcccagccactcaggaggctgaggcatgagaatcgcttgaaccctggaggcagaggttgcagtgagcagagatcatgccattgcactccagcctggataaacagagtgagactctgtctcaaaaaaaaaaaaaaaaaaaaaaaaggaaaggtgtatatctacagtgaactagggaaggaaatccca

SEQ ID NO: 20655 - DNA, 601 bp, Human
aaaatgtagttaatgcagctctagcatgaagtctagacttggagcaactgtagacagaggtctgataaatccctaaaaatgtcctaagatagaaattccctgatctgatgcatacaagacacttgtaacctgtggaaggaggtgtctccaagtcagaatagccttaaaggattttgctttcccctatgatcctaccatccagcccctctggctcctctggctttcgaagaagagaaaatggtcactaggtaggtaactactcgctttgtaacccagtgcctgttcccgccctgctctgaamtacctgtggggctctgaccccatagacaggccagcctctgcctgcttaaccatgatctcactccatgtgccatgaggacctgctgttttgtgtgtgtctggtcttctgctccttgagcagcaggatggtataatagttaaggactaccagggtttaaatcctgactccatcactcacctcacaacgtttaaatcctgactccgtcactcacctcacaatgtttacataacctctctgtgttacagtttccttagctgcaaagtgtagatagaatcaaggcctatctcaaagagttgttgt

SEQ ID NO: 20656 - DNA, 601 bp, Human
ttccctgatctgatgcatacaagacacttgtaacctgtggaaggaggtgtctccaagtcagaatagccttaaaggattttgctttcccctatgatcctaccatccagcccctctggctcctctggctttcgaagaagagaaaatggtcactaggtaggtaactactcgctttgtaacccagtgcctgttcccgccctgctctgaaatacctgtggggctctgaccccatagacaggccagcctctgcctgcttaaccatgatctcactccatgtgccatgaggacctgctgttttgtgtgygtctggtcttctgctccttgagcagcaggatggtataatagttaaggactaccagggtttaaatcctgactccatcactcacctcacaacgtttaaatcctgactccgtcactcacctcacaatgtttacataacctctctgtgttacagtttccttagctgcaaagtgtagatagaatcaaggcctatctcaaagagttgttgtgagcattaacaaattcagtataggtaaaaagcttgaagcagtgcctgacactcagaggatactatctacgtgttagctatctttactaaccactt

SEQ ID NO: 20657 - DNA, 601 bp, Human
cctgcttaaccatgatctcactccatgtgccatgaggacctgctgttttgtgtgtgtctggtcttctgctccttgagcagcaggatggtataatagttaaggactaccagggtttaaatcctgactccatcactcacctcacaacgtttaaatcctgactccgtcactcacctcacaatgtttacataacctctctgtgttacagtttccttagctgcaaagtgtagatagaatcaaggcctatctcaaagagttgttgtgagcattaacaaattcagtataggtaaaaagcttgaagcartgcctgacactcagaggatactatctacgtgttagctatctttactaaccacttctccaggccccatgaccccatgtgttccctgattatctaagaccagcattttttgtttatttaaagatggaggctagctctgtcacccaggctggactgcagtggtgccatcataggtcactgcaacctggaactcctgggcttaggcaatcttcccacctcagactcctgagtagctgggactacaggtgaacaccgccacacctggcaaattttttgcttgtagagatcgggtttcactatgtt

SEQ ID NO: 20658 - DNA, 601 bp, Human
ctgagtagctgggactacaggtgaacaccgccacacctggcaaattttttgcttgtagagatcgggtttcactatgtttcccagattggtctcaaatacctggcttcaagcaatcctcctgcctcggccttccaagccactgggatcacaaacatgagccaccacacccagcccaagaacggcttttgatctttgttctacctcctgcccctgccgctgcccagtgtcttacctctggcaatttgagagattaaagaaagaggagaggcctaagcaagatttctaatgaagtattcttagmagtagagagcagagtgttcaatcactaaatcggcataaaaaccaggatagagctgtagaatccagagaaaggatggtaatcaaacggccagcttggcatgtcatacagaggcaccctggcctctttaggaaccaaggtgccctgtgtgagaataacaaacagtctcaggctttatgatctgcccagccacagacagctgaatgctggctggagactcagctgtgcagtggtcgtttgtttggtttttttttttgagacaaagtctggctctgttgcccaggcaggagtgcaatggcatgg

SEQ ID NO: 20659 - DNA, 601 bp, Human
aaccaggatagagctgtagaatccagagaaaggatggtaatcaaacggccagcttggcatgtcatacagaggcaccctggcctctttaggaaccaaggtgccctgtgtgagaataacaaacagtctcaggctttatgatctgcccagccacagacagctgaatgctggctggagactcagctgtgcagtggtcgtttgtttggtttttttttttgagacaaagtctggctctgttgcccaggcaggagtgcaatggcatggtcttggctcactgcaacctctgcctcccgggttcaagcarttctcctgcctcagcctcccaagtagctggaattacaggcacctgccagcacgcccagcaaatttttggtatttttagtacagtcagggttttaccatgttggccaggctggtctcgaactcctgacctcatgatatacccgcctcggcctcccaaagcactgagattataggcgtaagccaccgtgcccagccagtggttttctttcagagtagataatccctgccagttgaggtgaggagcatcactgggaggagaccagttgctgacatagactcatggctgtcggccaaaggtctc

SEQ ID NO: 20660 - DNA, 601 bp, Human
ggcctctttaggaaccaaggtgccctgtgtgagaataacaaacagtctcaggctttatgatctgcccagccacagacagctgaatgctggctggagactcagctgtgcagtggtcgtttgtttggtttttttttttgagacaaagtctggctctgttgcccaggcaggagtgcaatggcatggtcttggctcactgcaacctctgcctcccgggttcaagcaattctcctgcctcagcctcccaagtagctggaattacaggcacctgccagcacgcccagcaaatttttggtatttttaktacagtcagggttttaccatgttggccaggctggtctcgaactcctgacctcatgatatacccgcctcggcctcccaaagcactgagattataggcgtaagccaccgtgcccagccagtggttttctttcagagtagataatccctgccagttgaggtgaggagcatcactgggaggagaccagttgctgacatagactcatggctgtcggccaaaggtctcaaccacccttggagcattctggagtggtcagacactactggacaatggatgagcttgtgccctgcatggtcagtctcc

SEQ ID NO: 20661 - DNA, 601 bp, Human
gtcctctatgtctgctaaggtttcttatagctttcatctccgtttctctacattgtgcttctttagctctgccactatttttcttttcagctatataagctctgctatttaaccctactcattgtaggttttcatgtccaaacactataaatcttcccagtctttttagtagtctcttgtttccttgctcatgttttcaactttctcttttattcctttgcacttttttttgagacagggtctcactctgtcacccaggctagagtgcagtagtgcaaacacagctcactgcagcctcaatctctcgagctcaagcgatcctcccatctcagcctcccgagtaagtagctgggactacaggtgcgtatcaccatgcccagctaattttggtattttttttttttagagacaggatttcaccatgttgcccaggctggtctcaaactcctgagctcaagcaatccacctgcctcaacctcccaaagtgccaagattacagacgtgagccactgcccctggccttctttgcatattttaaacatagttatttatattctctattaggtacccaataactgaggtcactaggggtttagttctt

SEQ ID NO: 20662 - DNA, 601 bp, Human
gcacttttttttgagacagggtctcactctgtcacccaggctagagtgcagtagtgcaaacacagctcactgcagcctcaatctctcgagctcaagcgatcctcccatctcagcctcccgagtaagtagctgggactacaggtgcgtatcaccatgcccagctaattttggtattttttttttttagagacaggatttcaccatgttgcccaggctggtctcaaactcctgagctcaagcaatccacctgcctcaacctcccaaagtgccaagattacagacgtgagccactgcccctggycttctttgcatattttaaacatagttatttatattctctattaggtacccaataactgaggtcactaggggtttagttcttccacctgttttttttctagctcttgttcatagggcttttccctcatttgttttgtaattttgtataaaaagctcttttctccctgtcttgatctcacacctacattggaacatttccaatctagaatagtttaagttaacttctggtccaagctggtagtataatttcatatccatgcatgtagtatgaaaacaggattgtggttatgagttctcaaga

SEQ ID NO: 20663 - DNA, 601 bp, Human
agctgggactacaggtgcgtatcaccatgcccagctaattttggtattttttttttttagagacaggatttcaccatgttgcccaggctggtctcaaactcctgagctcaagcaatccacctgcctcaacctcccaaagtgccaagattacagacgtgagccactgcccctggccttctttgcatattttaaacatagttatttatattctctattaggtacccaataactgaggtcactaggggtttagttcttccacctgttttttttctagctcttgttcatagggcttttccctcayttgttttgtaattttgtataaaaagctcttttctccctgtcttgatctcacacctacattggaacatttccaatctagaatagtttaagttaacttctggtccaagctggtagtataatttcatatccatgcatgtagtatgaaaacaggattgtggttatgagttctcaagaaagcctctttttctgcacccagaggcgaggcaaggaaattaccttacctctctttggcagtaggtgatctttttctctctcacctttcactgaggtagcagacatttgagtttctccggctaatgca

SEQ ID NO: 20664 - DNA, 601 bp, Human
atctcacacctacattggaacatttccaatctagaatagtttaagttaacttctggtccaagctggtagtataatttcatatccatgcatgtagtatgaaaacaggattgtggttatgagttctcaagaaagcctctttttctgcacccagaggcgaggcaaggaaattaccttacctctctttggcagtaggtgatctttttctctctcacctttcactgaggtagcagacatttgagtttctccggctaatgcatgggtctctgttcctaatctgtgcctcactaaagtccagggctaycagcctcttccctgagcagaggtcactgaactgagcactgggtgtccagagggtgaacccactcagggcagctgtcatcaaagcctttgcccacttctccatcttgcagctccctccctcttcactttcgtccctggagggtccccttattttcttatgagcctgattatgcacttaaatgatacgtttggtgttttaatcagaatctgcaggtgtgtgattaacaggaaagatcttcataatgttcaggccaccatgtctccagcagtgaaagtacttggagagacccttgaagagtga

SEQ ID NO: 20665 - DNA, 601 bp, Human
ggagggtccccttattttcttatgagcctgattatgcacttaaatgatacgtttggtgttttaatcagaatctgcaggtgtgtgattaacaggaaagatcttcataatgttcaggccaccatgtctccagcagtgaaagtacttggagagacccttgaagagtgagtgggactgtccagatgtgtagaaatgagagccggagggagccacaggggcgtggggcagcaggaccagggcatgtggaaggtcagagtgtgagctggcgtagaggtggagctgagaaaagagactagaggcaggrgagctttgcagttcttctaaggaatatggacttcaaaaatggttaaaggtggttttccaacttttctttttagtaccaaaacacttttttatttaacaaaaattaccatgactacatgatccagcaattccacttctgggtatatatcccaaagaaataaaaacagggtctgaaacagatacctgtacatctacattcaaaataacattattcacaatagccaaaaggtggcaacaacccaagtgtccaccaatggctgaattgataaacaagatgtggatatacaatggaacattactc

SEQ ID NO: 20666 - DNA, 601 bp, Human
agctaggctgggtctagggaaccacaggcagcattttatcccctagaatgcctgtacttcatcaggtgtgtcctaccacagactgggactgggcagagcaagctggccactgagtgtatgcccacagccctcagcaaacatcttccacctgattcagagtctttaattacagccatcctcttccaaaaggtgtccttgtccctatgtgattgcacataataggaagccactttagggacgatgttggggcaagtaaccctaaggctgtccccatctacaccaccctcaaaatcaaacagaycagaacccttaggacatatctaatacagaatttgggttttctctctctaactcacttcaggaaaatccctaatactcagaaggttttgtgtgatgcctatgtagactattctgtttcctgtgtctatttcagtggtttggggttcctggtttgaccacgtgaaaggatggtgggagatgaaagacagacaccagattctcttcctcttctatgaggacataaagagggtgagtgaaggctctgcagaagaaccattttaaagtggttcttcaggtgcagagaaattcaaagttgtttcaa

SEQ ID NO: 20667 - DNA, 601 bp, Human
tcagaacccttaggacatatctaatacagaatttgggttttctctctctaactcacttcaggaaaatccctaatactcagaaggttttgtgtgatgcctatgtagactattctgtttcctgtgtctatttcagtggtttggggttcctggtttgaccacgtgaaaggatggtgggagatgaaagacagacaccagattctcttcctcttctatgaggacataaagagggtgagtgaaggctctgcagaagaaccattttaaagtggttcttcaggtgcagagaaattcaaagttgtttcaraggacatcccagagaattgtagtatttctttatgatactctcattcattccagtccaatgttacccttgccgcaggacccaaagcatgaaattcggaaggtgatgcagttcatgggaaagaaggtggatgaaacagtgctagataaaattgtccaggagacgtcatttgagaaaatgaaagaaaatcccatgacaaatcgttctacagtttccaaatctatcttggaccagtcaatttcctccttcatgagaaaaggtgtgtggggcctctttatcatacattcagattgtctcgtaaca

SEQ ID NO: 20668 - DNA, 601 bp, Human
attaggttatatctatattaaaaacaaaatttctgtcatctgtcctggccattcaggcaactccagcctgggctcaatcctggagttctgtctggtcactatcagaaggaacactttgagggaaaccctggtgcagccagccctgaggaaacatggcctgagtgccctcactggtgggtgggaataaaatggaagtgcacagaggagatgtcagaagaccaaaacttggtgaatagtcccagtgctaggtcatataggaaacagaaagcatgacagtggccttttgggaacccaagttacrtcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatctatacctctcactcaattgttaattctttgggttcagtctcatgccatatttactcctagtacctaatgcagtgcctggcacacagcaagtg

SEQ ID NO: 20669 - DNA, 601 bp, Human
tgtcagaagaccaaaacttggtgaatagtcccagtgctaggtcatataggaaacagaaagcatgacagtggccttttgggaacccaagttacatcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatytatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtag

SEQ ID NO: 20670 - DNA, 601 bp, Human
agaccaaaacttggtgaatagtcccagtgctaggtcatataggaaacagaaagcatgacagtggccttttgggaacccaagttacatcctggtgaaagcagaaaggaggagacaggatggctgtcaacaacgtcagcatgggcatggctcccaggcatggaggtaattgggtcttggcttcaatgccacccttttgggaagccctaaaccaagtgaggtgttcttttcccttgcttcccatatttgtcccagttgcagccctgttgttatgtatttactcttcaatttcttatctatacctctcactcaattgttaattctttgggttcagtctcatgccatatttactcctagtacctaatgcagtgcctggcacacagcaagtgcccttgagaacttgtagagggagtaaaaaagtgcatggataaatgactgcagcaaatcacaaattttgaactttgacccttttcttttagtcccaaatagtggcattccatagctgagggtagtaggagcagttcaccctgggagcagacaataagaggaagaatgaagccaactaaaattctgaatgctttttgttggatttcgtagggtattt

SEQ ID NO: 20671 - DNA, 601 bp, Human
taaaaacatcaccaccaccaccaccaccaccaccaacaaaaaaacccgtagacttgtccctgttacaggcactaggaacacagcagggaacaatcaaaaagtccctggtctggccaggcaaggtggctcatgcctgtaatctcagtacttcaggaggccaaggcaggaggatcacttgagcccaggagttcgagactagcctgggcaacatagcaagacccccgtctctactaaaaaaataaaaaaaaaagtccctaccctcctgggttcagagtctggttggggaccccaggagctgggkgctctggagatcaggagatcacagaaatggggagggacccagagagtggtggataggatgggaagtaaatgtctctagagagggaggccagggggtggagggcgcttcgtggaggaggtggcctttgagctaaggcctgagcactagagaagagctctctaggctgagggagcggcctgtgcaaaggcccaggggacctgaagggctcaaggggctgtagcagggggtggggaatgtggctggaaggaaccccatcaaggtcttggagcggcaggagagggggtgggagaaggcaggctc

SEQ ID NO: 20672 - DNA, 601 bp, Human
aagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccaca

SEQ ID NO: 20673 - DNA, 601 bp, Human
gctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgcyaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaa

SEQ ID NO: 20674 - DNA, 601 bp, Human
gccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcrtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagg

SEQ ID NO: 20675 - DNA, 601 bp, Human
ggcgggggacgggccagacacctcctcgagcctccgaccctctccgggccaggctggcaggcacgccagcctctgccccctcggccgtgccgggcctccccgggatctcacctgggttgaccgggtctcggccccggggccggtcggaggctgaggccgcagggggcagcagcagcggcagcagcagcaggaaccggggtccaggccccgaggaggtcatggtggggagcgggcccagacagcacccaggatcctgggatctccgctacgcgcctggatcccagctccggaggggagctcyggaaagggggcgctcgggctgctgtgcggccgccgcggggagcagcttggctggggctacgccctgaaaaaaaggcgtatccggaggctacagaaagctccagatgccggcgccacagacaaggcgaggattgtcccgggcgcacgggaggcgggggaggggcggcggctcgggccggcgggcgggagacagggactctgggctgagccagccgcttgacacatgtggaagctgaaacctggacaggggaagtgacccctggcggagggtcgggcgggacgcgggggcgggtcctggccg

SEQ ID NO: 20676 - DNA, 601 bp, Human
agtgctgggattataggcatgagccaccatggttttcctttttttgtgagagacagagtctcattctgtcacccaggctggaatgcagtggtgcaaaacatcctcaaactcctgggctcaagtgatggtcccacctcagcctcccaagtagctgggattacaggcgtacaccatgaagcctggctaattttttctttctttttttttgtagagatgaggtctcaactatgttgtccaggctggtcttaaattcctggactcaagcaatcctcctgcctaagcctcccaaaagtcttggatkacaggcgtgagccaccacgcccaggcacacatttttctctttgcaaccccctttgctccccaaatcccattcagcctgaggcctccactcccacagagctgcgggatgcgcccactcctctgccttccctaccctcagtcctgggtccaggtagagccgtgtgtagaacagctggtcgtcgtcatcatccttgtacttccactggcgcacgatttggtggatggtggtggcaaaaccgatgaatcctggcggggagggggagtgttgacctcgagactcccagggtcccagggcctgtcc

SEQ ID NO: 20677 - DNA, 601 bp, Human
ctctgccttccaaagtgctgggattacaggcgtcagccaccgcggccggcccttgttttttattttcttgagaaagggtctccctctgtttccaggctggagtgcagtggtggaaacatggctcactgcagcctcaacctcccaagttcaagtgattctcccacctcagcctccgtagtagctgggaccacaggcacgcaccaccgtgcccagctaatattttaagttttttgtagagataggctcttgctacgttgctcaggctgatcttaaactcccaggctcaagcagtcctcctacytcagcctcccaaagtggtggcatcaaaagtgtgagccactgcagccagcctcatggcacctctgactggtgaccactccaaacccctgagagtagggggcttgggtctacctgggccccgggtcggaggaggcggggggctgcaggctggcgggactcacactcgcttccgctgcaccagctccacgtagtcctcggagcgggcgtagtactcatcggggctcagggcgccccagaagttggaccacagcttgccgtggcgggacagcatgggggcgatcaccttcctgcggacaggtgg

SEQ ID NO: 20678 - DNA, 601 bp, Human
ccagccaccatgcccggctgatttttgtatttttggtagagatggggtttcaccatgttggccaggctggtctcgaactcctgacctcgagtaatccacctgcctctgccttccaaagtgctgggattacaggcgtcagccaccgcggccggcccttgttttttattttcttgagaaagggtctccctctgtttccaggctggagtgcagtggtggaaacatggctcactgcagcctcaacctcccaagttcaagtgattctcccacctcagcctccgtagtagctgggaccacaggcacrcaccaccgtgcccagctaatattttaagttttttgtagagataggctcttgctacgttgctcaggctgatcttaaactcccaggctcaagcagtcctcctacctcagcctcccaaagtggtggcatcaaaagtgtgagccactgcagccagcctcatggcacctctgactggtgaccactccaaacccctgagagtagggggcttgggtctacctgggccccgggtcggaggaggcggggggctgcaggctggcgggactcacactcgcttccgctgcaccagctccacgtagtcctcgg

SEQ ID NO: 20679 - DNA, 601 bp, Human
atgttggccaggctggtctcgaactcctgacctcaggtgatctgcctgcctcggcctctcaatgtactgggattacaagcatgagcaccactcctggcctcatttcttatttaatttttttgttgttgttgtagagacagattctcgctatgttgcccaggctggtcttggacttctggcctcaaccgatccacccaccttggcctcccaaagtgctgggattacaggcatgagccactgagcccagccccattcttcttttaagatgtgatttcaagcataacaccagtatacccaatayacaggagaagaggctgtctgatcaatgctggctttgggggcaagagtcctttctgttcggcctctgccttcatcttgtctgaacagaaaaccctcagatctctggggaactcagtgtgaaaactttgaatccaggcgggggcccccaagaggcgatggccatgagggcagggggtgggtggggaggctgcgtgggctcacctgctccacgattccttccccttccagggcccggctgtagttctcgtggatgtactgctccttccagtcctgtgagagggtggggggcacatcagatctg

SEQ ID NO: 20680 - DNA, 601 bp, Human
caaggctgaggaccggtttctggcacaggagaggtggcagagggtcctggagcccctcgtgctgggacagtggtttccaaacttccgtaacagtgcatacctcttttttttttttttgagatagggtattgctctgtcaaccaggctggagtgcagtggcacaatcatagctcactacagcctcgaccttctgggctcaagcgatcctcccgcctcagactcccaagtagctggaactacaggcacatgccaccatgccaagctaattttttcttttcttttttttttgagacagggtctygctgtgtcacccaaggtggagtgcagtggcgtgatcttggctcactgcaacctctgcctcccaggttcaagcgattctcccacctcagcctcccgagtagctgggactacaggtgcacgccatcacacctgactaatttttgtgttttttttttttttttttttggtagagacaggatttgccatgttggccaggctggtctcgaactcctgacctcaggtgatctgcctgcctcggcctctcaatgtactgggattacaagcatgagcaccactcctggcctcatttcttatttaattt

SEQ ID NO: 20681 - DNA, 601 bp, Human
gcagcaggcagaatgggaaggggcagggaggagcagggaaggctttgtgagagcagccggggacccgccaggtaggggctgagggagtggcaaggctgaggaccggtttctggcacaggagaggtggcagagggtcctggagcccctcgtgctgggacagtggtttccaaacttccgtaacagtgcatacctcttttttttttttttgagatagggtattgctctgtcaaccaggctggagtgcagtggcacaatcatagctcactacagcctcgaccttctgggctcaagcgatcctccygcctcagactcccaagtagctggaactacaggcacatgccaccatgccaagctaattttttcttttcttttttttttgagacagggtctcgctgtgtcacccaaggtggagtgcagtggcgtgatcttggctcactgcaacctctgcctcccaggttcaagcgattctcccacctcagcctcccgagtagctgggactacaggtgcacgccatcacacctgactaatttttgtgttttttttttttttttttttggtagagacaggatttgccatgttggccaggctggtctcgaactcc

SEQ ID NO: 20682 - DNA, 601 bp, Human
tgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggatgcacgcaggggctctaggtggggacccgagggtcctgaggtgaagcgtgggtgggtagtgtgrctggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttttgagatagtctcgctctgtcactcaggctggagtgcagtggtgcgatcttggctcgatcttggctcactgcaacctctgcctcc

SEQ ID NO: 20683 - DNA, 601 bp, Human
cacagtcgtagcgcaggaagcggcagccacctccctggaaagagaagggaaaggaaacatggagtgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggrtgcacgcaggggctctaggtggggacccgagggtcctgaggtgaagcgtgggtgggtagtgtgactggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttttgagatagtctcgctctgtc

SEQ ID NO: 20684 - DNA, 601 bp, Human
cttcctcggggaggagatcacacagtcgtagcgcaggaagcggcagccacctccctggaaagagaagggaaaggaaacatggagtgagcagacgtggggcctggggagcaggcagatacacggggcagggcggccagaccggggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatggrcagggaggggagctgggggatgcacgcaggggctctaggtggggacccgagggtcctgaggtgaagcgtgggtgggtagtgtgactggggcgcacctcatagtccaggcccttgtggttgagggcaacgttgagggtgaaggtggatgagtcgtggtgtggccgcagagacggctgctcgtctggccggtagcgaaccacaaagttcatcaccgcccgcgcctgggggagaggagggaagaggctgcagggacagctgcgggcgcagggggtcttttattttgtattattattattcttt

SEQ ID NO: 20685 - DNA, 601 bp, Human
gggccaggccccctaaaaaggcacaatggcagggcaggtttggcagagtggttgagtgtcaggggtcgacaaaggacaccatgatgtagcgtgtgccccaggtcgttggcagcccctcgtggtagtgggtgaggcggccggggtgcaggagtgcccagcccttcctcggggaggagatcacacagtcgtagcgcaggaagcggcagccacctccctggaaagagaagggaaaggaaacatggagtgagcagacgtggggcctggggagcaggcagatacacggggcagggcggccagaccrgggggcacggtgcagcagaccggggtgacaagggagatggcagatatggcagacaccggaggctggggtgcctgcagacaggaagatccaggaggaagcagaggccgcctgcccagaagcgatccaggagctgatacccacaaagtcactgggaaatgggcagggaggggagctgggggatgcacgcaggggctctaggtggggacccgagggtcctgaggtgaagcgtgggtgggtagtgtgactggggcgcacctcatagtccaggcccttgtggttgagggcaacgttgagggtgaa

SEQ ID NO: 20686 - DNA, 601 bp, Human
aagcactcccaccaccacacccagcaaagagagatttttccagaaaaaatggggtcacagatccctaagctcagtaagtcctcaggagatgccctttcaccccttgctctggtgcgggctgtgcctgaacaggcaccgaccttgcccactcttggcctcctctggagggtgacacaggacctgcgcaagtgaaagggctccaacaagtcacggctgtggcagagcttgacggggaggggaaaccgggtagaagggaggtaaccattctgcttcatgagccttgaggaaggcacagtgactyagcctcaggacatgggtccgggcgcagggaatgggtggagaagtggggagccagggcttaatcagggaaacttctccacgcagactctcctggctgaggaccacaggcctgcagagctaatcagttcgagtgattccctggcggcggctgtggcgagacagccctcatcctagtaagtcccaaaacccccgcctggcctgtgcgtcactgctgagtcagggaccagacagcaatccataagaggtaatgagccactcctgctggcccaacgctgctgccagctcagatgtctgatgtccc

SEQ ID NO: 20687 - DNA, 601 bp, Human
ctggggaagatggtctaccatgtactgggagaggaaaccaatccccacggtctcattttctaaaacccagtgaaaaccattcatccagagacttgtccaccatcttttccccgaggacaagaggaagaagcctctaccccactggctggtggtccagactgaatcagtatgaccaaccccagctgaggggtggggcctgcctgcaggtcgttctcatccctgcacttggaagtcccctttgttaccagtcctaactcctctctgctgtagaccaagccctttccttcccctctggactccygagtccgcagcaccctcagatcctcagtgcagcttcagggaccctggtccctctgactgtcctcatcagcttgacttctttcctcaggttacggtggacaaacccaaggttccaggagggagaagacccagcctggagccgcctcacacatacctgactgtgggggacgaagggctcgatcagaaagttcttgaggaagcctgtggccttgccaacctacagaaaaattgagggagatgaaactcagagggacagcacgtcttgcccctagggcagaaggagggactgcacaggggtggt

SEQ ID NO: 20688 - DNA, 601 bp, Human
ccctggacatagctcttcagccactgaggcggaaaggagctgtcaggcgagaagctggaggcagaggtgtcagacagacaggggcaaggaggtgagggatgctggcggcatatttcagtctggttccaagccagtccccgccctgcacccagctgtcttcctcaggacagggccgtgtctaccacctggctcccagagaggagaccgctctgctctccccagtctgtgcccagagcctgtcggtcttctcatccgaactgccacctccctaccgtccctctcactcaactctttcttgtcktcaggggcgtggaccaacaggtgttttttgatgtcctcaggattcagtttctcatccacgccaacaagcagcttctgggccttggcgtccacatcacccacgtccacacccccctcgtggtggaacaggacgtagtccccttctcgggtggcatagatgcagacatagaactcctcagccttgcaggtgaagagacaggacagtgggattggggttgtgggggcgaagctggtgaggggcgctgaactggggaagatggtctaccatgtactgggagaggaaaccaatccccacggtctc

SEQ ID NO: 20689 - DNA, 601 bp, Human
gggctgtcataggcactgggacccttgccccctcccagccaagcacacccagttaccaaggggattgatctcgaggtaggtgaagtacaagtcctcgtagaaattgaagaggccggagataaaactggccagaattctagaggtgggagggagagagggacagttcatccatcagggagcagctcggcagcaccccaggcgccccgcagcaatctctcactgccaccgacagctccatttccctaaacgcaccccactggcccttccatctcctctgcaacccctgctccctggacatagmtcttcagccactgaggcggaaaggagctgtcaggcgagaagctggaggcagaggtgtcagacagacaggggcaaggaggtgagggatgctggcggcatatttcagtctggttccaagccagtccccgccctgcacccagctgtcttcctcaggacagggccgtgtctaccacctggctcccagagaggagaccgctctgctctccccagtctgtgcccagagcctgtcggtcttctcatccgaactgccacctccctaccgtccctctcactcaactctttcttgtcttcaggggcgtgg

SEQ ID NO: 20690 - DNA, 601 bp, Human
tcctggccagagccagcccacgccactctccctcaacaccacctgcttccttcacagcccaagagactgagaccaagctcttcccagcatcaagggttaatgattgaccaactcccacagagggaggcaagtgtgaggcctctgagtgtaccaggaggaatgaagggccaaagggtgagagcagtgcagaggctgcccacctcctgctgtcagaaagcctgacctggcgggaggagcagaagcacacagtcagatcaaaaccaggacttctggccgggcgtggtggctcacgcctgtaatmtcagcactttgagaggccgaggtggacagattacctgaggtcaggagttcgagaccagccttggccaacatggtgaaaccccgtctctactaaaaataaaaaattagcctggcgtggtggcgggcacctgtaatcccagctactcggaaggctgaggcagaaaaattgcttgagaccaggaggcggagattgcagtgagctgagattgtgccactgtactccagcctgggcgacagggcaagactctgtctctaagaccaaagagagaggttggagttgactaagagaagaactacagtc

SEQ ID NO: 20691 - DNA, 601 bp, Human
agcaattaaaattctcagtgagacgcggagagaatgaccttccatcaggattaaggcgagacacttggaatcatggagaggcaacaaatcaagtgaagagtcgagggaggctgattgagagagaaatctaaaaggatttctggctgggattcagaggcttggctcactcccacccccaccccattgaggttttaagaaaattaaatgcttctcagtcttcctttccctgccaaataaacagctcatgaaggggggccaaatgcacatcaaagatgagtcacctccccaccgccctcccccsagtccccatctcctctctaaaccagccttacctctggatatgcctcccgcccgaaggggggagggaactcgatgtcaccccacttcactttgcagatgtagtcggcagtggcgtccaccttggccgccaagtcaaggacatagactccatctttggtcactacttcaaggggagcagaggcaatcatcagacaccggctctgggtagagacaaccaccaacctccaacccctccacaaacaccgatcccatggtggcccattcaggcctcagaactctctaagctcagtaagaaaccaga

SEQ ID NO: 20692 - DNA, 601 bp, Human
ctgcctgctcggcccatcacacgtccccccaaccccaggcctccccagacgagaccgtctcctagcccagcctcttccctgggcctggggtacttcccagaaagcccagtcctgctgtgaggacttctcagaggacagagtgggaaagagcaattaaaattctcagtgagacgcggagagaatgaccttccatcaggattaaggcgagacacttggaatcatggagaggcaacaaatcaagtgaagagtcgagggaggctgattgagagagaaatctaaaaggatttctggctgggattcagaggcttggctcactcccacccccaccccattgaggttttaagaaaattaaatgcttctcagtcttcctttccctgccaaataaacagctcatgaaggggggccaaatgcacatcaaagatgagtcacctccccaccgccctccccccagtccccatctcctctctaaaccagccttacctctggatatgcctcccgcccgaaggggggagggaactcgatgtcaccccacttcactttgcagatgtagtcggcagtggcgtccaccttggccgccaagtcaaggacatagactccatct

SEQ ID NO: 20693 - DNA, 601 bp, Human
gtacacgacagaggcgccacccccggccaccatggtccagatcctccctttggggttcagcaaggtcagcttcaggcttgccccacttttggcatcgaggtctgcaatgtaggcttcctggggaccagacagcaacaggtaggcccttggggtaccccctttaccaggtcccagatcctaggacccctccccgctttccctggaagcacatgaaaaggtgccttaatggggtgggaagaaggggctacgcagggccccacatgccttgaagacacttgatggtgtctccaagtaccaaaamcacccatagtcacagtcactgcctagggacaaacttcccatctcccttctctgacgtcaagtacttggccctctgcctaagtcctgagcctaaccatgtccctctgctcaaccatgccctcaccccagcatctgcctgctcggcccatcacacgtccccccaaccccaggcctccccagacgagaccgtctcctagcccagcctcttccctgggcctggggtacttcccagaaagcccagtcctgctgtgaggacttctcagaggacagagtgggaaagagcaattaaaattctcagtga

SEQ ID NO: 20694 - DNA, 601 bp, Human
atatgcttgacaggacatacagtaacttgctaactggggtgacctggtcagggagaggatggggaaatgtccaggcaactttcactttctagctcattttctgtacctttgtatggagcacgtaattttcagaattaaaactcataaaacagcttcattttgacacaaacaagaaggttatagaagacactgggtgcaggacaggccctcaccaacatccctcgaagccctctgggatgccactgctttcctctgccccaaattcccacaccaaagtgacaggaccccacccacccaggcyacacacatgttgatgctgggtagactgggctggcatcccttcagcaacccccttcggtcacctgtacacgacagaggcgccacccccggccaccatggtccagatcctccctttggggttcagcaaggtcagcttcaggcttgccccacttttggcatcgaggtctgcaatgtaggcttcctggggaccagacagcaacaggtaggcccttggggtaccccctttaccaggtcccagatcctaggacccctccccgctttccctggaagcacatgaaaaggtgccttaatggggtgggaa

SEQ ID NO: 20695 - DNA, 601 bp, Human
agtaagagagaatcaaaaacagttacataggtagacttgagcatcttcccagcaatccaactgaggaagttcttgttcccctgaatgagggtcccccatctgccaggaggtactggggagtgagtaggacagtctctccagacattccactttatcagctcaactctccattacctatgccaccagacaggggtcagaacaaacccacaggagcactacataactcctaaccaacatccaaaaatccaggttggtttctagatatctctggagggaatctctctccctctctggctcaagkaaagaagaactggtatgcagagctccaaaacacaggtggtaaaggggcactgagactcacagaggccaggtaatataagagggtcactgagtttattgcaatcagagtttatcgcaatcggataaactgagtttactgcaattgtagcaggagcatgccacagccacctcctcccctgcacttgtttgaagggctttatcacacatcgcctcttgccctctcagtcccctcccactgatagatgtggtccctgccctctgtgcagtcagagaaactgagagccaaagttcaatgattagc

SEQ ID NO: 20696 - DNA, 601 bp, Human
cacccacactcagggtgagggggagagaaaaggtcctcatcttaccgacttctcccatcacccgtaagccctcctgatagttggggccacctcttcggacaaagattgtgacttcgtgctccttcagggggccctggtaatctcgaattgctctcacgatgccctggaagcccaaagtgacatgtgactaaaaacaaggcagccacaagtcaatgatttataaccgtgataaacaaacataccaggtatatgtgacaagtgctgctcctcaggaagcacaggactacgcataagcagccamggcctggaatatgatcactcagaatgttgctgaggtgggaacgtggggtacccgggattgacatcccttaatgtcatggtgctccaggcctccatcatcagcaaggccttgctggtctctcttttgtcccttctgcagtcattactgcctcttactacatttttgtttttggtggggatatctatgttgggctctatgcaagggttctcagaggtactaagacatagtcaatgtcctacaaaagcttcttaagtgatgtgcgggaatagttctttcttttgagacaaattctcgctctgt

SEQ ID NO: 20697 - DNA, 601 bp, Human
tttttttttttgtagaggcagggtctcgccatgttgcccaggctggtcttgaactcctgagctcaagggatcctcccacttcgacctcccaaagtacatgagccacctgtgcccagccttgatcaagtttgatcaagcattttctgatctccctgttgaaggctgccccgacccctcccacatgcattctccctttccctgctttgttttccttcctggcactcggcaccccctgacatagcagtttgtgtcctccgttccatcaaggcttgctgtctgtccatttgtggctgtaaccctygtcaccagcacaaagcccagcacagagcgagtgatctttaataaatatctgttaagtgtagagctcaatgaaaatgctttcctgaccactccaaagtttaggatagcactctgtgttgggacagggaatggaaacccaaactgcacacccaggaaggggagtagagagcaaaagagcctaagactgatgctcaggaatcagaaatcccaaagaggaaggccacccacactcagggtgagggggagagaaaaggtcctcatcttaccgacttctcccatcacccgtaagccctcctgatag

SEQ ID NO: 20698 - DNA, 601 bp, Human
ggtggtgcacacccgtggtccccaatacttgggaggctgaggagggaggatcacttgagcccacaaggtggaggccgcaatgagctatgatggtaccactgcactcaagtctgggtgacaaagcaaggcactgtctcaaaaaataataataataataaatatgtggttcctctgcttgaacacttcttgtgcctgctgtctcacagtgatggccaagtcctcctgtgacctgtagtgtctcgctgccactctctcagtcccagccccttaccactgcagggtatgggaatttgcccttccytctccaagagtcaccatggcgctgctccctcattccaggtctttgctcaaatgtcagttttcttttctttcttcttttttttttgatacagggtctcactctgtcacccaggctggagtgcagtggcatgatcacggctcactgcagcctcgacctcccaggttcaggtgatcctcccacctcagcctcccaagtagctgggactacaggtgtgtaccaccatgaccggctaatttttgtatttttttttttgtagaggcagggtctcgccatgttgcccaggctggtcttgaactcctg

SEQ ID NO: 20699 - DNA, 601 bp, Human
caggcgacactctctccttgacaccactacactctccagggctgtgggtctggctcttgctccttccaaaatctctaccccttcccaagcttggagccagaaacagccacacagtgaggagaggactgagtggggcgcgtactgagcacggataggaggggaggaagagcgaagacttaggacttggggtcaggccacatcaaggcagggacagaaaatagaccagacgacactgcaacccaccaggggagggggaaacagagcacacagtaaaactgtcacccgctaacaaagccacacrcggagtgggggcagggtgggggcatcctaccttgcagggatcttggacttgggactgaatctgtcaaagaaaatgaccaaggcaactgagtgacccactgatggctggaggctttggagggagagggtgggaacagggaagggtcccatggacaagcctttcagggctaaagccctcaccatccctctcctgttctgcaatggacaacggagtaaggccagcagaagaggtgaaagcaccgatgagcagaatggaagcaagaaagagcaaagaccaaacgggcagagagggggcaggagg

SEQ ID NO: 20700 - DNA, 601 bp, Human
cagaaaaagataaactggtccctggagcttgaggatgaagctggcagtggtgaagccgaggcaggaaaggtgggaaaatgacatcaggagatgtaaatgagaagcaggggtgacttgtggctccccttctgcaccccagcagtgacagacgcccacgactctctgccactccccatttagttggatggctccctccttcccaggcgacactctctccttgacaccactacactctccagggctgtgggtctggctcttgctccttccaaaatctctaccccttcccaagcttggagccagraacagccacacagtgaggagaggactgagtggggcgcgtactgagcacggataggaggggaggaagagcgaagacttaggacttggggtcaggccacatcaaggcagggacagaaaatagaccagacgacactgcaacccaccaggggagggggaaacagagcacacagtaaaactgtcacccgctaacaaagccacacgcggagtgggggcagggtgggggcatcctaccttgcagggatcttggacttgggactgaatctgtcaaagaaaatgaccaaggcaactgagtgacccactg

SEQ ID NO: 20701 - DNA, 601 bp, Human
tgtatcctcagcccaccagcagcagagaggctccacagagaacctctgtgccaggggctatgccccctacaccaggcctcctctggcctcgctgaggggagggctcgctcagccataatctgttctccctgacacaccctccttttatttctctcactccagaaagtaacaaggataacccccctcctcataaccctcctccccttcagagcacagagagctcctggagaaccagggctggtccctgttctttccacactgggctcactctgctcttaactttttccagaggcaaaaacaycaggattaaagccaggtggccacagtgctgcattccaggcctttccagctggttatcgaccctgccaattactccttcccctccccttagcaaggggacaacaaagacttccccgcctccacggctgtgaatgtcaaagttaaatggacgctctgatgccatgaaccaattaatctactcagctaggctggtgggtgaatgcgcatgcacagaagtatccactgtaaaatgtgacctcatacaccagacaaagctcataccccttccaattacccagtcactagatccgctgcacaccct

SEQ ID NO: 20702 - DNA, 601 bp, Human
tctggccagggctctgcacaaggcaggagcagcaagctagttacacagggccagtgccctcaacctgctctcctgtttttcctgtccttctcccttctaccaggtggctctttcctgctcaggacagtgctcttggacagaccctccagtgggcacttaagaggtaaggcgcaggtcaggtgtggtggctcacgcctgtaatcccagcactttgggaggctgagaccagtggatcacttgagctcaagagttcaagaccagcctggccaacgcggtgaaacgctgtctctaataaaaatayaaaaattagctgggtgtggtggggtggacacctgtaatcccagctactcaggaggctgaggcagggagaatcgctcgaacccgggaggcagaggttgcagtgagccgagatcgtgccagtgcactccagcccaggtgacagagcgggactccatctcaaaaaaaaaaaaaaaaaattagcgtggtggcatgcacctgtaatcccagcttcttgggaaaccaacacacaatcacttgaaccaaggaggcagaggttgcggcgagccaagatcgcaccactgcactccagcttgggccacag

SEQ ID NO: 20703 - DNA, 601 bp, Human
ctgcaaagaatggagaaagaagggccccacagtcaaagatgcccaggataattcctataggacctgcttcatttcccaggcaaggtgtgtcatcagcttatatgcaaatgaggtcttaacaaattatttttaaagtcattggaaaaaaatgcttagctcgcccaattttggtgggttcaggacttatgttccaacaatgcttattaccctgtaaatctggacataaaaccagctccagtcagggtttgaatcagcatgaattctaggtcagtgtaggtccaaagaagaggtttgtgcagcyggggctgaggacacagcagccttatcgctaactgtggttctggccagggctctgcacaaggcaggagcagcaagctagttacacagggccagtgccctcaacctgctctcctgtttttcctgtccttctcccttctaccaggtggctctttcctgctcaggacagtgctcttggacagaccctccagtgggcacttaagaggtaaggcgcaggtcaggtgtggtggctcacgcctgtaatcccagcactttgggaggctgagaccagtggatcacttgagctcaagagttcaagaccagc

SEQ ID NO: 20704 - DNA, 601 bp, Human
aagccttccccagcaaagggaatgagctcactgactcctcaagccttgccttttttttttcttttgagacaggttcttgctctgtcacccgggctggagtgcagtggcataattagagttcactgcagcctcaacctccaaggctcaggcaatcctcctgcctcaccctcccaagtagctgggactacaggtgcacaccaccatatccggctaatttttaaattatctgtagagatgggggtctccctatgttgcccagggctggtctcaaactcctgggctcaagcaattctcccacctygacctcccaaagcgctaggattacaggcatgagccactgtgcccagccccaagctttgtcttagcagaggaaggagatatttcccgccatggggtaactcacgtgaaagggtagaccatggcagccactgagggctcgtctcgggagcagacatagtcaaagtccagcatgccttgcacggcccgggtctgcatgccccacacaatggccttggtgtggcggctgaagagggtggtgctctttcctggtgggcaaagacacagagagtgcacccagaacacatacccccgggagacctgc

SEQ ID NO: 20705 - DNA, 601 bp, Human
ttctggccaggctggggagagaatgaccaagagaaatcacacttgcccactgggtttcctgcttaggaaagtctcctctctctctcaagagacatacagaacaaaagagagccttatttgtaaagcatggctcactaattcaggttcagatacgtatacttggcccggcacagtggctcaggtctgtaatctcagctctttggaaataaatactagctccatttttttaatacagtaagaagtaaaaataagccaggtgtggagaacacttctggaatcccagctactcaggaggctgagrcagggagattgcttgagcttaggagttcggggctgctgaagtgtgttataactgcacctgtgaaaagccactgcactccagcaacacagcaagaccctgcttcttaaaaaaacaaacaaaaaataattcaaagaataatttcagccaggcatggtggctcacgcctgcaatcccaacacttttggaggctgtagggggcagactacctgaggttgggagtttgagaccagcctggctaacatggtgaaaccctgtctctactaaaaataccaaaattagccaggcgtggtggttcacacc

SEQ ID NO: 20706 - DNA, 601 bp, Human
cttggtgagagttcttcctcacccaggcatcctatcggaaatcatgtggtagagccagggagacgaacaaggtgactctatctcaacagcttttggtttctaagcccgacagcagtagtaatagtaggaataataaacaataatggctaacatttattatgaacctactaagtgccagacgttactctgagatataatactgtattcatgacctactgatcagtgttcccactaccaaaaataatgaggatactattattaactacaataaaaactcactgagcacctgctgaacgcaggycctggctcagacacttatatgtattacaattcatttattcctccagtagccccatgaggtgggggtattatttacccatttgatgtgtaaaaatgatggaggtctagggaggttaagtaaccggaccaggatggcccctgccacccaccccctactaaagagggaaaatgggatttgaacctctttagtccaatttcagaactggccctcctaaccactgtactctgctgcctccctatggccaatcacaacaaacagaattatccccaaagcccagtcgcccctcctgcacattgttgc

SEQ ID NO: 20707 - DNA, 601 bp, Human
tcctccctcagccccccaaagtgctgggattataggcataagccactgttcttggcctcttcatgtcttttgatatgatcattataaatctaagaagacaatctaaacaagcagcatttcctagacttattccctgagcctttggtcaggcagtacccaaggactggggattcccaggctacacccctaaagaccttggtgagagttcttcctcacccaggcatcctatcggaaatcatgtggtagagccagggagacgaacaaggtgactctatctcaacagcttttggtttctaagccygacagcagtagtaatagtaggaataataaacaataatggctaacatttattatgaacctactaagtgccagacgttactctgagatataatactgtattcatgacctactgatcagtgttcccactaccaaaaataatgaggatactattattaactacaataaaaactcactgagcacctgctgaacgcaggccctggctcagacacttatatgtattacaattcatttattcctccagtagccccatgaggtgggggtattatttacccatttgatgtgtaaaaatgatggaggtcta

SEQ ID NO: 20708 - DNA, 601 bp, Human
tcagccttcaactcctggtctcaagcagtccttccaccttgacctccaaaagtgtcaacttgactggattgagggacacaaagtattaatcctgggtgtgtctgtgtaggtgttgctaaaagagattatcatttgagtcagtgggctggggaaggcagatccacccttagtgtagtgagcataatctaatcagcttccagcaaatataaagcaggcagaaaaatgtgaagaagagagaccagcctagcctcccagcctacatctttctcctgtgctggatgcttcctgccctcaaacatcrgactccaagttcttcagttttgggactcggactggctctccttgctcctcagcttatagacagcctattgtggtaccttgtgatcatgtaagttaatacttaataaactctcctttatatatatatatcctattagttctgtccctctaagagatccccgactaatacagaaggcctggtttccaagagttcaaggcaaatcaacgcgaaacccaccaccatagacccacagatctcccttgctcacactgttagagacatttaaggcacctaccctggcccaggagtagtccatgggca

SEQ ID NO: 20709 - DNA, 601 bp, Human
ccttttttttttttgagacggagtttcgctcttgttgcccaggctggagtgcaatggcacgatcttggctcactgcaacctctgcctcccaggttcaagcaattctcctgcctcagcttcccgagtagctgggattacaggagcccaccaccgcgcctggctaatttttgtattttttcagtagagatggggtttcaccatgttggccagcctggtctcgaacttttgacctcaggtgatccgcccaccctggcctcccaaagtgctgggattacaggcatgagccaccaggcccagccctttttttttttttttttttaaattacagacagggtctcactctgtcacccaggctggagtgcagtggcacagtcatggctaacttcagccttcaactcctggtctcaagcagtccttccaccttgacctccaaaagtgtcaacttgactggattgagggacacaaagtattaatcctgggtgtgtctgtgtaggtgttgctaaaagagattatcatttgagtcagtgggctggggaaggcagatccacccttagtgtagtgagcataatctaatcagcttccagcaaatataaagcaggca

SEQ ID NO: 20710 - DNA, 601 bp, Human
aattatcctctatgaatttttaaaatgctttacagttacatttttattacaaaaacaacatgaatatgttctctatctctctctctccttttttttttttgagacggagtttcgctcttgttgcccaggctggagtgcaatggcacgatcttggctcactgcaacctctgcctcccaggttcaagcaattctcctgcctcagcttcccgagtagctgggattacaggagcccaccaccgcgcctggctaatttttgtattttttcagtagagatggggtttcaccatgttggccagcctgatctcgaacttttgacctcaggtgatccgcccaccctggcctcccaaagtgctgggattacaggcatgagccaccaggcccagccctttttttttttttttttttaaattacagacagggtctcactctgtcacccaggctggagtgcagtggcacagtcatggctaacttcagccttcaactcctggtctcaagcagtccttccaccttgacctccaaaagtgtcaacttgactggattgagggacacaaagtattaatcctgggtgtgtctgtgtaggtgttgctaaaagagattatca

SEQ ID NO: 20711 - DNA, 601 bp, Human
ctgcccggcagccgccccatctgagaagtgaggagcccctccgcccggcagccaccccgtctgggaagtgaggagcgtcttcgcccggcagccaccccgtccgggagggagatgggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccaccaccctgtctgggaggtgtacccaacagctcattgygagcgagccatgatgacaatggcggttgtgtggaatagaaagggggaaaggtggggaaaagattgagaaattggatggttgccgtgtctgtgtagaaagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcagtgcaaggtgtgctttgttaaacagatgcttgaaggcagcatgctggttaagagt

SEQ ID NO: 20712 - DNA, 601 bp, Human
gtgccgagattgcagcctctgcccggccgccaccccgtctgggaagtgaggagcgtctctgcctggccgcccatagtctgggatgtgaggagcccctctgcctggctgcccagtctggaaagtgaggagcgtctctgcccggccgctatcccatctaggaagtgaggagcgcctcttcccggccgccatcccatctaggaggtgaggagcgtctctgcccggccgcccatcgtctgagatgtggggatgaggagatcctctgcctggcaaccgccccgtctgagaagtgaggagcccctcygcccggcagccgccccatctgagaagtgaggagcccctccgcccggcagccaccccgtctgggaagtgaggagcgtcttcgcccggcagccaccccgtccgggagggagatgggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccaccaccctgtctgggaggtgtacccaacagctcattgtg

SEQ ID NO: 20713 - DNA, 601 bp, Human
tcccggccgcctgccttgcccttccaaagtgccgagattgcagcctctgcccggccgccaccccgtctgggaagtgaggagcgtctctgcctggccgcccatagtctgggatgtgaggagcccctctgcctggctgcccagtctggaaagtgaggagcgtctctgcccggccgctatcccatctaggaagtgaggagcgcctcttcccggccgccatcccatctaggaggtgaggagcgtctctgcccggccgcccatcgtctgagatgtggggatgaggagatcctctgcctggcaaccrccccgtctgagaagtgaggagcccctctgcccggcagccgccccatctgagaagtgaggagcccctccgcccggcagccaccccgtctgggaagtgaggagcgtcttcgcccggcagccaccccgtccgggagggagatgggggtcagccccccgcccggccagccgccccgtccgggagggaggtgggggggtcagccccccgcccggccagccgccccgtccgggaggtgaggggcgcctctgcccggccgcccctactgggaagtgaggagcccctctgcccggccaccaccctgtc

SEQ ID NO: 20714 - DNA, 601 bp, Human
ccgggattgcagacggagtctcgttcactcagtgctcaatggtgcccaggctggagtgcagtggcgtgatctcagctcgctacaacctccacctcccggccgcctgccttgcccttccaaagtgccgagattgcagcctctgcccggccgccaccccgtctgggaagtgaggagcgtctctgcctggccgcccatagtctgggatgtgaggagcccctctgcctggctgcccagtctggaaagtgaggagcgtctctgcccggccgctatcccatctaggaagtgaggagcgcctcttccyggccgccatcccatctaggaggtgaggagcgtctctgcccggccgcccatcgtctgagatgtggggatgaggagatcctctgcctggcaaccgccccgtctgagaagtgaggagcccctctgcccggcagccgccccatctgagaagtgaggagcccctccgcccggcagccaccccgtctgggaagtgaggagcgtcttcgcccggcagccaccccgtccgggagggagatgggggtcagccccccgcccggccagccgccccgtccgggagggaggtgggggggtcagccccccgccc

SEQ ID NO: 20715 - DNA, 601 bp, Human
tcactgcaacctccctgcctgattctcctgcctcagcctgccgagtgcctgcgattgcaggcgcgcgccgccacgcctgactggttttcgtatttttttggtggagacggggtttcgctgtgttggctgggctggtctccagctcctaaccacgagtgatccgccagcctcggcctcctgaggtgccgggattgcagacggagtctcgttcactcagtgctcaatggtgcccaggctggagtgcagtggcgtgatctcagctcgctacaacctccacctcccggccgcctgccttgccctyccaaagtgccgagattgcagcctctgcccggccgccaccccgtctgggaagtgaggagcgtctctgcctggccgcccatagtctgggatgtgaggagcccctctgcctggctgcccagtctggaaagtgaggagcgtctctgcccggccgctatcccatctaggaagtgaggagcgcctcttcccggccgccatcccatctaggaggtgaggagcgtctctgcccggccgcccatcgtctgagatgtggggatgaggagatcctctgcctggcaaccgccccgtctgagaagtgaggagc

SEQ ID NO: 20716 - DNA, 601 bp, Human
cggctcactgcaacctccctgcctgattctcctgcctcagcctgccgagtgcctgcgattgcaggcgcgcgccgccacgcctgactggttttcgtatttttttggtggagacggggtttcgctgtgttggctgggctggtctccagctcctaaccacgagtgatccgccagcctcggcctcctgaggtgccgggattgcagacggagtctcgttcactcagtgctcaatggtgcccaggctggagtgcagtggcgtgatctcagctcgctacaacctccacctcccggccgcctgccttgsccttccaaagtgccgagattgcagcctctgcccggccgccaccccgtctgggaagtgaggagcgtctctgcctggccgcccatagtctgggatgtgaggagcccctctgcctggctgcccagtctggaaagtgaggagcgtctctgcccggccgctatcccatctaggaagtgaggagcgcctcttcccggccgccatcccatctaggaggtgaggagcgtctctgcccggccgcccatcgtctgagatgtggggatgaggagatcctctgcctggcaaccgccccgtctgagaagtgag

SEQ ID NO: 20717 - DNA, 601 bp, Human
ctcccaggttcatgccattctcctgcctcagcctcccaagtagctgggactacaggcgcttgccaccacgcccagctaattttttgtaattttagtagagatgaggtttcaccgttttagccaggatggtctcaatctcctgacctcatgatccgcctgcctcggcctcccaaagtgctgggattacaggcgtgagccactgcatccagcccattgcttcattttaacctcacaaaggagaagcattccttgtgttatagcaaaaaaaaaaaaaaaaaaaatgaggcttagagaggctcaktaaccagcccaaggtcacctgggtaagaaatggtaaaatgaatccaaagggaaaatcttacatacacttcagatatagctgccaaccataacaataacgtaatggggcagggcacagtggcttatgcctgtaatctcagcactttgggagaccaaggcaggcggatcacttgaggtcaggagttcgagaccagcctggccaacatggtgaaaccccattatctattgaaactacaaaaattagctgggcgtggtggtatgtgtctgtaaccccagttactcgggaggctaaggcaggaga

SEQ ID NO: 20718 - DNA, 601 bp, Human
gagtgcagtggtacgatctcagctcactgcaagctccgcctcccaggttcatgccattctcctgcctcagcctcccaagtagctgggactacaggcgcttgccaccacgcccagctaattttttgtaattttagtagagatgaggtttcaccgttttagccaggatggtctcaatctcctgacctcatgatccgcctgcctcggcctcccaaagtgctgggattacaggcgtgagccactgcatccagcccattgcttcattttaacctcacaaaggagaagcattccttgtgttatagcaaaaaaaaaaaaaaaaaaaatgaggcttagagaggctcagtaaccagcccaaggtcacctgggtaagaaatggtaaaatgaatccaaagggaaaatcttacatacacttcagatatagctgccaaccataacaataacgtaatggggcagggcacagtggcttatgcctgtaatctcagcactttgggagaccaaggcaggcggatcacttgaggtcaggagttcgagaccagcctggccaacatggtgaaaccccattatctattgaaactacaaaaattagctgggcgtggtggtatgt

SEQ ID NO: 20719 - DNA, 601 bp, Human
atgatgacagtacttacgatggtgagcagccccgaggtgaggctggagaccaggtctttcccagctcgcgcacaaatgatggtgttgtgggctccagagacggctggcccgtgatcagctgtcaccatcagacacatctcaatgaactggcaagagtacttaggcaacctggagtggggggatcaaaggccaggagatggtcgacaaggccatgctcgtactttcccccatctccctaaacaagtcattcaaatccaagaagggtaactaccagtccaagtctaatactaccacacaactstaaggcaaaacctcctgattcttttctttagacagagtctcattctgtcgcctaggctggaatgcagtagtgtgatcttggctcactgcaacctccacctcctaggttcaagcaatttgcctgcctcaacctcccaagtagctgggactacaggtacgcaccaccacgccaggctaatttttgtatttttagtagagacgagattttgctatgttggccaggctatctcgaactcctggcctcaagtgatctgcccacctcggcctcccaaagtgctgggattacatacaggcatgagcc

SEQ ID NO: 20720 - DNA, 601 bp, Human
gcccagtgtccccactgttcacctcccatgatgacagtacttacgatggtgagcagccccgaggtgaggctggagaccaggtctttcccagctcgcgcacaaatgatggtgttgtgggctccagagacggctggcccgtgatcagctgtcaccatcagacacatctcaatgaactggcaagagtacttaggcaacctggagtggggggatcaaaggccaggagatggtcgacaaggccatgctcgtactttcccccatctccctaaacaagtcattcaaatccaagaagggtaactaccartccaagtctaatactaccacacaactgtaaggcaaaacctcctgattcttttctttagacagagtctcattctgtcgcctaggctggaatgcagtagtgtgatcttggctcactgcaacctccacctcctaggttcaagcaatttgcctgcctcaacctcccaagtagctgggactacaggtacgcaccaccacgccaggctaatttttgtatttttagtagagacgagattttgctatgttggccaggctatctcgaactcctggcctcaagtgatctgcccacctcggcctcccaaag

SEQ ID NO: 20721 - DNA, 601 bp, Human
cccagtgtgtcccgaacggccctgagcactgggttttacactcaggggctccttctagggccctgctgtggcaaagcagcatgaggccaaggcccagtgtccccactgttcacctcccatgatgacagtacttacgatggtgagcagccccgaggtgaggctggagaccaggtctttcccagctcgcgcacaaatgatggtgttgtgggctccagagacggctggcccgtgatcagctgtcaccatcagacacatctcaatgaactggcaagagtacttaggcaacctggagtggggggawcaaaggccaggagatggtcgacaaggccatgctcgtactttcccccatctccctaaacaagtcattcaaatccaagaagggtaactaccagtccaagtctaatactaccacacaactgtaaggcaaaacctcctgattcttttctttagacagagtctcattctgtcgcctaggctggaatgcagtagtgtgatcttggctcactgcaacctccacctcctaggttcaagcaatttgcctgcctcaacctcccaagtagctgggactacaggtacgcaccaccacgccaggctaattttt

SEQ ID NO: 20722 - DNA, 601 bp, Human
cccactatcaccacccacccagtagatccatcccacttttttttttttttttttgagatggagtttcactcttgttgcccaggctggagtgccatggcacaatctcggctcaccacaacctccacttcccgggttcaagcaattctcctacctcagcctcctgagtagctgggattacaggcatgcaccaccacgcctggctaatttttttgtatttttagtagagacggggtttctccatgttggtcaggctggtctccaactcccgacctcaagtgatccacctgccttggcctcccawagtgctgtgattacaggcatgggccaccgcgcctggcctccatcccacttttttaggagagtaacaactcaccgacttcactcggtgaccaatgcccatgatcagcttcccttccttcttcatcttgttcacaaactccatggggataatgccactgtcaaaggctttactgaacatcttggctgctgcatccaaggcacccccaaaccgatccccctggaggagaaacaagtgcgtgttgccttgagctttaagagtttccttcagctgggcaaaccaacccagtgtgtcccgaacggc

SEQ ID NO: 20723 - DNA, 601 bp, Human
attacaggcaatttttgttttcttctttatacctctccttatttttcaaatattctattatgagtatgcattacttttatagtttggaggaaacaacaaaaatcaacaaacttaatgaagaagaaaacagctgcaatgctcaccgagtaaaggacccacagtttctaagcatgtctacaaatgcgactccgatgagaccatctacattcaggataagatttggcttctgggaaggcaaaaaaattcaaagcatttatcattatttctcattttttcttcataattttccactgtcactacyattactacgaattgtgaccatcatttaaaaaccttctaccagccccactggtcgacactgtgtctgactcagttcaattcccagcatctagcaaagtacccaacacctagttgacatttagtgcatgtctgttaaatttagttatgaaacaaaaataacatttctagaaaactaggtttgcttttagctgcataatcaaaatgtaacgtggctcctatttcctccaataaacttgtccaacgtgagggaattaggaagttttttctttgttaccttcgaggtggtaatcttctctacttc

SEQ ID NO: 20724 - DNA, 601 bp, Human
atgaaccccatactccttcccagcacaaagatgccattgagggctccaatgtcaatatattcatcagcttcctccctgcaacacacatcaacttgtagttttaaaaggctcacgtgactgccctcctccccacagacagtactactactgcccaagaatgagaagaaaaggggtgctctgggtggtagcattacaggcaatttttgttttcttctttatacctctccttatttttcaaatattctattatgagtatgcattacttttatagtttggaggaaacaacaaaaatcaacaaacktaatgaagaagaaaacagctgcaatgctcaccgagtaaaggacccacagtttctaagcatgtctacaaatgcgactccgatgagaccatctacattcaggataagatttggcttctgggaaggcaaaaaaattcaaagcatttatcattatttctcattttttcttcataattttccactgtcactaccattactacgaattgtgaccatcatttaaaaaccttctaccagccccactggtcgacactgtgtctgactcagttcaattcccagcatctagcaaagtacccaacacctagt

SEQ ID NO: 20725 - DNA, 601 bp, Human
tcccagctgcttgggaggctgaggcaggagaatcgcttgaacccgggaggcagaggttgcagtgagctgagaccgcgccactgcactccagcctggtgacagagcaagactcagtctcaaaaaaaaaaaaaaaaaaaattttcctgggctagcaatcatttctaagaacaaaggaacaatgataaagataaggggaaaggttaaagtaagaaaggaaagattaagaacaatgattaagaggatatgacatttcttctgtagaaactgaaccacaaaaagaaaattaaaaaaaaaaaaaaaraaagaaaaagaaactcaaccccatgggtaagtggtgtagctgaaccgtggggtttaaaaaaaaacacttaaaacaacaacgaatggactcaccaatgaaccccatactccttcccagcacaaagatgccattgagggctccaatgtcaatatattcatcagcttcctccctgcaacacacatcaacttgtagttttaaaaggctcacgtgactgccctcctccccacagacagtactactactgcccaagaatgagaagaaaaggggtgctctgggtggtagcattacaggcaatttttg

SEQ ID NO: 20726 - DNA, 601 bp, Human
aaatcagctgcataaatacagagaacataagacacaagacatttcacagctttctgcatttccattttaaatgtatgtatgttacaactttacatattaagttactactccacatattttgtgacaatggctaaggatgcaatggccccctccccctgacataaacagactctggtctgcaacacagaacatttcagtgggataccaaacaagcccttaacacgtaacatacaaaaagatctttaaaaatcagattaatacaatgttcttcatgttatataaggaagaagaaagggaagtaaaaaaaaaaaaagagagacattggggtgctttaaatgtatagtatcttgaggccataaatgtttcattcccttcctccaaaggagaaaaaaatgtttaactaatggaaaaagaaagcaacatcctaacgccctacaatgaggaagaccccatcctgacagtacttagatgcttccatataataaatacagcaggtagcagagcaaagtcacaaatattggcttggtttttatttctatgcttataaaaaaaatatgaagcttctttgtgtggactgaaggggtgttagcctgtggatgtt

SEQ ID NO: 20727 - DNA, 601 bp, Human
agtatgccttcattgttactatatagtttatttaaaccagactatgataatacagagaagagactgaggtggcagctgcccagaatctttgtggattacagatgcaaagtagttaggagtccttggacccacacttcagttacagacagacaaatcagctgcataaatacagagaacataagacacaagacatttcacagctttctgcatttccattttaaatgtatgtatgttacaactttacatattaagttactactccacatattttgtgacaatggctaaggatgcaatggccccmtccccctgacataaacagactctggtctgcaacacagaacatttcagtgggataccaaacaagcccttaacacgtaacatacaaaaagatctttaaaaatcagattaatacaatgttcttcatgttatataaggaagaagaaagggaagtaaaaaaaaaaaaagagagacattggggtgctttaaatgtatagtatcttgaggccataaatgtttcattcccttcctccaaaggagaaaaaaatgtttaactaatggaaaaagaaagcaacatcctaacgccctacaatgaggaagaccc

SEQ ID NO: 20728 - DNA, 601 bp, Human
cagatggttgagcttcttccacaaaatccccaccaagtgggtctctttgaatgctctaccaacaaggatcccactacatcagagatgaaccatttacttaaatcagatcaatcacccaactatcaactaagcacttactatgtgcaagtctctatgttaagtgctaatgaagataaatgagttttctcagggagtcagggaactgtaactaaagagtacagctcttttgttttcacttaaatatgtgtcattattgtggaactattaaaccacaccattgttcattctacacacataatgaaaaaaaaaatcaacaaatttttatgatagtgtgattcatagaacttactttcattaatttttgcttttatttttttcccatagctgggcatggagcagcattatgaacttggagagtatataagaaagagatatagaaaattcttgaatgagtcctataaacatgaacaggcaagttggggagccaagagtgggaactttgatctttgaaataattaaaataattctgcatatataaaagtgctttgcctgttttccaaggaacttatacaagtcagaggtcttgtttacaaatatattc

SEQ ID NO: 20729 - DNA, 601 bp, Human
gcatcagtgtttgaaaaataatctccctcgatgattccagtggggaggcaagtttgagaaccagtactataaactaagctgcctgaatggggctgtttgagagaaactctcaaacgtgtttacacaggttgggaccgaccaagctttctttaatcttttcagaggaatgggtatttttaaagtagcaatagataaatctaactaatcttccaggtgtgaaacttaaggctatatgaaagaaatagtttgggacaaagaatcccttcctaatttccctgcagtcccatcataggcatgaccrtcgcatctctttatggctgaagcttagcctgactgctggacccagacttttgcccagtgacctctggggtaggttactatcctctttgtcctgccagtacccctagaaatttgacttaattgctgcatctagggacttagggatttttcccaaatgctgtgtagaaagtcactggagttaaatctactccaaccatttttctgctgtttcttgaaaagacaggatgattcatttacatctcttttccttcacagaatcatgagggaagtattgtgattaccagtgttaagcatttgtgaa

SEQ ID NO: 20730 - DNA, 601 bp, Human
taaaaaataataataggccgggcgcggtggctcacgcctgtaatcccagcactttgggaggccaaggcaggtggatcacgaggtcaggagatcgagaccatcctggctaacacagtgaaaccccgtctctactaaaagtacaaaaaattagccaggcgtggtggcaggcgcctgtagtcccagctactcaggagagtgaggaaggagaatggcgtgaacctgggaagcagagcttgcaatgagccgagatcgcgccactgcactccagcctgggtgacagagcaagactctgtctcaaaamataataataataataaaaggtattagtgtaactgctgtgtggagaatgaattaggatggctgaaagagtgaacactgatttaccaaataggaagttctcacagtagttgaaacacaagttatggtggctaggactgggaggggactatgaagataaaaaaaagcggtctattttgaaatagaaggggatatgttttgaaaatagagaaacaaaagtgactatgaagtaggttgataaattctgccactagcaaaagcagagaaaattacaaagagggaatggttaaaaatgaagttgaat

SEQ ID NO: 20731 - DNA, 601 bp, Human
aaaccctgtctctactagaaacacaaaaaattagccaggcgtggtggcaggcgcctgtaatcccagctactcaggaggctgaggcaagagaatcacttgaacccaggaggcggaggttgcagtgagccgagatggcgccactgcattccagcctgggcaacaagaacgaaattccgtctcaaaaaaaaaaaaaaaagaccaaatatatatttcacaatatcatagataatgaatggcatttttaaaaaaaagtttgtctattaactgcttaccgtgttcttgccatgtaggttctgtatcratgtattcttatatggcttctatattttgagtcatgtttagaaaagctttccccactcctaggttataaaggaagtctgcaatgctttcttctaattccactctagcttcatttctcatttatatattgaattcatttacagttcatactggtagaaggtatcctgtttaagttttttcctggaagattatctaattgctccatcattgtttattgaatagttcatttttttcctacttattgaagctattatatattaaaattcccataggtgtggggtctatttatgtaatttttatt

SEQ ID NO: 20732 - DNA, 601 bp, Human
aatcttcctaagaatatggtacatgttcctacttgttttatcttaaagattattttagggttttcttcatatatgtctttacattttttgttaagtttgtttcaggtttacagtatctccagttttcaaaaatgtgtatctctgatttcttccttttgcctatttgcactggccactacttacagtataatgttatgggcagtgttggtagcgggtattcttgtcttatttctgattttagaggagttttcctaataagcatacaggcttttgaaccaaaatagacatatttttatgaaaytaaggaaatatccacctttcttattttcttgagtgtatttttttaaatcaatattagttgtttaatctcctgaatgattgttttaacattttttaatacaatcaaattatttttctccttggattaattacaatgattgattacattcatagatttaccaatgttgaacaatctttatatttctcaaatcaaacccatttccttttatgtgacattgaattacttcctgttattttacttacaccttttgcattgatatttacaagtggcattgaactaatagttttattttgggggcaa

SEQ ID NO: 20733 - DNA, 601 bp, Human
acattgaattacttcctgttattttacttacaccttttgcattgatatttacaagtggcattgaactaatagttttattttgggggcaatctttgtcagtatcagtgttacacttaattcataagaagtttttgaaagttttctttcatcttctatgctccagaacagttaaaatagcattagaataatttactcttgaaaagcttggtagaattcctctatgacagtcatctggccctggagcttttatgtttgagaagatggcagtaggagctctttaacaataatttctattattttwtgaaaatctattgaggttaatattggcaaattgtagttccctagaaatttcatccatcagacagacaatatcttccaaaaaggcttcccagaaatggctgccaatttcagcagtcagatagctgaacattgggtctcattattgcgacattccaagaaacatacagaacctagcgaaagatttgcattccatccaagttttatatgtatagccaaagaccaagccctatttgtgttgcatgttccaggatgctttggcctgaaatatgctttcctttctcacctgggacatatttacaca

SEQ ID NO: 20734 - DNA, 601 bp, Human
tgtccttggtcttaatgaaaaaacaatgttgttataaagaaagaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctsaccacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattcc

SEQ ID NO: 20735 - DNA, 601 bp, Human
ccttggtcttaatgaaaaaacaatgttgttataaagaaagaggggaaaattacctgatttccgaatgtagaaataaacaagcaaaatataagccaggctatttatatttgcttaacaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgacsacccacctaattcatattgacttctaactttgaggtcatcgtgagagtctggggggcagcaattacttccgtagttctatcttaataacagatgacacagtttgcctccatccatcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattccaaa

SEQ ID NO: 20736 - DNA, 601 bp, Human
acaagaaagaacttctttcttgctttgcgatgcatttgaaataccgtttgtggccagataaattacgattgcttttcaaggttacatggtgtttctcactcaccatgctccaccttctggccaaaaggagtactctctgttcctgttttcccaactagctcactaaatatggggcaagattctgaccacccacctaattcatattgacttctaactttgaggtcatcgtgagagtctggggggcagcaattacttccgtagttctatcttaataacagatgacacagtttgcctccatccmtcctaaagttaattgacccaatcacatgctactttcccagtattttcacttaatcatcagcaactatttcagtgaaaattcattagcattgtaaaagactcttcagtgaaaacaagagcccccatttttgttccagtcataatttttttttcttccttactacagtttgatctgagctattccaaaatgtggtcatgtcatgtgatattttttccaaatctctctcacttatttcctctgtaggtcactccactttggtctcctctttcacgaactcactttctctcactcttaatcctg

SEQ ID NO: 20737 - DNA, 601 bp, Human
atttaccaagtatccactgtgtgcaaggtgcaggctttcctcaagagtcagtgaactacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccarcatggcgaaatttcatctctactaaaaatacaaaaattaggcgggtgtggtggcgcatgcctgtaatcccagctactcgggaggctgaggcaagagaatcgcttgaacccaggaagtggaggttgcagtgagctgaaatcgtgccactgcactccaggctggatgacagagcaagattctgtctcaaaaaaaaaaaaaaaaaaaagtgccacgtgtggtggcatgcacctatagtcccaactactcaggaggctgaggtaggaggattgcttgagtcctggagtttgaggttacagtgag

SEQ ID NO: 20738 - DNA, 601 bp, Human
actacagccaggtatggtggctcctgcctgtaatcccagcacttctgggaggctgagatgggaggatcatttgaggctagaagttcaggatgagcctgggcagcataatgaggccctacctctacaaaacacttttaaaaattagccacgtgtggccaggtgtagtggctcatgcctataatcccagcactttgggctaaggtgggcggattgcctgagctcaggagttcgagaccagcctggccaacatggcgaaatttcatctctactaaaaatacaaaaattaggcgggtgtggtggygcatgcctgtaatcccagctactcgggaggctgaggcaagagaatcgcttgaacccaggaagtggaggttgcagtgagctgaaatcgtgccactgcactccaggctggatgacagagcaagattctgtctcaaaaaaaaaaaaaaaaaaaagtgccacgtgtggtggcatgcacctatagtcccaactactcaggaggctgaggtaggaggattgcttgagtcctggagtttgaggttacagtgagctgtgatggccactgcattccagccttggtgacagagcaagacaatgtctctga

SEQ ID NO: 20739 - DNA, 601 bp, Human
cctgattgcatggcacagagacagacttgatagaaatgtgcaagtccttacttcacattaaacacatgagcaacaagatccagccttgaggaagggagagtctccagagaggagtcttagatggaagctggagtgttggaaaaaattaccaggcgggatacagactgtgtctatgggcagaacccaggaagaagctcaatcttaagtgcttaacaacaaaagatgtagagggtgccttggaagccacataagcactcagcctcatttctggcccaccaggtgccagcagtgtgactcagtygcaagccccatcaaatggtggaagcgggactcttgatttatttcccccaacctagttatggtggattcaggcacctagtccctcacgactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttc

SEQ ID NO: 20740 - DNA, 601 bp, Human
cacattaaacacatgagcaacaagatccagccttgaggaagggagagtctccagagaggagtcttagatggaagctggagtgttggaaaaaattaccaggcgggatacagactgtgtctatgggcagaacccaggaagaagctcaatcttaagtgcttaacaacaaaagatgtagagggtgccttggaagccacataagcactcagcctcatttctggcccaccaggtgccagcagtgtgactcagttgcaagccccatcaaatggtggaagcgggactcttgatttatttcccccaaccwagttatggtggattcaggcacctagtccctcacgactcaaagtgcagtctacttttcagcatcggcatcaactaccacctggctagaaacacaggccccactcccaaacgagttgaatcaggatctgcatttgaataaaatcccaacatgctttataccagacaggagttgacagtagtctaatagtagatgtagggatgtgtatgtatgaataagaaatggagttgctccactttcctcatgtttcctcttttatttcccttgcctactagaagattacatttgggagaagccacttcc

SEQ ID NO: 20741 - DNA, 601 bp, Human
agattacatttgggagaagccacttcccctctctggatctctgtttcactacctatgaggagattaaactagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgmacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaa

SEQ ID NO: 20742 - DNA, 601 bp, Human
ctagactgtctataagagtccttctctgagttgttctctgatcttggattctaaaggctggcacttgtatgaaaccagctgtcctgctttctggaaaaagtccagcgccattgttaagcaggaaaatttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccaycttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaattttttttaaattttttgcaaagacagggtctccttatgttgcccaggctagtcttgaactcctgggc

SEQ ID NO: 20743 - DNA, 601 bp, Human
atttctcctgtgtggttctgccaaaacaaaagctcagactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagyatgatcacggctcactgtagccttgacctcccaggctcaagcgatcctcccacctcagactcccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacac

SEQ ID NO: 20744 - DNA, 601 bp, Human
agactattattcagatctggctgggcaagagagatttgtcaactacatgtttattgaatgatgaaacagctgcacacattcctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccagsctcaagcgatcctcccacctcagactcccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaa

SEQ ID NO: 20745 - DNA, 601 bp, Human
cctgcacagaaaacacacattgtctaggtgacaaagagtaatgtggacacatcagggccatcttctgacctttgctagtttttttgttagtttgttttgtttttgtttctttgtattttttgtttgtttttgtgtctgtttttgagacagggtctcattctgtcctccaggctggagtgcagcagcatgatcacggctcactgtagccttgacctcccaggctcaagcgatcctcccacctcagactcccaagtagctgggactacagtcatgcaccaccatgcccagctaaatttttttwaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaaaaaaatccctggggcaaatttaggatcatatggctggtcatatcagtgaaaagagagctcttcttgctctaggccagagg

SEQ ID NO: 20746 - DNA, 601 bp, Human
cccaagtagctgggactacagtcatgcaccaccatgcccagctaaattttttttaaattttttgcaaagacagggtctccttatgttgcccaggctagtcttgaactcctgggctcaagcgatcctccaccttggcctcccaaagttctgggattataggcatgaactactgtgcccagtctagaatttttatttcatcatttaacttcaggggtgacactgttcagtaagacacacacacatacacacacacacacacacacacacacaccaaaaaaatccctggggcaaatttaggatsatatggctggtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccaccgcagagctgagtagttgcaacagattttttaacccacaaagcctaagacatttactctctggacttttacagaaaagtttgccaacctctgctgtagactagaaatgaaggaagcaaagttta

SEQ ID NO: 20747 - DNA, 601 bp, Human
agtctagaatttttatttcatcatttaacttcaggggtgacactgttcagtaagacacacacacatacacacacacacacacacacacacacaccaaaaaaatccctggggcaaatttaggatcatatggctggtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccacygcagagctgagtagttgcaacagattttttaacccacaaagcctaagacatttactctctggacttttacagaaaagtttgccaacctctgctgtagactagaaatgaaggaagcaaagtttatgtcttcaggtcaatgatatttttgtctagtttacgaagatttaataaaggatacaacagataactttgaagctagctttccacgatagcatgttctaatgattacaaataaaggttttgacacaggacatgctagatttaaagccctccttctctgcttgcaagttgtataatcta

SEQ ID NO: 20748 - DNA, 601 bp, Human
gtcatatcagtgaaaagagagctcttcttgctctaggccagaggttggcaaactactgcctgtatgcctaatccagcccactacctggttttgtaaataaagttttattgaaatacagccacactcattcatttatgcattgtctattgctgctttcatgctaccaccgcagagctgagtagttgcaacagattttttaacccacaaagcctaagacatttactctctggacttttacagaaaagtttgccaacctctgctgtagactagaaatgaaggaagcaaagtttatgtcttcagrtcaatgatatttttgtctagtttacgaagatttaataaaggatacaacagataactttgaagctagctttccacgatagcatgttctaatgattacaaataaaggttttgacacaggacatgctagatttaaagccctccttctctgcttgcaagttgtataatctaatcaagtttctgagcctctccaagcctcagtttcccctataaaacagaatattgatatgccagagcctgaggataatcatgatagtcacccctaatcactcctgggataagggtgtaatcataccagaaccaa

SEQ ID NO: 20749 - DNA, 601 bp, Human
aaaggatacaacagataactttgaagctagctttccacgatagcatgttctaatgattacaaataaaggttttgacacaggacatgctagatttaaagccctccttctctgcttgcaagttgtataatctaatcaagtttctgagcctctccaagcctcagtttcccctataaaacagaatattgatatgccagagcctgaggataatcatgatagtcacccctaatcactcctgggataagggtgtaatcataccagaaccaagaactgatatattcatgaccaaaactgcagcctgacyaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatggagggatttagacctgttagacatgtacattcagattatcctattcatcctcaaggaatttccagtatcttatagaaagagcagatacctacctccttaattaacccttttttatacttactggtgtacagacctgtctcttcttactatt

SEQ ID NO: 20750 - DNA, 601 bp, Human
tccaagcctcagtttcccctataaaacagaatattgatatgccagagcctgaggataatcatgatagtcacccctaatcactcctgggataagggtgtaatcataccagaaccaagaactgatatattcatgaccaaaactgcagcctgactaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatrgagggatttagacctgttagacatgtacattcagattatcctattcatcctcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaac

SEQ ID NO: 20751 - DNA, 601 bp, Human
gaggataatcatgatagtcacccctaatcactcctgggataagggtgtaatcataccagaaccaagaactgatatattcatgaccaaaactgcagcctgactaaaaggcacttgttgacaaagggcaacttgctgatttcaggtggctgtcatggctcccaaaagcttggccacagagtttagcaccaacatggcatgtgaatcaagctaaagtccctaatgcattccacagggcaaccctctctgagatggagggatttagacctgttagacatgtacattcagattatcctattcatcytcaaggaatttccagtatcttatagaaagagcagatacctacctccttaattaacccttttttatacttactggtgtacagacctgtctcttcttactattttatgagtttttggagggcagggaccaggtctgattctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaaga

SEQ ID NO: 20752 - DNA, 601 bp, Human
tctcctagcacagtatctggcgcatcatagctgctcagtgtgtgtttgttgagtggactacagaacctgagattatagtcaatctgttaatatcaatgccctgctcattacaactcacacacacacacaccctaacacaccctactggtcattctcagccaagagagcacatgatgcagggtaaagagaccaacagagacaccagatagttacagacatctctgaagcaacatgtccttaaaacaggatctgttttggcaccacaaggtaccccacagccctcagtgcctagaaataggayaaatactgtaagctctatatctgtctttcaccacctcaggagcaacagcagttaggtgttcagatgtgaagtgtgaagagcaaaagtttcctctactgaagacagacagaaactcaaatgaaagctaaagatgctggctgtccccccaatagtgacacctagggtaacctggagaaatggtccacagagaatagtccatgatctgtacaaacatccagagagctgctttctcccatggcctcccacaggtctgactgccagagagtagaagcaagaggggtgaaaatagaggagtacctg

SEQ ID NO: 20753 - DNA, 601 bp, Human
cctggctgtgtgagtcacttaatatctttggacttaagattccttacctaaaaatgagggttgagacgtaggattcagtttaaaaaaaaaaaagtatgtaaatcacattacctagcacagagcagatgctcaataaaattagatctttgcccctcttcttaagtcatggcagggagagtccgcaactatgaagtgacaaaaagctaatgaactaaaatagaagcttatgtttggttcagtttggttattgattcatcttctttaaggtgtcctggtcaatgaaatcctcaatcacatgaaragagcaactcagataccaagctacaaaaaactcatcatgtattctgcggtaagtattttcatcttcatttaacatatgtttgttcaagtgtgtgatctcttgaagcacaggacctcatctttttttaatcttcatttccccatctccttgtacgtggtaggcacttgcacaaagcttttagaattaaatgcatcattctgtcctttaagggatttataatctaaactaacaagaagacaaacataaacactatacaaaatgggatggaaataccatgcaggcaagtgctatggcacctca

SEQ ID NO: 20754 - DNA, 601 bp, Human
ttaacgaattctgtctaagcctgcttattaggtgatcctgactgtgaagtgatctcacattttcttatgagaagatacggagagagacagaaagagagagtattttagattttcaaccatcttaaatacgtaaacttttcaggttgtagaaaaggtagctaaaaatattcttaaaagatttaattttgggttagatacagagatttaaaatcatagactatataaaataattcattaagttaatattgctttgtttcacttttacattttataaaatgattttatctaaactctttgtackcatctttggcttgtgtcttcaccactaaagccaattttgagtcttttaaaattgtttcccagatatattcactaataaaagataattttgtcttctatatagatgaacctcagatttttgaagtcttaacccaatgaaaattaatttcacacttatctaacagtacaatgcaggtgtacattaatagatgtgattcacacgtggtgattcaggcacccagggttccctctttggacctacggtttcaagagtgctgtgctcacttgcaggcagcttgtagaaaggaatgaaagggtggag

SEQ ID NO: 20755 - DNA, 601 bp, Human
ggatctctaaatccttcttgagttcccctcctgactccttgattagcaaatggcttccataagcaactcacgctggtttaactcaggttagtttacaccattggaccttcccaaatagtacattgtttttttgagataaagcattgagagagctctccttaacgtgacacaatggaaggactggaacacatacccacatctttgttctgagggataattttctgataaagtcttgctgtatattcaagcacatatgttatatattattcagttccatgtttatagcctagttaaggagagrggagatacattcagaaagaggactgaaagaaatactcaagtaggaaaacagaaaaagaaaaaaaggagcaaatgagaagcctaaaaagaagggaggaggagaaggaaaacccaacacccccacctgcctcccacttcttatccaaaggctcaaagtcccacccagctccctgcaaccatcacttctcaccacctcctctgatttagcatcctggtgcctacctcctatgtccctgttcatctaacaaaccagccctcccatttccaccctgcaaatctctcccgcctgccccagtctccc

SEQ ID NO: 20756 - DNA, 601 bp, Human
cagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctcyagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagcc

SEQ ID NO: 20757 - DNA, 601 bp, Human
attaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccraggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaagg

SEQ ID NO: 20758 - DNA, 601 bp, Human
ggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggagstcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacac

SEQ ID NO: 20759 - DNA, 601 bp, Human
tcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctkgtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcag

SEQ ID NO: 20760 - DNA, 601 bp, Human
gcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtgstgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaacaaagttgattaagaaaggaagtataggccaggcacagtggctcacacctgtaatccttgcattttggaaggctgaggcaggaggatcactttaggcctggtgtgttcaagaccagcctgg

SEQ ID NO: 20761 - DNA, 601 bp, Human
ccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcactactgtactccagccagggcaagagagcgagaccctgtctcaataaataaataaataaataaataaataaataaataaataaataaaaaaaaagttgattaagaaaggaagtataggccaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaaacaaaattagaaatgtaattatgttctaagtgcctccaagttcaaaacttattggaatgttgagagtgtggttacgaaatacgttaggaggacaaaaggaatgtgtaagtctttaatg

SEQ ID NO: 20762 - DNA, 601 bp, Human
gtaggcatggtcggcccggggctcgggacagcccgccacgcagtagtaacagtctcccagggtgctgattttctcacacttggtctcctcacacaggcggtcgaagcgaccgaacagatcgttcaggagacccaccagggcgtgggcagacttgttggcactcatcttggtgaagcccacgatatctgcaaataaaatactgacttcttcgatctgctgcatcttaaaagggcggaaggctataggagctttttggatggaagactttttcttcctgttcttggggctcgaggtggcatgyctcttgacagaattctcactctcctcatctccctgcttcattaagtcatcggctatgattcttggcatcacggaatgaatcatcctctctttgagggctttttccacttccaggtccttcccgtgcataatggattgccccaccttgaggaaggtgctcctggacctcacctgggacatgacgaacaggtggaccccgatggcgtggatgcagccgtggagcagccccctgctcagcagctcccagtgcagggccccggctccgggcgaggggaagcaggcttcatcccggaaatggtag

SEQ ID NO: 20763 - DNA, 601 bp, Human
catgcccaggcccatctcgatgcagcagtaggcatggtcggcccggggctcgggacagcccgccacgcagtagtaacagtctcccagggtgctgattttctcacacttggtctcctcacacaggcggtcgaagcgaccgaacagatcgttcaggagacccaccagggcgtgggcagacttgttggcactcatcttggtgaagcccacgatatctgcaaataaaatactgacttcttcgatctgctgcatcttaaaagggcggaaggctataggagctttttggatggaagactttttcttyctgttcttggggctcgaggtggcatgcctcttgacagaattctcactctcctcatctccctgcttcattaagtcatcggctatgattcttggcatcacggaatgaatcatcctctctttgagggctttttccacttccaggtccttcccgtgcataatggattgccccaccttgaggaaggtgctcctggacctcacctgggacatgacgaacaggtggaccccgatggcgtggatgcagccgtggagcagccccctgctcagcagctcccagtgcagggccccggctccgggcgagggg

SEQ ID NO: 20764 - DNA, 601 bp, Human
tgaaagccttcctgccaccggccctaactcccaacctctctcttcacccagcctttctcgccgtgaagaccccctcttgtctctgcccgtctatattctatcataaactgagtccagcttccagtaccacaaatcccctcccggcactcgaatccacgcattttaaacccttattggcctttagaggaatcccgcccagctcagcccctgagcgctggtttccacgtgggttgctgctgaccctccctcgagctccctgccggtctcttcaacacccggaggacccgcgggtgcggagtgstgttacccaagaggagttactctcagaactaagaagtcgacaagacaggaatgtcaccttgggtggatgcgccaggagaggaactgacaggaacaacagccatgagcttgttaccttggtgctgtttttatgctcgtcttggcagccgttttgaggtgctcctccctcggcgccggcttcagatttgggagcaaatgtgattccgcacgaagggcaggtctagaagaaaaacacagactgtggggacacacccagaaaccgcgactgccaccctgaattcaggcaggtccgctgttgcca

SEQ ID NO: 20765 - DNA, 601 bp, Human
aagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctctgctgcggggcgctgctgcactrggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaagtatgacgaggggtccagggctg

SEQ ID NO: 20766 - DNA, 601 bp, Human
aaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctctgctgcggggcgctgctgcacygggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaagtatgacgaggggtccagggct

SEQ ID NO: 20767 - DNA, 601 bp, Human
gtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggattaggtcctccagaagcctgcctcgagacaaagaggacgcagacacgggaagtgaagtggcaccgggcactgggcacacacgcctgtcccaccccgacctcygctgcggggcgctgctgcactgggcgtgggactttctgacctgcgaggaacccccacccccctgcgcctacagacctgctccaatcccagccctgactgcccgtctgctccttcctgttacccaacagtgcccagtggtaacgctgggtgttcaggctgccaggacattgagacatgggaagagtcggtgcggaggtggaggggaagggaggaaagtgaggagccgaggcccccagagtctgcttaggccagaaccacggttctgggagcagggtgcatgggtcgggggtccaggagaag

SEQ ID NO: 20768 - DNA, 601 bp, Human
agcaagacctagtctttattaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacctgggagatagaggctgcagtgagccaagatcgcgccactgcactgcagcctggrtgacagagcgagactcagtcttaaagaaaagaaaagaaaaaggcagagaggcttctgcctgcaacctttgctttttcccagacagccccagtcgtacctgtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgttggtgagcttctcctcttggggagggctgaggagcccgttctgagttttgggatt

SEQ ID NO: 20769 - DNA, 601 bp, Human
gtggaggttgcagtgagccgagattgagccactgcactccagcctgggcaacacagcaagacctagtctttattaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacytgggagatagaggctgcagtgagccaagatcgcgccactgcactgcagcctgggtgacagagcgagactcagtcttaaagaaaagaaaagaaaaaggcagagaggcttctgcctgcaacctttgctttttcccagacagccccagtcgtacctgtcttctttgataacgtccacaaagtgggcgtccgttttctcccggatgttcttgaacctcagcggaaggagagccgactggtccaggctcacccctgcccaccttcccttctcctgcaagatctcacacagagaagtctgactgtt

SEQ ID NO: 20770 - DNA, 601 bp, Human
caaaaatgttaccattaggccaggcacaggctcacacctgtaatcccagcactttaggaggccgaggcgggcagatcacctgaggccaagagttcgagacccgcctggccaacatgttaaaaacccatctctactaaaaacacaaaaattagctgggcatggttgtgtatgcctgtagtcccagctacttgagagacctaggcaggagaattacttgaacctgggaggtggaggttgcagtgagccgagattgagccactgcactccagcctgggcaacacagcaagacctagtctttatwaaaaaaaaaaaaaaaaaaaaagccaggcgtggtggctcacgcctataatcccagcactctgggagggtggggtaggtggatcacccgaggtcaggagtatggagaccagcctggccaacatgatgaaactccatctctactaaaaatacaaaacctagccaggcatggtggtgggtgccagtaaccccagctacttgggaggctgaggcaggagcatcgtttgaacctgggagatagaggctgcagtgagccaagatcgcgccactgcactgcagcctgggtgacagagcgagactcagt

SEQ ID NO: 20771 - DNA, 601 bp, Human
cagaaccttggttttttggggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtragctgctgaggcttgtttttgaaaacacattcctaatgtctaggattaggagaagatgaaggcagcttttctgttctttgaaacaatcttttgtgaagaacacgcagatcactgtgctgagagtacttacatggatttggaggcttcaaacgaaaacataattcagaaccggcggtcctgtcattcagagcactgacagtaattgccaccgtaaaagctaacaggttgttatcacaaaattgtgtttatagttagcgtaattttggtgctattgtcacatatgcagattgcatgtgaaac

SEQ ID NO: 20772 - DNA, 601 bp, Human
ataatcatattttgtgtttcaccttcgttaaagaatgaccatccaccatgattataacacacatcatatcagaaccttggttttttggggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggmtggtctcgaactcctgggctcaagagatccacccatctcggcctcccaaagtgctgggatgacagcgtgagctgctgaggcttgtttttgaaaacacattcctaatgtctaggattaggagaagatgaaggcagcttttctgttctttgaaacaatcttttgtgaagaacacgcagatcactgtgctgagagtacttacatggatttggaggcttcaaacgaaaacataattcagaaccggcggtcctgtcattcagagcactgacagtaattgccaccgtaaaagctaacaggttgtta

SEQ ID NO: 20773 - DNA, 601 bp, Human
atctttcatcaggctagaagacacaacaaatgcagtcgatcaatacccagcaccatgactgtgccaatgttttcagatcataattagctaccaaaacgctgctcattaggtatattacaacagctgcgtctaaaagcgcctgtggaacagacgccactcagctgccccttgttaaaacagatctgtggaaagtccttcgcacctcaaagcataatcatattttgtgtttcaccttcgttaaagaatgaccatccaccatgattataacacacatcatatcagaaccttggttttttggggktttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtgagctgctgaggcttgtttttg

SEQ ID NO: 20774 - DNA, 601 bp, Human
agtaatctttcatcaggctagaagacacaacaaatgcagtcgatcaatacccagcaccatgactgtgccaatgttttcagatcataattagctaccaaaacgctgctcattaggtatattacaacagctgcgtctaaaagcgcctgtggaacagacgccactcagctgccccttgttaaaacagatctgtggaaagtccttcgcacctcaaagcataatcatattttgtgtttcaccttcgttaaagaatgaccatccaccatgattataacacacatcatatcagaaccttggttttttkgggttttttttttttgaggcaaggtctcactctgtcgcccaggctggagtgcaatggcgcagcgatcttggctcactgcaatctccgcctcccaggttcaagcaattctcctgcctcagcctcctgagtagctgggattacaggcgcctgccaccgcacccagctaatttttgtattttttagcagacgcggggtttcaccatgttggtcaggctggtctcgaactcctgggctcaagagatccacccatctcggcctcccaaagtgctgggatgacagcgtgagctgctgaggcttgtt

SEQ ID NO: 20775 - DNA, 601 bp, Human
ttgtcctggcatctctcctttcctccccaccgggaccctgtggccacctgccctgagtttcggtaacagcctcccacctgtcatgtggcctcctgtcttgtccacactcttatcaccctccgaaactcagctgatacatgtttgttttttttctttttttgagacggagtttcactcttcttgcccaggccggagtgcaatagtgcaacggcatggtctcggctcactgcaacctccgcctcccgggttcaggcgattttcctgtctcagcttcccaagtagctgggattacaggcgcccrccaccatacctggctaagttttgtatttttagtagagacggggtttcactatgttggccaggctggtctcgaactcctgacctcaggtgatctgcccgcctcagcctcccaaagtgctgggattacaggcatgagccaccgcgcccggccatgtttttcttctttttgttggaagagacagggtctcactatgttgcccaggctggtctatctactggcctcaagtgatcctcctgcctcagcttcctgagtaattgggattacaggtgtgagctgtgtgatctttgtaacacaacctgt

SEQ ID NO: 20776 - DNA, 601 bp, Human
gcacccacgtggagcccccagcacaatgagtccccaaacgcgggccagctgggaggctcccttgtcctggcatctctcctttcctccccaccgggaccctgtggccacctgccctgagtttcggtaacagcctcccacctgtcatgtggcctcctgtcttgtccacactcttatcaccctccgaaactcagctgatacatgtttgttttttttctttttttgagacggagtttcactcttcttgcccaggccggagtgcaatagtgcaacggcatggtctcggctcactgcaacctccgcmtcccgggttcaggcgattttcctgtctcagcttcccaagtagctgggattacaggcgcccgccaccatacctggctaagttttgtatttttagtagagacggggtttcactatgttggccaggctggtctcgaactcctgacctcaggtgatctgcccgcctcagcctcccaaagtgctgggattacaggcatgagccaccgcgcccggccatgtttttcttctttttgttggaagagacagggtctcactatgttgcccaggctggtctatctactggcctcaagtgatcctcctgcct

SEQ ID NO: 20777 - DNA, 601 bp, Human
ggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacaycactgccttgcccacatgtgaggccggaaggtttccacgtgggctgccgtccttctgagagcccacacctcccaccttccaagccaagggctcgggtacagggcctttcctgattggggctgccatctcctctgtagaactgccccatccatggacgctgccagaggccccgctcctccctccacctcccttgcagtctctcctgcctgccctgctacttgccagagacacctgtccctgccacagcctccccctctgggccacccctggccctgatgccagaggctcccaggcccatct

SEQ ID NO: 20778 - DNA, 601 bp, Human
ggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtaggaatttcaggggcgacactgcccatgcccactcaccttggcagaggcccacgcamgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaagccaagggctcgggtacagggcctttcctgattggggctgccatctcctctgtagaactgccccatccatggacgctgccagaggccccgctcctccctccacctcccttgcagtctctcctgcctgccctgct

SEQ ID NO: 20779 - DNA, 601 bp, Human
tgggaatttcttttttttcatttttcttttcttttccttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctggsattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaagccaagggctcgggtacagggcctttcctgattggggctgcc

SEQ ID NO: 20780 - DNA, 601 bp, Human
gggcgagtcaggtcccagccctggaatcccctcagaaggtgtgggaatttcttttttttcatttttcttttcttttccttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctygacctcgtgatctgcctgcctcggcctcccaaagtgctgggattacaggcctgagccactgtacccggccaggtgtaggaatttcaggggcgacactgcccatgcccactcaccttggcagaggcccacgcacgtcccctttctgtggggctccatctagtgcccgtcaggggttcgagtcagggccgggtgcatgcatgtgatgtccctgagacatcactgccttgcccacatgtgaggccggaaggtttccacgtgggctgccgtccttctgagagcccacacctcccaccttccaag

SEQ ID NO: 20781 - DNA, 601 bp, Human
tggcagccctgggtgcggtgtgcgttctttgggacaaaccagctccgggtgcctcgaccactcccaggaactaggtgggagggcaggaggggcacttggacggtgggagcaaggctgccagtcagccctgatgccaggctggaccctgccagggcaacctgggggttagggtttggttccaaattctctccaaggaagctggaggctctgtagtgcccaaaagggcgagtcaggtcccagccctggaatcccctcagaaggtgtgggaatttcttttttttcatttttcttttcttttccttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacctcgtgatctgcctgcctcggcctcccaaagtgctgggattacaggcctgagccactgtacccggccaggtgtag

SEQ ID NO: 20782 - DNA, 601 bp, Human
gtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttggacggtgggagcaaggctgccagtcagccctgatgccaggctggaccctgccagggcaacctgggggttagggtttggttccaaattctctccaaggaagctggaggctctgtagtgcccaaaagggcragtcaggtcccagccctggaatcccctcagaaggtgtgggaatttcttttttttcatttttcttttcttttccttttttttttttttttttgagatgggatctggctgtcgccaggctggagtgcagtggcgcgatcttggctcactgcaacctccgcctcccaggttcaagcaattctcctgcctcagcctctggagtagctgggaggacaggcacccgccaccacgcccagctaatttttgtatgattagtagagatgggatttcaccaagttggctaggatggtctctatctcgacc

SEQ ID NO: 20783 - DNA, 601 bp, Human
actcctgagtgtgtccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcagsaggggcacttggacggtgggagcaaggctgccagtcagccctgatgccaggctggaccctgccagggcaacctgggggttagggtttggttccaaattctctccaaggaagctggaggctctgtagtgcccaaaagggcgagtcaggtcccagccctggaatcccctcagaaggtgtgggaatttcttttttttcatttttcttttcttttccttttttttttttttttttgagatgggatctggctgtcgccaggctggagtgcagtggcgcgatcttggctcactgcaacctccgcct

SEQ ID NO: 20784 - DNA, 601 bp, Human
gaacctacggggcctggctctgtgctgggggccagtacactagagaggcacacactagtgttcggcaattgagggggagaaataacgatgctgacacgtccaagaggtgaccaggcccaggccctgcaaggctctggggaggtgcgatctccattgacgctcacggcaccccacaggcaggaactaccacccatctcggtgtacagattgggaggccaaggccaggggctacccctagggcacacagcgaacaaggagccaggccaggacttggcatggaccggttgactcctgagtgtgyccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttgga

SEQ ID NO: 20785 - DNA, 601 bp, Human
ggaacctacggggcctggctctgtgctgggggccagtacactagagaggcacacactagtgttcggcaattgagggggagaaataacgatgctgacacgtccaagaggtgaccaggcccaggccctgcaaggctctggggaggtgcgatctccattgacgctcacggcaccccacaggcaggaactaccacccatctcggtgtacagattgggaggccaaggccaggggctacccctagggcacacagcgaacaaggagccaggccaggacttggcatggaccggttgactcctgagtgtstccctaacctagaggaaggtgtaggatccaaaggcagaggctgtggttgggagaggaagggatgtagccagttcagctgctttccatttggccttgcaaccttctggcaacccctgagaggccatgggtgtccactcagcatcccggccaggctcggggctgagggcaggagctggagacgcacggagcggaaaggtctcctggcagccctgggtgcggtgtgcgttctttgggacaaaccagctccgggtgcctcgaccactcccaggaactaggtgggagggcaggaggggcacttgg

SEQ ID NO: 20786 - DNA, 601 bp, Human
aggagggtcgctggagcccaggagttcccggccagcgtaacacagtgagactccatctctacaaaaaactttaaaattagccaggcatggcagtgcgtgagtgtggtcccagctactcaggaggatgacgcaggaggattgtgtgagcccaggagtttcaggccgcagtgagctataatcatgccactgcactccagcctgggcaacatagcgagaccccgtctaccaaaaaataaaataattagctgggcatagtggtttgtgcctgtagtcccaggtacttggggtctgaggtgggagkattgcttgagcccaggagtttgaagccgcagtgaactatgatcacaccactgcagaattataccgtttccgaaaacaaaaaaacacaaaaaaaaccctgccagggtcacagagcaactgattatgacccagcacattctcatagacacattatatatttagctgcaagatgagttactgactggcgcaggtgaggtccctgcatctgtaaggcagttggacgagagcaatgtgcagggcggtcctgctgcatggcggagtcctaggttcagcaggtgcgaaagcggggcttcgtggcgga

SEQ ID NO: 20787 - DNA, 601 bp, Human
tcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcaccgccccctccagcgaggtggtccccccgcatctgggccaacgtcagggagggaggatgctggggcacagggctcggggaggacrcggggacccatctccagaaatcagccagcagggacagctggctggggaccagtccaaccgctcagccataagccatggagccagaagagggagctaacggctcagagctggagacccagtccacgcggcgcttacctgatggacaccgcgagggacagcacctccagcagcagggctgcactgaagaccgccagggcggcgggcgggggaggcacggtggccgcctcgtacttcaggaagcaggtggtggacagcgtcagaaacactgtggtcgacagaaacacatccaggagggagctg

SEQ ID NO: 20788 - DNA, 601 bp, Human
tttctctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcmccgccccctccagcgaggtggtccccccgcatctgggccaacgtcagggagggaggatgctggggcacagggctcggggaggacacggggacccatctccagaaatcagccagcagggacagctggctggggaccagtccaaccgctcagccataagccatggagccagaagagggagctaacggctcagagctggagacccagtccacgcggcgcttacctgatggacaccgcgagggacagcacctccagcagcagggctgcactgaagaccgccagggcggcgggcgggggaggcac

SEQ ID NO: 20789 - DNA, 601 bp, Human
ccatcctgttgagggtgacaggaccacccaaggggcttgtggtgcccaggacggggaccacacagggccaccttcctgctcaggaatacagagccgctgcgagccccctcagggagccaggctggtcccgagggcccagctttcccaagacgcacctgtggtctattcggagcctctgtcccctttaaaatgagctgtctttttattatcaggctatgtgtgctctttatccattctagatgttagaccttgtccgaggcctgatctgcaagtgttccctcccgttctgtgggttctttckctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccaggcccactacccccgctcatgtcttttcctttccttcctccagattgtttcctatcttctcaccttctcctttgcagtctctgaacctggaaatctggggacaagctggcagcggttggggctgtggaggcaccgc

SEQ ID NO: 20790 - DNA, 601 bp, Human
actcaaagccattcatttctgccctgggatgttggataagggcagcagacgctcaaggtcagggctgcctccccatgtctgtttgaagcccagctccggggcaccgttgctagtgggactctgctaggccggcagccatcctgttgagggtgacaggaccacccaaggggcttgtggtgcccaggacggggaccacacagggccaccttcctgctcaggaatacagagccgctgcgagccccctcagggagccaggctggtcccgagggcccagctttcccaagacgcacctgtggtctaytcggagcctctgtcccctttaaaatgagctgtctttttattatcaggctatgtgtgctctttatccattctagatgttagaccttgtccgaggcctgatctgcaagtgttccctcccgttctgtgggttctttctctttcttgatggtgttctttgtagcgcaacagcttaacttctgaggaagttgggcttgtctattctttcttctgttggcgtcacatccaagagaccactgcctgaggcaagtgcgtggagatgctgtttggctccggtactctgaagaggcgcctgctgtcccag

SEQ ID NO: 20791 - DNA, 601 bp, Human
ggagaggctgggcgggggccgctgttgtgactgaacagcaaaaaagcctctggcacagagccccccgcccccagccttcgggcctgaacacctaccatgcctctccctcttggctgcgtggtgtggccaggcgagggaacgctcactctccagccattccccacatggacgcaggcacagcctcacccttttagggtcctggacagccctggcttcctgatatttaaaggataatgaagactttggaatacttccaagaataaccacaaatatgcagaatacagaggccctaggagggggracagagggaaccaagttcccagtcagcagcgggaaagatgtgaggttggagggggccttcatgctggtccctgagactgcagggatctgaaaatgagacctcacgcctgctggggcagagcagagagggtgatgcaggaagcctcctggaggcaacgggcggggcctgggccagtcactgaggaggcgcctggctttcctcctgtacaggaaagggatggggtgcccgtataccccacagcgcaggttcccgtcaacctggggtcctcaacacggccctcagaggggccagggaagcctt

SEQ ID NO: 20792 - DNA, 601 bp, Human
ctggaattctgtggagcccgtgcagttgtcgcagcagaagaggcggtcctggcatctggtgggcaggcgccagggacagagctgtcctgcatgtgggcaggtgccacccagggaggttctgccctgcaccccacacagcagccaagcccctgggcacctgcaaaggcagaaggctgctgacagcatcttagcccagaggctgtgtcccagctacaaacagggtgctctgtggtggtgctgacacaccctggattttcttggagcgcagctcctgtggaaactgagtgacagtggtctctgttgtttggggcatcatcatcagtgtttcagaaaatcacaccacaggctgaacctggctcgtggcgcttagaccaccaaacccgcacacgcgtgccgtctgcatctgggctgtcatgttcatcgtgcatgttcacctgtagctggcggcttcaggactctccagacagcggggctctgttgtacgtgaggtccagcaccacgtatttcattttaaaagactttgtccttctaagcagagcgactgtattcactgactccttttgcaggcgtgtgtctagcgggcttcgtttcaggagtgtga

SEQ ID NO: 20793 - DNA, 601 bp, Human
ctgcgagaggcatgggggttagcaggagcgacggggcccggggtgggtcatcggccaggagacaggtgcgaggccgcagccagcgccgccctctgctctctcccgtgttgcccctgggatgggcgtgagagcaggcgtggggtgggagtctacctccctcacttttggtagaaggcaaggaagccaggcttagctcattgtacctgattctagggtcacatgttgcgttgtgataaaatatgcttgtgaaaagcacatgcttcgctcgcctaacagaacacgtgagagtatcacaggcccygaggagagtctcctgggggccaccacgttgccgtcaccggctcccatcagcttctgaggcaggaggtcttgacgggggcagctttggaggcgtcctggaattctgtggagcccgtgcagttgtcgcagcagaagaggcggtcctggcatctggtgggcaggcgccagggacagagctgtcctgcatgtgggcaggtgccacccagggaggttctgccctgcaccccacacagcagccaagcccctgggcacctgcaaaggcagaaggctgctgacagcatcttagcccagaggctgtgtc

SEQ ID NO: 20794 - DNA, 601 bp, Human
cacactggcagggactcgtgcccaccggggactccccagcccggccactgcccggccgtgagcatctgggcaggccaatgctaagtcggcttctaaaaaagctggctcaggagagtaaaagagttcgtgcctcttcaagggtttattttattttatttattttattttattttgtgacgcagtctcgctccatcacccaggctgcagtgtggtggtgcaacctcagctcactgcaacctctgcctcccaggttcaagcgattctcctgcctcagcctcccaagtagctgggattaaaggcrcctgccaccatgaccagctaattgtatttttagtagagacggggtttcaccatgttggccaggatggtctcgatctcttgaccttgtgatctgcccacctccacctcccacagtgctgggattacaggcgtgagccaccatgcctggccaaagggtttatttttaaattgctatcccaagtgatttaaagaaaagagagattagggagtccaggagagcgtggaaataaaacggctgagcctttacttacgtgtatgttggtctcatattcggaggtgacatgggagtagacggccagtg

SEQ ID NO: 20795 - DNA, 601 bp, Human
aacaccatcagcccgcccggaagctcatgctcacttgcaccagaaggatcatctcccacggccgtgctggttccctctccacggagtttagcacaggtcccttcctgatcagcagcagccgacccgggcacaagtcaattctgtgtgccaggtatgcttctcgcatggttaggaaaggtgggacagacgcttctttgtaaaatgtgaaggaaaataactgatttggaacttgatgaagaagaagccacactggcagggactcgtgcccaccggggactccccagcccggccactgcccggscgtgagcatctgggcaggccaatgctaagtcggcttctaaaaaagctggctcaggagagtaaaagagttcgtgcctcttcaagggtttattttattttatttattttattttattttgtgacgcagtctcgctccatcacccaggctgcagtgtggtggtgcaacctcagctcactgcaacctctgcctcccaggttcaagcgattctcctgcctcagcctcccaagtagctgggattaaaggcgcctgccaccatgaccagctaattgtatttttagtagagacggggtttcaccatgt

SEQ ID NO: 20796 - DNA, 601 bp, Human
acagatcaagcctctaggttccctacccagcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcaccagaaggatcatctcccacggccgtgctggttccctctccacggagtttagcacagktcccttcctgatcagcagcagccgacccgggcacaagtcaattctgtgtgccaggtatgcttctcgcatggttaggaaaggtgggacagacgcttctttgtaaaatgtgaaggaaaataactgatttggaacttgatgaagaagaagccacactggcagggactcgtgcccaccggggactccccagcccggccactgcccggccgtgagcatctgggcaggccaatgctaagtcggcttctaaaaaagctggctcaggagagtaaaagagttcgtgcctcttcaagggtttattttatt

SEQ ID NO: 20797 - DNA, 601 bp, Human
gtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatatcaccgataccagctaattgctcactatctgcagtcagtcttacttttgctagtgggcagtgtcaaggacagatcaagcctctaggttccctacccrgcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcaccagaaggatcatctcccacggccgtgctggttccctctccacggagtttagcacaggtcccttcctgatcagcagcagccgaccc

SEQ ID NO: 20798 - DNA, 601 bp, Human
caggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatatcaccgataccrgctaattgctcactatctgcagtcagtcttacttttgctagtgggcagtgtcaaggacagatcaagcctctaggttccctacccagcgtgaggctccctgttcacatggcatcacactcttctgcaggtgtgggaaatggcacgtgtcttcgtggaaaggaaagggaggcctccctgtttgagaaacgctgtgtgatcagtttccttcaaaacacttttccttggggcccagtgagatgtgatttggggctaaagtgtcaaacaccatcagcccgcccggaagctcatgctcacttgcac

SEQ ID NO: 20799 - DNA, 601 bp, Human
accctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctatacccggccgccaaaacattcgccactaatccatgtttccttttttttttgactgagtctcrctctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgggattacaggtatgagccaccgctcccggcctaatccatgtttctgtgtaacctaaaaatat

SEQ ID NO: 20800 - DNA, 601 bp, Human
cgtgagaagcaatgtgcaaatgcagccaggccctacgcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctayacccggccgccaaaacattcgccactaatccatgtttccttttttttttgactgagtctcactctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaagactgggtttcaccatgttggccaggctggtctcgaactcctgacctcaggtgatccacctgcctcggcctctcaaagtgcctgg

SEQ ID NO: 20801 - DNA, 601 bp, Human
ctctgagggcatctcattagctctttggtatgatgtgtgctgacagctattttgggtcatgatgggaaatatctctatcggggcgtgagaagcaatgtgcaaatgcagccaggccctacgcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagygcggccgagcctgtgaacactgggaactgcaagaggcgaagggttaggacagccgcccagggccaccccgccacccctgctatacccggccgccaaaacattcgccactaatccatgtttccttttttttttgactgagtctcactctgtcgcccaggctggagtgcagtggtgcaatctcagctcactgcaacctctgccttccgggttcaagtgattctcctacctcagcctcatgagtagctgggatgacaggctcccggcaccacacctcgctaatttttgtatttttagtaaaga

SEQ ID NO: 20802 - DNA, 601 bp, Human
ctttcatggccttgaccatcttctatgaaatccttcaggtcctactttcttagattccagcccattcatcagaagtcacctcggtataatgcaatggcagcattatgttttccaggatgtctacattcaactacccagagtgctgttctaaatgatattctttttctttcttttgcatattactctgagggcatctcattagctctttggtatgatgtgtgctgacagctattttgggtcatgatgggaaatatctctatcggggcgtgagaagcaatgtgcaaatgcagccaggccctaygcaacctcgggcaaggtggccacgcaccctggtgcccgcaagcagtgctggccgcgtacctgtctgggcacagggagacgtagagcaggagcagcggcccggcccccacgacggtggcgagggaggacctcatccaggagctgagctggcagaagttacagtagtgcacgacggcaatcagcgcggccgagcctgtgaacactgggaactgcaagaggcgaagggttaggacagccgcccagggccaccccgccacccctgctatacccggccgccaaaacattcgccactaatccatgt

SEQ ID NO: 20803 - DNA, 601 bp, Human
cttaaaataccctgaaaccagtagcaaatgtgtaataggcaattttgagacttattttttatttttatttttggagactgagtcttgctctgtcacccaggctggagtgcagtggcgcgatctcggttcactgcaacctccgcctcccagggtcaaccaattctcctgcctcagcctcctgagtagctgggactacaggtgcacaccgccatgcctggctaattttttgtatttttagtagagacagggtttcaccgtgttgcccaggctgtcttgaactcctgagctcagacaatccacycgcttcagcctcccaaaagtggtaggattacaggcgtgagcaccaagaccggctgggacttatttttaacaaatcaagaattattcagttagtgcaacacatgaaagatagggatcttactggatgtcgctaatggcaaatattttaaatatagcacctatcactgccatcctgtaagtttttacattttttgtagtacaatgatgagaactgggcttgtccccagaggtctaccggcctccctgactcctgtttctgtgtctgcgccatcccattcctcagcacctaccagtgatacgg

SEQ ID NO: 20804 - DNA, 601 bp, Human
ggtcccccatcactgtggctctccagctccaggtagaaaagccccgcagccatgactaaaggccacggtgaatgcccgatgagggacctgtgatggatttaaaaggtaaaaagcagtttgctggatttcatactctcgagaaagagctcatcgtgaccatcgttctagatggccataccttcagaaaaatccaagtctgctttattttgcttaatctattcattaaagtttcctttcaagtactgaatgacagtcctattttaaattccctttttgatcttaatttgcagggaatttaaakgtcttttgtattgtgattcttttcttaagtaaactgaggacggatgctcacactgcccatggctggactgttgctttgctaataaccaaagacaccccgtgcctactccgtctgatactgacaatactgcggcaaatagaatcattttgtgcttttgaatgaattcaagcagaggtccttggcaacagcaatgccactccaacggggcatttcggaaatgccaggggtccctctggttctcttaataactcagggagccagaatgttagatctcctgcaaggacaaggaagaaatgtccc

SEQ ID NO: 20805 - DNA, 601 bp, Human
ctcaaatctgtccatcttttcgttgtggttctatttattatttgtaagcctggaaagttatctcagttttagaggcttgaaaactattgaattttactttttctagattttatatagtttaatttttatttccgactcttcaatttatttagaatttattctgctgtttatagtaaagcaagggtcaaacatttagtattttggatttcaagtcagttattttattactttttgagacacagtctcattctgtcacccaggctggagtgcagtggcacaatcttggctcactgcaagctcygcctcccgggttcacgccattctcccgcctcagcctcctgagtagctgggactacaggcgcccgccaccatgcccagctaattttttgtattttgtttagtagagacggggtttcaccgtgttagccaggatggtctccatctcctgacctcgtgatccgcccgcctcggcctcccaaaatgctgggattacaggcgtgagccaccgtgcctggctgatttcaagtcggttattttaaaatattttacaaaataacttttttctttgatttgcgagatttcctttgttgcatgcgaaagt

SEQ ID NO: 20806 - DNA, 601 bp, Human
aggctggagtgcagtggccgatcttggctcactgcaacctccgcttcccaggttcaagcaattctcctgcctcagcctcccaagtggctaggattacaggtgcccaccaccaccccagctaatttttgtatttttagtagagacggggttttgccatgttggccaggctggtcttgaactcctgatctcaggtgatccacctgccttggcctcccaaagtgctggaattacaggcatgagccaacgtgcctggccttttttttctgagacagagtcttgctgtgacaaccaggctggggtrcaaggacaccatcacagctcaatgcagcctcaaattcccggcctcaagcccaccttagcttcccgagtagctgggactacaggtgcataccaccatacctggctaatttttacaattttttgccaaaacaggatttcgctatgttgcccaggctggtctagaactccaggcctcaagtaatcttcctgccttggcctcccaaagtgctgggattacaggcgggagtcaccgagcccggtccttttctgtgtgctttgattttctctcccttcctctcaaatctgtccatcttttcgttgt

SEQ ID NO: 20807 - DNA, 601 bp, Human
tggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcactcattcattatatcctaagtataaatctcgtacatatttttactatatataaatacctagttgtacctatagtacatatatagtttcacctagtaaatgaaaatcttaaatgttttccacatttactgcattttaacagttgtattatttgagtaaatgtataatcagttaatttatttattattgacaactacagttgctaatgaatcttttttttattttattttattttttgagacagagtctcactctgtcgcccaggctggagtgcagtggccgatcttggctcactgcaacctccgcttcccaggttcaagcaattctcctgcctcagcctcccaagtggctaggattacaggtgcccaccaccaccccagctaatttttgtatttttagtagagacggggttttgccatgttg

SEQ ID NO: 20808 - DNA, 601 bp, Human
gccatttaaaatctgcccctagggaggtggtcaggtcgggggagagggggtcagcagcggtggggttggagggcttctggggtagtggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcactcattcattatatcctaagtataaatctcgtacawatttttactatatataaatacctagttgtacctatagtacatatatagtttcacctagtaaatgaaaatcttaaatgttttccatatttactgcattttaacagttgtattatttgagtaaatgtataatcagttaatttatttattattgacaactacagttgctaatgaatcttttttttattttattttattttttgagacagagtctcactctgtcgcccaggctggagtgcagtggccgatcttggctcactgcaacctccgcttcccaggttcaagcaattctcctgcctcagc

SEQ ID NO: 20809 - DNA, 601 bp, Human
ctaatttttgtatttttagtagagatggggtttcacaaacatgttggtcaggctggtctcgaactcctgacctcaggtgatccacctgcctcagcctcccaaagtgttgggattacaggcgtgagccaccacacctggctcaaaaagaggcatttcatgtgactaaatgcaggagttaatttataagtcataaatggaagttagagtaaaatacagtgtaatccgttatcatggagaagagggattgaaaaactgaaaaaaatagaaagcaaacatcacttgcagtcctaaccagccaaaygtggcttcggttgacactttggtatatttcagtgccatttaaaatctgcccctagggaggtggtcaggtcgggggagagggggtcagcagcggtggggttggagggcttctggggtagtggtaatgctctacttcttggtctgggtggtagttaaatgggtgtgttctctggtgaaaatgcactgagctgtccttttatgatcaggtactcttctgtgcatactgacatacacatcaataaaaggttaaaaaaagatgctaggtgctttacttttaagtactaaagctgtaatcatcact

SEQ ID NO: 20810 - DNA, 601 bp, Human
gccctggccgtgggtggaacagaacccctgggccccatcctggctggaccgcgggggagtttcagaatcttgggtaagccatgccatctttctgggtctcagtttcctcgcttgtaagctgtgaagatggactggagcatggctacgtcccttccagcctaaggttccgtgcaggaaaggcctgaggctgccatccttggaaagacctgcctgcaaaggtggtggctggcaccagggagctgggatttggggagggttcctgccattccttgataagagcggctcacactgcctacactgyctaaataaggaggtttacgctgaatacccgctttcctgctggaagtctggaatttaggcacgtgctgggcagaggcgggagacctgaacagcccctaatacaagcctggacaccgagactttaatgagcttccctggtaggcagcatgttacaagtgttgtcaccactcactgctggaggaattaagcccatcccgtgtgactctaccgggagaggactcttggaagctggtgccggcttcctccaaacgtcaactcacacacccttccctttgctgattctgccttatgtcttttcgct

SEQ ID NO: 20811 - DNA, 601 bp, Human
tctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaaatttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaatttttgtatttttagtagagacagggtttcatcatgttggccaggctggtctcaaactcctgacctcaaagtgatcagcttgccttaaagtgctgggattacaggtgtgagccactgcacccggctttttgct

SEQ ID NO: 20812 - DNA, 601 bp, Human
aggcgtgagctgctgtgcccagccctgtaactaacatctttagtaagtgcttggtaatcgtttttcttttctttttctttttctttttttttagaagtctttagcttctttcaaaaatcttttcttttctctctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaaawttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaatt

SEQ ID NO: 20813 - DNA, 601 bp, Human
caggcgtgagctgctgtgcccagccctgtaactaacatctttagtaagtgcttggtaatcgtttttcttttctttttctttttctttttttttagaagtctttagcttctttcaaaaatcttttcttttctctctctcctttgtttttttagagacatggttgttgtccaggctggagtgcaatggcacaatcatggctcactgcagccttaaactcctgggctcaaacgatcctcctgcccagcctcctaagtagctgggattacacgcatgtaccaccacacctagctaattaaaaaawtttttttttgaagagacagggtcttgctggttgccaaggctggtcttaaactcgtaacttcaagccatcctcccaccttggccttccaaagtgctgggattacaggcttgaactgtgcttggcctaacatctttttttttttttttttttaagattgagtcttgctctgttgcccaggctagagtgcagtggtgcgatcttggctcactgcaccctctgcttcctgagttcaagtgatcctcctgcctcagcctcctgaatagctgggactataggtgtgtgccaccatgcctggctaat

SEQ ID NO: 20814 - DNA, 601 bp, Human
gttgttgaagtcgtccaccacgcgcatcatctccttggcgaactcgaacaggatctgcaggtgctcctgcgggtggctgccgtcctgggcctgcgcggtgttcagccctgacgccgccatgtacgtggctccgatggtcttgatcttctcgatgctgctgtagtccggcttgcttaggagctcgtcaaagtccccgatgagctcgttgaggacccggtagcactccttgccgccctcgtagttctcctcgtagaactcgctgaagttgacgatgctggcgaagatcacccctccgctgtcrtggttcttggagtaggtctgggacaccttcagctgctcagccacgtggtaggggatgatgttcctcagcagccagtctgcctggtcccgcatgctctggatcttggtgcggtgaagatccgcttccacgtctccgtggtagtggaggcggtagctgacttcaaattcgcgattcaggaaccagaccaacaagagcaggagaaagaagacgagaaccacctcctggccgatgaggctggcgggccgccggaggtcacgcggcaccgaactattgcacgggttcctctcggaactggagagc

SEQ ID NO: 20815 - DNA, 601 bp, Human
cacagcttttgttctaaaagtcaaataatacccaaagccatgatctccactggcggcctctgtcccgagactcgaggccgaggccagccctgaaggcacttgttctccaccacgtgctgaacggatgacccagaggcagcggggtttccagggaagggagcgaaagggaagaatggatgaaaatgaaccctgaataactgtgatccacacagaagttagggctgaaatgaccacataacaccacgtccggggagggcaactgtggcgcttggaaagcacaacagccaaatacaaatattaytgtgtttcgacaaacagagcacctcgggcagcgggtgggcgccgcctcacacactctttgaaacgttgagcttggtgagttcgttggcttcttctattcctgtttcgtcacagtcgtctttctctatggctttgccaaatcgacccctttcttcggctttgacgggctccttccacggtctcttgggggacaggtgggcatccttggcctgcgtgctgctgtcagaacccagagatgtcttgtccacatactggacagaaggcaccaggttggcaatctcgtctgtgggagaccgtccga

SEQ ID NO: 20816 - DNA, 601 bp, Human
gaacctatatccttaaaccaggagagagacctggtgcaaacctcagccttgccacttcctcaatgctatggacacccccgaggaaataacatcataacatctctgggcttaagtttctttttttctttcttttttttttttttttttttttttgagacagagtctccctgttacccaggctggagagcagtggctccatctctgctcactgcaacctccgcctcacgggttcaagcaagtttcctgcctcagccacccgagtagctgggattacaggcgcccgccaccacacccagctaaytatgtatttttggtagagacggggtttcaccatgttggccaggctggtctcgaactcctgacctcaagtgatccaccttcctcggcctcccaaagtgctgggattacaggcatgagccaccacgcctggcctgggcttaagtttctttaagtgtaagaggactaaatagttccttccccttagataccgcagcgtggcaagctcttcagaaacgccagatttctgaaagaagcagcaccttggagaatctgacgggtgctgggaaccctttctccaaaactgggcaaagagagagatgac

SEQ ID NO: 20817 - DNA, 601 bp, Human
aggttgcagtgagccgagatcgcgccactgcactccagcctggcgacagagcaagactccgtctcaaaaaaataaaataaaataaaaaagaagtttcactccaaagcctgcatttctggcctttcttgaaaaataggatggtctggccacccaggggctgttacgcctcgaacatccggtgtgtgcctctgatatggtagggtccctcgttggacagcaggaagcccaggcccagcggatggagaccccaaagctcagagagggcttccggcttagcagaggtcacacagcactgtgaccrccatctgatcccttccctgtggaatcaggtcagccccggggctcaccaggcggtatccaacccttcatatcgaggaacccgcacaaaagcttctggggcctgcatggaaagctgactccagcaccttcgactgtcagtgtctcagtttgcccagcttgagaatgggtacgacagtcggacgacaggaaggatgaagcacgaggaggcacgaacggtcttgagcacacagggagtacccaaaaaggtgggatatttgcagcagcaacaacaaaatcgagattcccctttctacttggagga

SEQ ID NO: 20818 - DNA, 601 bp, Human
tggatcacttgaggtcaggagtttgagaccagcctggccaacataacgaaagcccgtctctaccgaaaatacaaaaattagccgggtgtggtggtgcacgcctgtaatcccagctacttgggaggctgaaacagaagaatcgcttgaatcccaaaggtggaggttgcagtgagccgagatcgcgccactgcactccagcctggcgacagagcaagactccgtctcaaaaaaataaaataaaataaaaaagaagtttcactccaaagcctgcatttctggcctttcttgaaaaataggatgrtctggccacccaggggctgttacgcctcgaacatccggtgtgtgcctctgatatggtagggtccctcgttggacagcaggaagcccaggcccagcggatggagaccccaaagctcagagagggcttccggcttagcagaggtcacacagcactgtgaccgccatctgatcccttccctgtggaatcaggtcagccccggggctcaccaggcggtatccaacccttcatatcgaggaacccgcacaaaagcttctggggcctgcatggaaagctgactccagcaccttcgactgtcagtgt

SEQ ID NO: 20819 - DNA, 601 bp, Human
tgtcacattcgagcttgaggctgaggaggcacaggggggagatggggtggttagtggcggctgggcgggagccccccaccctccgttatccaggggaggaaactgaggctccaagtcccctgtaagggcaagatcagccaattctcagagggtcaagcaataattttttttttaaattgagacgggggtctccctatgttgcccaggctggtctcaaaaactcctgggctcaagcaatcctccttcctcggcctcccaaagtgcttggggttacagatatgagccacccaccgtgcctggycaatgaagccgtaaactttcataggggctgaggacattgaattgaggggcagggaagttggtaagagttgagctctctgtgatgctgcggggaggggagagcatcagggcccctgactgtaagaagggggtgatgaaaccacccttgcagatctggttggggggaaataagcaacattatagtaacattataggaacaacagaagttagagggggcacggtaacgctagctctgagagtctcacgagccttcacctctcacggtcccgacgaggcccgcaacgtcattgtcacgctcctt

SEQ ID NO: 20820 - DNA, 601 bp, Human
aagccggcttcagtcctgggcgggtggcaggtgcaggctagccacaggaggcctgcgcggggcccggcccagccctgccacttgcggcttctaagaggggctaggtctggccagggtgggatgagcaaagccgtgttcgggcccgagggcagccagtcagtggcaaaggtggggctggacaccggctgtcgcctgcagcttagagtgaggtaagtgcaggatgaggccagactgcacattcctcgggggtcggccactcaggcccctggcaggtagtaagcgcttgtgcgaatgtagggasggctgggggccgtaggctgtggggaaggtctctgcccctccccaccaccgggagaaacactcccagggaggcctgaaaaagaggcggggcgggggggaggagagcgggagcttggggagggcttaggaggtaacaggataaccgggctggcttggtgcccagccgagggccggccgctacctgcctgggggtgcccaaggcggggctggaggtggggggaggagggggaaggaggaggaggaggaggaggaggaggagatgggcgtacctgtttgtgcatctcgatgttcaagccgtagg

SEQ ID NO: 20821 - DNA, 601 bp, Human
ctcctgatcctgggagaggagagggggacggccctgaggccaggaggagccccactaccaagtgggccatcatgtctgctcctcccagtggttttcaaccccatcagaaagcaccctccctctctccaactgcttcctttcaccaagctcgtctcttcgtctggccaacagagacaaatggaaaagtgcagaaaacaattaaaagggttttgtgctaagtagttaggaaacagcttttgagtgagcccgggagaaaccctggatcctgacctatcctatgtgcacagccacctgcaaagaygtgaaacatgtgaatgtttgtgcagtacacaacctgcccaactgtacagggacgtcctgatcctaggagctccaagactgtgccctgagtctggccaaattgagcccttctcctaccatggctggggagggcccaatgaattctggcagggctggctggggaatgggctcagattcagggcagttcctccctgagctctccccaaacacctgactctgtggccagcagatgctagaatctaccaatctccctttttgccttggctaccaggaagcctctgttctgaagggctccaagtgc

SEQ ID NO: 20822 - DNA, 601 bp, Human
gggagaggaccaggtgggcgtggaggtgtctggaactagcagaggtggtgagtggggcaggtggaggtgggagcatacctgggacccggggtcgggggagactcggggtgcccaggacgggaaaggggcagctagcattgcgtgcatgcagtaccagggtgagagggctgtggcccaggcagactgtcggttacacatgttcaaaacgggggaagggccggggctgctgcgcttcgcgaggtcttgctcccttgggacctggtctcccatctgaccctccaggccttagcttgcctcacaygtcagggcaggtatccacctaaccaggctgcaggggaggaggagggaagccgggaatggggtaggaagaaagctagaggtggcctgcaagctgggctggggcccccgccggcggccaccataaatactatgggagtttagccaatcccgagctccgctgtgtcttgtgctaaacattcctttctctccgtgcctctgtctcccctctgtcccccctcccaacctccccgtcccggccccctgctaatccgacttctcgccatcatcctcctggtgggtgtcaccatcgtgcccgttcttg

SEQ ID NO: 20823 - DNA, 601 bp, Human
atacagaaacaaattcacatacatagtcatctgatttatgacaaagtctcaaatgcaattgagtggggaaaggatgatcatttttataaaagagatgaggtcaatggaatatctaatagagaaaagataaggattctgataactaccttccactaaaaacaaaaattgttttcccttgagttatagatttaaatgtgagtaccatcttatttttacaaatctaaatgtgcaaactatcatatttgtaagacataaataccagctatttgatgattatctgatattatttgaagtgtgcagycatatttcttccaaattctcttgtctaatgattttctctcattatagtcaatttgatccattgcattatatgtaaaaggtctttgtgaaaacaaaaggaaggtggttggtggttgctttggtatatattactaaaggtaagatttccataagcagttttggagagaataattcagagagtacaaagcattaatgggattgagatagaaactggaaagggagtgagggagcaggaagggcccaaagggaagttgaggagggctgaggtggggcacaaaagttgtgtaatttacaagtccaa

SEQ ID NO: 20824 - DNA, 601 bp, Human
ttaaacaaataaaaattgaaacacagcataccaaaacctatggggatacagcaaaagctgtgctaaaaggcaagtttatactgacaaacaactacctcaaacaaaagaaagattttaaataaacaatctaataatgcatctcaagaactaaatgaaaataaggacaaatcaaacccaaaacgggcagaagaaatcacaaagtttagagcagaactagacaaaatagagactttaaaaaatatacaaaggataaaaaaatgttgattttttgaaaatataaacaagaccaataggccgagtwaccaagataaaaaagagaagacccaaataaacaaaatcagaaaaacaaaagatattacaattgtcactagagaaatacagaagaccacaagacaatcatggataactatatactaacaactgaaaattttagagaaaatgaataaattcctggagacatacaacctaccaagattgaatcagaaagaaatagaaaccagagctgaccaataatgaataatgacactgaattataataaaaactctaccaataagaaaagtccaggatcagatgatttcactgctgaattctaccgaatct

SEQ ID NO: 20825 - DNA, 601 bp, Human
gaaattaaggagtaaatcaaacaattttttaaacaaataaaaattgaaacacagcataccaaaacctatggggatacagcaaaagctgtgctaaaaggcaagtttatactgacaaacaactacctcaaacaaaagaaagattttaaataaacaatctaataatgcatctcaagaactaaatgaaaataaggacaaatcaaacccaaaacgggcagaagaaatcacaaagtttagagcagaactagacaaaatagagactttaaaaaatatacaaaggataaaaaaatgttgattttttgamaatataaacaagaccaataggccgagtaaccaagataaaaaagagaagacccaaataaacaaaatcagaaaaacaaaagatattacaattgtcactagagaaatacagaagaccacaagacaatcatggataactatatactaacaactgaaaattttagagaaaatgaataaattcctggagacatacaacctaccaagattgaatcagaaagaaatagaaaccagagctgaccaataatgaataatgacactgaattataataaaaactctaccaataagaaaagtccaggatcagat

SEQ ID NO: 20826 - DNA, 601 bp, Human
aactagaaatcaataacaagaggaaatttggaaactgtaaaaaatgtggaacttaaacaacagactcctgaatgaccactgggtcaaggaagaaattaaggagtaaatcaaacaattttttaaacaaataaaaattgaaacacagcataccaaaacctatggggatacagcaaaagctgtgctaaaaggcaagtttatactgacaaacaactacctcaaacaaaagaaagattttaaataaacaatctaataatgcatctcaagaactaaatgaaaataaggacaaatcaaacccaaaackggcagaagaaatcacaaagtttagagcagaactagacaaaatagagactttaaaaaatatacaaaggataaaaaaatgttgattttttgaaaatataaacaagaccaataggccgagtaaccaagataaaaaagagaagacccaaataaacaaaatcagaaaaacaaaagatattacaattgtcactagagaaatacagaagaccacaagacaatcatggataactatatactaacaactgaaaattttagagaaaatgaataaattcctggagacatacaacctaccaagattgaatca

SEQ ID NO: 20827 - DNA, 601 bp, Human
tttatcttatagctataagataaaacagactttaagttcaaaacagcaaaagcagacaaagaaggtcattatgtaatgaaaaagggatcaattcagcaagagaatgtaacaattctaaatgtatgcacccaacaatggagcacctagatatataaagcaaatattattatatctaaagggagagacaaactccaatgctataatagtggggacttcaacaccccactctcagcattagacagatcatctatatagaaattaacaaagaaacattggatttaagttggatattaaaccaaasgaacctaacagacatttatagaacattttatccaacagctacaaagtgcacattcctctcatcagcacatgaaacattctctaggatggaccatatgttacaaaacaaaacaagtctcaacaagtttttaaaaattgaaatgatgtcaagtatcttctctaactacagtgaaataaaactagaaatcaataacaagaggaaatttggaaactgtaaaaaatgtggaacttaaacaacagactcctgaatgaccactgggtcaaggaagaaattaaggagtaaatcaaacaattttttaaa

SEQ ID NO: 20828 - DNA, 601 bp, Human
atttgctttctacctggagtctgaaaaaagaaagcataatactacttttgttggcaaattggaacacattatttactttaactcagactcatgtttaaagtttatgtaataaatttgtgttgggggttaaatttatcttcttgtttaaatttaaaattcttaagcctttattttatgaccaaactatctataaaatgtatgaaaatattctaataattctctgttatagagcatcaacctattgttttatcaatgccttctactttttcttttgtattcttggtcaaaagcggattgggtrtggtttcccttggacgggtagggttctacttatctgctctttgctctggacttttaactagtgatactaatttcttctttcacatgacaatctgggccaggctgtttcccagaacttggcctaagtggtctaaacagcctagtactaggtcttgatggcaaatataggtttctgactgtttgcccttttcccattcctctggaatggtggctatacttcaggttagctttttccttattatgaagcatgaaggtcacccttcctcactggggaagtaaaatggtcagagaatcagaggga

SEQ ID NO: 20829 - DNA, 601 bp, Human
ggttagtctatttgctttctacctggagtctgaaaaaagaaagcataatactacttttgttggcaaattggaacacattatttactttaactcagactcatgtttaaagtttatgtaataaatttgtgttgggggttaaatttatcttcttgtttaaatttaaaattcttaagcctttattttatgaccaaactatctataaaatgtatgaaaatattctaataattctctgttatagagcatcaacctattgttttatcaatgccttctactttttcttttgtattcttggtcaaaagcrgattgggtatggtttcccttggacgggtagggttctacttatctgctctttgctctggacttttaactagtgatactaatttcttctttcacatgacaatctgggccaggctgtttcccagaacttggcctaagtggtctaaacagcctagtactaggtcttgatggcaaatataggtttctgactgtttgcccttttcccattcctctggaatggtggctatacttcaggttagctttttccttattatgaagcatgaaggtcacccttcctcactggggaagtaaaatggtcagagaa

SEQ ID NO: 20830 - DNA, 601 bp, Human
ggctgtctacagttgcccaagtaatagagcctcgcatttacctccctccatttttttcaataatatgttctctattctaggtgatccacctgccctgctgcttaggcattaggcaatgtctggggaaatttgaggttgtcgtgatgggcatgatagggggagagtgctcctgccattttgtgaatagagggcaaggatgctgctgctaaattcctgcaaggcccagaacagccctcaccacaacaaataattatcccatacaaaatggcaataaggttgaagttgggaaaccctacattaraaatactcctattaaaatccctgacaagctcaatttgcatatgcaatattgttttaatgactttattctgcttggtttattggcagctgactcttttgactaaactttcagtgtagaaatactctttcttttggtgtaaggaacaaacacactctttatttttctctttcctttctttgcttctttcacctggactgattgtggctactgtctagctttcaactggcctcccagaatccactaatgctttactatgtctatagcctctctcccactccgtgatccattctttcataatgc

SEQ ID NO: 20831 - DNA, 601 bp, Human
cataatggtgagtgagttctcatgagatctggttgtttaaaagtatgtggcaccccccaactctctctctcttgctccctctctcaccatgtgagacacttgctcccccttcaccttctgccatgattgtaagcttcctaaggtctcaccaaaagccaagtagatgtgggtgccatgcttcctgtacagcccgcagagtcataagctaatgaaatctcttcttaataaattaccaaggctcaggtatttctttacagcaacacaaaaacagcgtaacacagaagcaataatgtttttttttattatttcctggaaactagcagtaagttacctaatttatatgctttaagatgggctcatttttgagcacctaaaattgtcttatgggcagctgagcagggctgcatataacttatttctcaactgcattatcgttccaaagctaagcagatccccatggtgctattgttcagtagctatagtaactccacagaatggagacctaggtttctagctgctcactccactcttctgcaatactgagattttttattcatttctcctgatggtcagaacttggaatctgaaaactccagaactt

SEQ ID NO: 20832 - DNA, 601 bp, Human
aggccacaaatttcttagatttttagctttctagatatttattgtatttttatcctttaatcctttgataaggtaaattatatgattagtttaatgttaagatactcctggattcctgccacataccctttgtgtctaagtgtatcaatcttaaaagaaaatgctatttactagtgttttatttaggatttctgcattaatttctgtgattatgcctcttttttatatgctttatcttcattggcttttaacatcaaatttaagtaggctttatttcaagtggattttattttagattttrtgtaacttaccaatgggcacatgtgagaacatagtgaaaggaagcagtctttaagccagaaggagaatcctctcaagaaactaactatgctggcactctaatcttggacttccagcctttgtgaattcaataaaataaacttctgtggtttaagtcattcaggaatgtgatattttgttatggtagactgagcacactaaaacagattttggtatcaagaactgagatgctgcttcaacaaatacctaaaaatgtggaagcagccttggaattggataatgggtagagactggaagttct

SEQ ID NO: 20833 - DNA, 601 bp, Human
aaagcgaatttctctgatttcattgtcttcattcctggaaacaggaaatgagagaaatcattttgataaaacgtgttctattttgaaagtgacaccgattcactttgaaggagacaaatcaagattatctgaaggtgatggaattcagttaatataccacagcgatgagataatgcttttgtgataaaattagtgtgttagttgacttatataggaaatagaaggtttgaatccaggccacaaatttcttagatttttagctttctagatatttattgtatttttatcctttaatcctttrataaggtaaattatatgattagtttaatgttaagatactcctggattcctgccacataccctttgtgtctaagtgtatcaatcttaaaagaaaatgctatttactagtgttttatttaggatttctgcattaatttctgtgattatgcctcttttttatatgctttatcttcattggcttttaacatcaaatttaagtaggctttatttcaagtggattttattttagattttgtgtaacttaccaatgggcacatgtgagaacatagtgaaaggaagcagtctttaagccagaaggaga

SEQ ID NO: 20834 - DNA, 601 bp, Human
gaaactttttacatgttaatgtcttttattgaaagagatggtgtatataaaagatgaaagtacatcagcatggataaaactaaagtgctggggtgtgggaaagaaagtagatgagaagttctagttctggactaatttgaaactttagaaaagacgggcagggctcaatgacttatccctgtaatcccagcactttgagagggcaaagtggaaggattgcttgagcccgaaagtttgagaaaagcctgggcaaaaaaaaagcatcttcatatctacaaaaaaaaaaaaaaaaaaaaaaaamaattagttaggcctggtggcgtatgcctgtagttccagatacttggaaggctgaggtgggaggatagctggagcccagaaggtcaatactacagggagctatgttgacacctctgcactccagcctgagtgacagaacaaggccctatctcaaaaggaaaaacaaaaaagaaaagacaattcttacccatgtatgtctaaaaacataatgtagataatatctgcttctaaatacaactttaaaaagtaaatgttctggttttaaaaagcctttttaaatatgatatttgtttatctgagc

SEQ ID NO: 20835 - DNA, 601 bp, Human
tgcatcttgtatgcaatcagtactgaatacatattttgttaaattaatggcatacgaagcttttttattgtttcttgcttcacaaatgtatatatagatgtgtcaataaaacaatgagacatttaaactacttccaattaaatgatatttaccttgcaagatgagactgaactctgtttgctttgtggattcctttaatgattgatttaaagtagaagtaaaattttaaaagtgaagaattattactggatgttagttgtgcagggaagataatcagagtggttgaaaatatggggaaggygggggtgggagttgaaccacataagacctattttagcccaggttactgttgagggacccagttataccataagttgaattatgccaacttaaaaactataaatcacatgatttaaatttaaggcaggtgttggacttgaccttttactccagcactaagaaagtttaaaacagtgttacttcaggatgtatcaggatgggagttaaggtctccagcatgattaaaatcagtgaaatttagcagaagctactgaactatagcaaaagacatgaatccaacagacatctcctcctcatcgtc

SEQ ID NO: 20836 - DNA, 601 bp, Human
gccccagttgcaaagtctctcccaaagtggttcagcagctgcttatggctctctccttgtgtccccacaatggtcagtgagatggagtcccgtgttcccgacaagaggtcggtgcctgtggccaccctgactttgtaggtggccatggctgctcttcaggaggcaagaggggcactcagtcccagacaccgtggaggggccacacgaaggcccaaggcaggcaagagaagccaggcacagagtggagtggacagggctggcctccgaggtgcagtggtgaggtggcgaggtggggtgactrggcctgccagccaaattctggaaaagctgctgcccttggtggccggggtgggtgccgggcaggcccaggcggagcccagctggtggtgagtgagcaggtgtctgggctccaagccttctgggagctggtggggaggaagagcaggcagggcactgggcctgcctctgaaagggcggatagaagatgccgtggatgaaggcgccttcagggtgggggagccagtccagcctgagccagggccctagggaagttgcgggagggggcagggtgtggtccccagatctttatcagactaataag

SEQ ID NO: 20837 - DNA, 601 bp, Human
ccgtcccaaaaaaagaaagccagggcgtcataattataagaccacagcaccatggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacatggccgggcatcttataggagtcagggaggactggagatgtagcggggagygcactctgggaatgctgtctgctgccagatggggatgctgagggtagctgctgggcctcaggcacctctcttcctccaatgtgcagccccaagctgagctcagggcagcagcactgactgagggaaatgtgtgacagtggcaggagagcccaggagtccctggtggggctgggcccccctctggcttgatgggagcctgggtgccatgccagggtagcaggctggagctagaggcctcacggccataggatggagcagggtgatgagggcttacctgtggcctcccggagtgccagggtc

SEQ ID NO: 20838 - DNA, 601 bp, Human
aagagtgaaactccgtcccaaaaaaagaaagccagggcgtcataattataagaccacagcaccatggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacatggccgggcatcttataggagtcagggaggactggagakgtagcggggagcgcactctgggaatgctgtctgctgccagatggggatgctgagggtagctgctgggcctcaggcacctctcttcctccaatgtgcagccccaagctgagctcagggcagcagcactgactgagggaaatgtgtgacagtggcaggagagcccaggagtccctggtggggctgggcccccctctggcttgatgggagcctgggtgccatgccagggtagcaggctggagctagaggcctcacggccataggatggagcagggtgatgagggcttacctgtggcctcccgg

SEQ ID NO: 20839 - DNA, 601 bp, Human
tgagccgagatcgtgccattgcactccagcctgggcaacaagagtgaaactccgtcccaaaaaaagaaagccagggcgtcataattataagaccacagcaccatggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacrtggccgggcatcttataggagtcagggaggactggagatgtagcggggagcgcactctgggaatgctgtctgctgccagatggggatgctgagggtagctgctgggcctcaggcacctctcttcctccaatgtgcagccccaagctgagctcagggcagcagcactgactgagggaaatgtgtgacagtggcaggagagcccaggagtccctggtggggctgggcccccctctggcttgatgggagcctgggtgccatgccagggtagcaggctggagctagaggcctcacggccatagg

SEQ ID NO: 20840 - DNA, 601 bp, Human
aggtggaggttgcagtgagccgagatcgtgccattgcactccagcctgggcaacaagagtgaaactccgtcccaaaaaaagaaagccagggcgtcataattataagaccacagcaccatggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacamggggtatttttaacatggccgggcatcttataggagtcagggaggactggagatgtagcggggagcgcactctgggaatgctgtctgctgccagatggggatgctgagggtagctgctgggcctcaggcacctctcttcctccaatgtgcagccccaagctgagctcagggcagcagcactgactgagggaaatgtgtgacagtggcaggagagcccaggagtccctggtggggctgggcccccctctggcttgatgggagcctgggtgccatgccagggtagcaggctggagctagagg

SEQ ID NO: 20841 - DNA, 601 bp, Human
taatgccagcactttgggaggctgaggcaggcagatcacctgagttcaggagtgagaccagcctggccaacaaagtgaaaccccatctctactaaaaatgcaaaaactagcatcaggaggctgaggcaggagaatcgcttgaacctgggaggtggaggttgcagtgagccgagatcgtgccattgcactccagcctgggcaacaagagtgaaactccgtcccaaaaaaagaaagccagggcgtcataattataagaccacagcaccatggagacctgttgaactcaaagggcttctaaatrggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacatggccgggcatcttataggagtcagggaggactggagatgtagcggggagcgcactctgggaatgctgtctgctgccagatggggatgctgagggtagctgctgggcctcaggcacctctcttcctccaatgtgca

SEQ ID NO: 20842 - DNA, 601 bp, Human
aatgctcaattagaaaactggggctcatgcctgtaatgccagcactttgggaggctgaggcaggcagatcacctgagttcaggagtgagaccagcctggccaacaaagtgaaaccccatctctactaaaaatgcaaaaactagcatcaggaggctgaggcaggagaatcgcttgaacctgggaggtggaggttgcagtgagccgagatcgtgccattgcactccagcctgggcaacaagagtgaaactccgtcccaaaaaaagaaagccagggcgtcataattataagaccacagcaccayggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacatggccgggcatcttataggagtcagggaggactggagatgtagcggggagcgcactctgggaatgctgtctgctgccagatggggatgctgagggtagctgct

SEQ ID NO: 20843 - DNA, 601 bp, Human
agtctaaaaaatgctcaattagaaaactggggctcatgcctgtaatgccagcactttgggaggctgaggcaggcagatcacctgagttcaggagtgagaccagcctggccaacaaagtgaaaccccatctctactaaaaatgcaaaaactagcatcaggaggctgaggcaggagaatcgcttgaacctgggaggtggaggttgcagtgagccgagatcgtgccattgcactccagcctgggcaacaagagtgaaactccgtcccaaaaaaagaaagccagggcgtcataattataagaccrcagcaccatggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacatggccgggcatcttataggagtcagggaggactggagatgtagcggggagcgcactctgggaatgctgtctgctgccagatggggatgctgagg

SEQ ID NO: 20844 - DNA, 601 bp, Human
aaaatagggagtcctttggagcaatagaacatcccatcagtctaaaaaatgctcaattagaaaactggggctcatgcctgtaatgccagcactttgggaggctgaggcaggcagatcacctgagttcaggagtgagaccagcctggccaacaaagtgaaaccccatctctactaaaaatgcaaaaactagcatcaggaggctgaggcaggagaatcgcttgaacctgggaggtggaggttgcagtgagccgagatcgtgccattgcactccagcctgggcaacaagagtgaaactccgtcycaaaaaaagaaagccagggcgtcataattataagaccacagcaccatggagacctgttgaactcaaagggcttctaaataggatagcaaggtgctggttggaataatggggcatcctgttatagtaacagaatcctgctggagtaacagggcgtctttctggagcgcatatgattggcatcataaataggcctcctgtgagagtcctgagcctgtacttagcatcacaaggggtatttttaacatggccgggcatcttataggagtcagggaggactggagatgtagcggggagcgcact

SEQ ID NO: 20845 - DNA, 601 bp, Human
tggttcacgcctgtaatcccagcactttgggcggccaaggcaggtggatcatgaggtcaggaattcaagaccagcctgaccaacatgatgaaaccccatctccactaaaaatacaaaaattagctgggtgtggtgttgcatgcctgtaatcccagctactctggaggctgaagcaggaaaatcacttgaacccaggaagcagaggttacaatgagctgagatcatgccactgcactccagcctgggtgacgaagcgagactctgtctcaaaagaaaaaacaaaaacaaaacaaaaaaaaaacaactccgttcagatgtcatcttattggattctcacatccaccctatgaagtaggttctgttgttatctccattttacagatgagggaaccaaggcttagaagaatttggaaatgtggccgggtgcggtggctcacacctgtaatcccagcactttgggaggccaaggcaggcagatcacaaggtcaggagatcgaaaccatcctggctaacacggtgaaaccccatctgtactaaaaatacaaaaaattagccgggcgtggtggcactcgcctgtagtcccagctactcaggaggctga

SEQ ID NO: 20846 - DNA, 601 bp, Human
gctccctctgccttcctggccattccaacctctggggctgtcttggaggccgccaaggttgggggagagggaaagttcttgcaggagccctcgttctcccgtcactcacacgcactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccmggggaaaaccatgggcggggcccagcacagcttcgggtccttactcaggccggttggggttgcgatgcctccgcaccggagggcggtaactgggaatgtgcacatagctgggcaggccaggaagaaagactcgccagctgcaagggaaaccgagatgtcaccctcatgcccgtgcaccaccccagggcaaagggccagagccatcactgccccccacctccctggacccctgccgggcgcccagactctgccacccgccccctcactggtagaagtcctgcttggctctgatctcctctt

SEQ ID NO: 20847 - DNA, 601 bp, Human
attccaggaagaggccttcagaggggctgccaagcgccggctggggcaggtggcggggccgccccatccacttaggtctctgggtctcagggtctgtgcgtcgcaaagtctctgggtcccatgtctcaaggtctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacacgsactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgtgcacatagctggg

SEQ ID NO: 20848 - DNA, 601 bp, Human
ggattccaggaagaggccttcagaggggctgccaagcgccggctggggcaggtggcggggccgccccatccacttaggtctctgggtctcagggtctgtgcgtcgcaaagtctctgggtcccatgtctcaaggtctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacaagcactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgtgcacatagctg

SEQ ID NO: 20849 - DNA, 601 bp, Human
cctaggagatgggattccaggaagaggccttcagaggggctgccaagcgccggctggggcaggtggcggggccgccccatccacttaggtctctgggtctcagggtctgtgcgtcgcaaagtctctgggtcccatgtctcaaggtctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctccagtcactcacacgcactcacatgggccccaggcggacgaagaaggaggccgtcttgaggaaggagtagcggagatttaagttcaggaacttggtggccttaaagttgatgagaattgggaatcccggaatatagccattccacctgtggggagaagcgcagggcaactgggatccagggggcggggaggaggcaggcgcccaggggaaaaccatgggcggggcccagcacagcttcgggtccttactcaggccggttggggttgcgatgcctccgcaccggagggcggtaactgggaatgt

SEQ ID NO: 20850 - DNA, 601 bp, Human
ctggcgctgagcggccggaggagcccggtgcgacattttccaagaagccgccagagggcgcgcgcgcgcctcgctgcctctcccgtcccactgccccgaagtcgggggcctgcctagcacgccggagaccgcctggctccccctgctcgatccgggacgccccattccataccggagacgacagatttcttgccagggaaaattttcctaatgtccttcagcctcttccacgaatgtttgcagtccaacaggccgcggactttgaaagccagtgccctaggagatgggattccaggaagargccttcagaggggctgccaagcgccggctggggcaggtggcggggccgccccatccacttaggtctctgggtctcagggtctgtgcgtcgcaaagtctctgggtcccatgtctcaaggtctttgcatctctaggtctctgggatcatgtctcaggttttctgggtctgcgtttcagctccctctgccttcctggccattccaacctctggggctgtcttggaggccgccaaggttgggggagagggaaagttcttgcaggagccctcgttctcccgtcactcacacgcactcacatgggc

SEQ ID NO: 20851 - DNA, 601 bp, Human
gccaggtgccgtggtggctcacacctgtaatctcagcactttgggaggctgagggaggcggatcactggaggtcgggagttcgagaccagcctggccaacagggcgaaaccccatctctactaaaaatacaaaaatcagctgggtagggtggcgggcacctgtattctcagctacatgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagca

SEQ ID NO: 20852 - DNA, 601 bp, Human
gggaggctgagggaggcggatcactggaggtcgggagttcgagaccagcctggccaacagggcgaaaccccatctctactaaaaatacaaaaatcagctgggtagggtggcgggcacctgtattctcagctacatgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagaaaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagag

SEQ ID NO: 20853 - DNA, 601 bp, Human
aaaccccatctctactaaaaatacaaaaatcagctgggtagggtggcgggcacctgtattctcagctacatgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccag

SEQ ID NO: 20854 - DNA, 601 bp, Human
accccatctctactaaaaatacaaaaatcagctgggtagggtggcgggcacctgtattctcagctacatgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccagga

SEQ ID NO: 20855 - DNA, 601 bp, Human
tgggaggctgaggcagaagaatagcttgaacccgggtggtggaggttgcagtgagccgatcacgccattgcactccagcatgggggacagagcaaaactccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcrgcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctggg

SEQ ID NO: 20856 - DNA, 601 bp, Human
ccatctcaaaaaaagaaaaaaaaaaaggaaggaaggaaaaggaaggaaagagagaaagaaagagagagaaagaaagaaagaaagaaagaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatggggsctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctgggctgcaggcttttgctcctggtctgtgggatcagagcagccacaggctcatttggttcctggtgattctccatgtgtcatgaattccacccctaaggaaa

SEQ ID NO: 20857 - DNA, 601 bp, Human
gaaagaaagaaagaaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctgggctgcaggcttttgctcctggtctgtgggatcagagcagccacaggctcatttggttcctggtgattctccatgtgtcatgaattccacccctaaggaaaccattgcaccaaatctggcagcaacagccccaagagagggaatagacattgagatctactgtgtccatggagacccagagtcagcct

SEQ ID NO: 20858 - DNA, 601 bp, Human
aaagaaagaaagaaagaaagaaagaaagaaagagaaagaaactgctttaaatgccttacctttgctggtgtcttccttgccctgggactttttcatgcatcggcttgttgtgtcctcccagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctgggctgcaggcttttgctcctggtctgtgggatcagagcagccacaggctcatttggttcctggtgattctccatgtgtcatgaattccacccctaaggaaaccattgcaccaaatctggcagcaacagccccaagagagggaatagacattgagatctactgtgtccatggagacccagagtcagcctaggccctgccaaa

SEQ ID NO: 20859 - DNA, 601 bp, Human
cagaaatctgagtagagccagaaacacgcccttcaagccccaggaaactcaccctccagggctagcaaggggtgagatgggggctctctctgtgctctgggctcagcattggagatcacaggggaaaactgggacttggagataacagaggagttggagataacagaggacttggagataacagctagtgaggattcccttggcacaaagccaggaactgcattcagaaacagattttcaaaagatcttgatccggccaactcatctgctatctaaagcctgggctgcaggcttttgctcytggtctgtgggatcagagcagccacaggctcatttggttcctggtgattctccatgtgtcatgaattccacccctaaggaaaccattgcaccaaatctggcagcaacagccccaagagagggaatagacattgagatctactgtgtccatggagacccagagtcagcctaggccctgccaaaacgagctgtgagatcttagaccaattttttcatctcttcaattcttattttcttctgtaaaagaaactaagaataccaatctcgtttgggttaggaggaacaaatgagaaaatggtta

SEQ ID NO: 20860 - DNA, 601 bp, Human
cattgcctgggagcttgttagaaatcagaatctgcatttaaccaagatctctatgtgagagggattcaagtctgagaggaagggtttggccaccacctggtggcagtgtactttaattgcaaatttttctttgaagttgaaagctcaaacccaaaagcaagttttgaatgaatcaaagaatgaatgagtgagagcatgactggctaggggtcatcaagtttgcagatacatgaatttaccatttccctggaaggtctttggctgtgttgcttgtttgagaatagaatttagagatgcctcrggcggctccccctaaactatgaaggctgaagtgcctctctatgggacacctaccaaaggcaactgaaaccttctgcgcagcccctgtcccaggatagtctcgcctctacaagatgcgtctgtgttagtcgggacttctatagttgcaagaacaaaagctaactccaactagcaggcagaaaaaaagtttgtcggccagacacagaggcacttacagaaacacaggcaggaattgtccacccagtggaaaatggccataactaacagtctgtgtttactgctataatctacatatccagag

SEQ ID NO: 20861 - DNA, 601 bp, Human
tgctgaccaccttccctctctaccctccaggtggaaggcttacaacccaggttggcctcactgcctggatgaaaagacagtggaagacttggagctcaatatcaaatactccacagccaagaatgccaacttttatctacaggctggctctgcgtgaggatgcccacccttccctgcccctgggcctcagatgccctatgacctctgccttctgccctcccctagtcagttcccccaccctcagtgatatgagtcacatagtcctgcccaggaaacagcctccttcccactaccaatcccrcagagcaacagctaccttaggggtagtgactaccttgggcccggaggctggttcaggatcccaagaggcataaggctggctgacagggaagggtctcccagggcctcctccccactccccacccctcacatcccctggcagttttgcagagatgaaaatcaaggggttgctggaccgcaaggggctctggaggagtctgaatgagatgaaaaggatcttcaacttccggaggaccccagcagctggtgaggagcttgggccagggatcctgacctctttcctggggcatcagctcctgtg

SEQ ID NO: 20862 - DNA, 601 bp, Human
tggaggaaagaaaacaccactgtggtcaaagtgtaatgaacaagagaaggagagcgagagaaggagcaggaaggtgcacgggggtcgcacaggactttgtcggccatggcaggacttgcgtctttcctcagcccagtgcttgactggttgccagcaggggaataatgtggtcactgtgcactgctggggggcaagagactatgagaatctgctatgaggctctggctgtggtcaccagaggatggtggcctcagcaaggcagtggcaatgcaatggagaggatgggtggaccgagaggtaytcaggatggagaatcaatgggatttgatatgtgaggggtactgccaagagaggtccccaggctccggctgggcgcagtggctcacacctgtaatcccagcactttggaaggccaaggtaggtagattgcatgaggtcaggagtttgagaccaggctggccaacatggcaaaatcccgtctctactaaaaatacaaaacttagccaggtgtggtggcatgggcctgtagtcccagctactcaggaggctgaggcctgagaattgcttaagcctgggagatggaggttgccctgagccaaga

SEQ ID NO: 20863 - DNA, 601 bp, Human
atttggcctgcaacgtgttgcatttgaggctagtgagttattcagggggagtgtcaggcagacactgggatgcatgggctggggactatgatttgctgctgggtgaagaggcagtgactgaagacaaggggcaggggaggtaactctgaggacacactgtgaagattagccagaggcctgtgggagctggggtaaccccgtccccgtgtcccccaccccctgcaaagcacgcatttgagtgaccccgttcccctgtcccccaccccctgcagagcacgcatttgagcactggcaggaggaygccttcttcgcctcccagttcctgaatggtctcaaccctgtcctgatccgccgctgtcactacctcccaaagaacttccccgtcactgatgccatggtggcctcagtgttgggtcctgggaccagcttgcaggctgagctagaggtgaggggtgcagggatcttggctctgcacagtcccatctcagtgccttcacacccgtcccctactggagacagaggggcacactcacatttgttagggacctaccgcgtgctgcgtgccaagcacactctcccgaaacacactcctctcccagcc

SEQ ID NO: 20864 - DNA, 601 bp, Human
caaggtggcccagcctgtgcccatgcctctgtgcctcttctaagcagcctttcctcacatggccctatccatgcaagctgggatgcagagcccccgtccgcttcagcagcatctcctggcacaactcccctggaagcctgctatccagcaggccctaagtaacataaatgcagcaccccagaaaggctctcgaagggagatcaggcagcatcaacagccgtcatagaagcccaaatcttaggaaggggaaggacctggggctggcaggtgccaaagtttgaacatggctttgagagaccacgttctctgcagatacttctggggtaggggagggctgggtgggaggcccccgtgctctagggtgggttctgtaggtttcctagaccctgctagctttcagacggcatggattcgaggcatctcctctgtgaagggcaggatggccccctcccagggtccacccacagtcgctgctcagattctctgatccttctagacttctcctgggtcccagatgcgggccctactctgtgctcttctgtactagctggttctttctgactatctgcagcttctgaggcctggcgctcagaggtgggct

SEQ ID NO: 20865 - DNA, 601 bp, Human
gaagggcaggatggccccctcccagggtccacccacagtcgctgctcagattctctgatccttctagacttctcctgggtcccagatgcgggccctactctgtgctcttctgtactagctggttctttctgactatctgcagcttctgaggcctggcgctcagaggtgggctctggtggacggctccacattgccaggcccacaggccctggttttcctagtgccttccctgcctaggggctaggaaatcacaggatgccagagccggaagacacagggctcagccacatcagcacccacrtttgacaaaacaacctgaggctcagggagaggaaggagcacgcctgagctcccagaacaagctgctggtggagcccagcaggaactccagggctcagacccctgtcccaggctgcctcctctcattcttgttgcctctttccaagtgacttgcagggctggtgcctgtgtgggggaaggtctggggccagaacaacccaggcctcccctagctctgccattttcctgccatgcagctgctgatcccgcacacccgatacaccctgcacatcaacacactcgcccgggagctgcttatcgt

SEQ ID NO: 20866 - DNA, 601 bp, Human
gagctgtgttggggagggagtaggcaggccactccttcaatgtgacgaatttgaggtcctggggtaggagtggcccatctccccgacaccagtgctacctcctgcttctggagcaaggtctgtaggacccaagagtcctgtctctcagtccacaggcatcggcattgaaggcttctctgagttgatacagaggaacatgaagcagctgaactattctctcctgtgtctgcctgaggatatccggacccgaggagttgaagacatcccaggctactactaccgtgatgatgggatgcagatytggggtgcagtggaacggtgaggggccgtccctggagagccgagggctggtcggggacgtgggaagacaggaaaggagactgaggccccagggaggctcacgttgaggaggagggccagacattcatgatgctaagcagaggcattcctcagagcgggtcggggttggaggctggacctgaacctggatgcattgcagctttgtctctgaaatcatcggtatctactacccaagtgatgagtctgtccaagatgacagagagctccaggcctgggtcagagagatcttctccaagggctt

SEQ ID NO: 20867 - DNA, 601 bp, Human
gcattgaaggcttctctgagttgatacagaggaacatgaagcagctgaactattctctcctgtgtctgcctgaggatatccggacccgaggagttgaagacatcccaggctactactaccgtgatgatgggatgcagatttggggtgcagtggaacggtgaggggccgtccctggagagccgagggctggtcggggacgtgggaagacaggaaaggagactgaggccccagggaggctcacgttgaggaggagggccagacattcatgatgctaagcagaggcattcctcagagcgggtcsgggttggaggctggacctgaacctggatgcattgcagctttgtctctgaaatcatcggtatctactacccaagtgatgagtctgtccaagatgacagagagctccaggcctgggtcagagagatcttctccaagggcttcctaaaccaggagagctcaggtacagggacctcagccctcaggcgcatttgagtgagcccatccccgtgtcccccaccccctgcagagcacgcatttgagtggccccgtccccgtgtcccccaccctcaaggctcaccctcaagcctccgcagcagggtcc

SEQ ID NO: 20868 - DNA, 601 bp, Human
gtcagagagatcttctccaagggcttcctaaaccaggagagctcaggtacagggacctcagccctcaggcgcatttgagtgagcccatccccgtgtcccccaccccctgcagagcacgcatttgagtggccccgtccccgtgtcccccaccctcaaggctcaccctcaagcctccgcagcagggtcctcaggtccctggaagccccatcccagcccagctctccttgcaggtataccctcctcactggagacccgggaagccctggtgcagtatgtcaccatggtgatattcacctgctcmgccaagcatgcggctgtcagtgcagggcaggtgaggaaaggccagcgcccgaggtggcaggctggaggtgacccagctcctcagcctcattctgccctctcggccttcagtttgactcctgtgcttggatgcccaacctgccacccagcatgcagctgccaccacccacctccaaaggcctggcaacatgcgagggcttcatagccaccctcccacctgtcaatgccacatgtgatgtcatccttgctctctggttgctgagcaaggagcctggagaccaagtgagtgtggggctggggg

SEQ ID NO: 20869 - DNA, 601 bp, Human
tctggttgctgagcaaggagcctggagaccaagtgagtgtggggctgggggccaggctgggccaaattggggtaagagagggtgtgatgtttaccctgctggcccagacccaaccctgccatcaggtagcgggtccctttgccccactgaccctccagtgggacacatgagccttggacatttcacagtgaaggtcaaatggccaaatgcgatgatgcggagccactctcagtagcaaggggaacgtgtaattatgcttcttggaaattccgaattgagctttcattccccgaaagcttcytgcagataagctttacatggatatctgtttaagaggagggacatggatcaggccccatcgagggctacttcaggtcccacacttgggggctagggccagagctggctaaggcaagttgcagctgctcagatagtggggaccaggagtctgggatgcaggacctcagcagccgcctcacccaaccttgtggtggatcctcagaggcccctgggcacctatccggatgagcacttcacagaggaggcccctcggcggagcatcgccaccttccagagccgcctggcccagatctcgaggggc

SEQ ID NO: 20870 - DNA, 601 bp, Human
atggatatctgtttaagaggagggacatggatcaggccccatcgagggctacttcaggtcccacacttgggggctagggccagagctggctaaggcaagttgcagctgctcagatagtggggaccaggagtctgggatgcaggacctcagcagccgcctcacccaaccttgtggtggatcctcagaggcccctgggcacctatccggatgagcacttcacagaggaggcccctcggcggagcatcgccaccttccagagccgcctggcccagatctcgaggggcatccaggagcggaaccrgggcctggtgctgccctacacctacctagaccctcccctcatcgagaacagcgtctccatctaaatcccaggggaacacaggcccagatgacatccctttgaccacatcgctctaggataactggcacccagagaaaaggactcctcagaaaaaacaggcccccatgtgcctctcctgggacaaccagactctgtaactcacccccaccaccatacacacacacaaaaacagaaacaaaatcaaaacagagaaagcagaaaatctaccaagaacagagtctcaggacagaaccactgagt

SEQ ID NO: 20871 - DNA, 601 bp, Human
ggttttgctagttggttttgttttgcgttttacagccgtggggggaagcacataatcccgccccagggcccactagcatccactgattggaccttatggtcacccaactcaaggacagccaccaagaagtggctgccaaagagactgggcgcagtggctcatgcccataatcccagcactttgggagatggaggcgggaaaatcatttgaggtcagaagttcaaggccagcctggacgacatagcgagactccacctctaccaaaaaataaaaattaaaaaacaaattgggcctggtggtrtgtggctgtggtcctaactactcgagaggctgaggtgggaggactgcttgagcccaggagtttgaggctgcagtgagctatgattgtgccacggcactccagcccaggtaaccgagcaagaccccgtttctattaaaaaaaaaaaaaaaaaaaaaacaaggccgggcgtggtggctcacacctataatcccagcaccttggaaggtcaaggtagagggatcacctgaggtcaggagttcaagaccagcctggccaacgtggtgaaacccggtctccacccaaaatacaaaaaatagctag

SEQ ID NO: 20872 - DNA, 601 bp, Human
agcagattttaatagttaatattgtaggcaccgactatgtgattactggattttggattatttcaacccttgctcatctctgtttccttttaaaatgggcatagtgttagttaatagggctgatattaaaaattgataagaaattacatatagggcagacatattgagcattaaaaaagagaagaactgtgatgatgatgatgatgatgatgcctgctgttattttgcagaccccagtgagccatggctcacagttcatacctttgtgtactcctcgtgccttaaatctggactttccttktgaccaaccataaccaacagaatgcaatggaagtaacactgtttcatttctgggtctaataaaactaaaaaaggctgaaagctcctgctttgtctttggaggatgacaagtgctacgtaagaagtctgataaccctggatcactttactgaaagaagcttagcttagccacatggaaaggtcacatgggagaagcttccagtcaacagccagcaacaattagccagttatgtgggtgaggccattgctattacccatcctgttccacaacctgcaaccctgcacagctcccttggtcagg

SEQ ID NO: 20873 - DNA, 601 bp, Human
tctaatccttgaaacatcactgtgaggcaggtgaagtattatcattgtcctattttaactagttagaaagctaaggtgcaggttaggtgatctgtcgaaaatctctcctcttgtaaatggcagagtgaagactataattgtgttttgttttgttttgtttttagacagagtctttctcggtcgctaggctggagtgcagtggcgtgatctcagctcactgcaacctctgcctcccaggttcaagcgattcccctgcctcagcctcccaagtagctgggattacaggcacgtgccaccacayccggctaattttttgttgttttagtagagacggggtttcaccatattggccaagatggtctcgatctcctgacctagtgatccacccacctcggcctcccaaagtgctgggattacaggcttgagctaccgtgcctggcctataactgttaatataaacataattcaaagtctttttgtttttgaatatagataatcttttatccctcatatatttttagaatcacctaggtaggaagaggccttcaaatctgacctagcattccaattctccataccaatcccaaaagataatgatata

SEQ ID NO: 20874 - DNA, 601 bp, Human
ctcagacatgtcaaaactctccctcttgccacttgatgattcccttttctgtgcagtcattgaaaagggattcaacacttatactcaatgtgaataaagaggctgggaatgatgaagtgttaagttttgggtcacatatttccatgctgttgaaagcgctgtgtggataaaactctccaacttccccagggaaacacgcagtgatcctgggtgagccttagaaatggacaagcattagcctcattcctaggacagcctccatccctgtctccacatgcaggcctgtacttccctctaaatrgaaataaatatcccttcctaaacagtttgcatttttgtctttcaggaagaagtgactaaaaagaacgcagtataatttgcatttagaaactaacatttatttcgagctccttcccaaaaaactgtccaagcatgctctagtatgagagcaaaaggtttgagtacaatgaatcaaaatggctgcaatatagggaggaaaccttctaatagccaagtgcagtgatccagaaacaactgtttcattataaagatgaaaaatacgtgaaagaaggggaattgtgttcccacattagtaaactgt

SEQ ID NO: 20875 - DNA, 601 bp, Human
tttttttgcagctcagacatgtcaaaactctccctcttgccacttgatgattcccttttctgtgcagtcattgaaaagggattcaacacttatactcaatgtgaataaagaggctgggaatgatgaagtgttaagttttgggtcacatatttccatgctgttgaaagcgctgtgtggataaaactctccaacttccccagggaaacacgcagtgatcctgggtgagccttagaaatggacaagcattagcctcattcctaggacagcctccatccctgtctccacatgcaggcctgtactwccctctaaatggaaataaatatcccttcctaaacagtttgcatttttgtctttcaggaagaagtgactaaaaagaacgcagtataatttgcatttagaaactaacatttatttcgagctccttcccaaaaaactgtccaagcatgctctagtatgagagcaaaaggtttgagtacaatgaatcaaaatggctgcaatatagggaggaaaccttctaatagccaagtgcagtgatccagaaacaactgtttcattataaagatgaaaaatacgtgaaagaaggggaattgtgttcccacat

SEQ ID NO: 20876 - DNA, 601 bp, Human
ttagcactttatcaattacaacagcccctgggaagaaaaagaagaccactgggattttccttgcatttttttgcagctcagacatgtcaaaactctccctcttgccacttgatgattcccttttctgtgcagtcattgaaaagggattcaacacttatactcaatgtgaataaagaggctgggaatgatgaagtgttaagttttgggtcacatatttccatgctgttgaaagcgctgtgtggataaaactctccaacttccccagggaaacacgcagtgatcctgggtgagccttagaaakggacaagcattagcctcattcctaggacagcctccatccctgtctccacatgcaggcctgtacttccctctaaatggaaataaatatcccttcctaaacagtttgcatttttgtctttcaggaagaagtgactaaaaagaacgcagtataatttgcatttagaaactaacatttatttcgagctccttcccaaaaaactgtccaagcatgctctagtatgagagcaaaaggtttgagtacaatgaatcaaaatggctgcaatatagggaggaaaccttctaatagccaagtgcagtgatc

SEQ ID NO: 20877 - DNA, 601 bp, Human
ccattactttcaatggtaaaaaccataattacttttgcaccaaactaatagattactagaaccatgacttttggagctttaactttcttatttttaaatattaataagcaaccctgtaaatccatgactgtaattatttacaaagctgcactggcattggaattttgaggcagaaggctgatttgtaagtgctcctgagtgaacctagctgactgcttggcttctgaatgtcaacatgactttattgttctctttgggggaagtcaaggttgttaagtattcaaaatagtttctttgtagkgagaaaaaagtggtcccaaaagaaagccagcgcttaatgttggagatgttagtgataggaaaagaaagaacccctagaaacttgctggcattctagatttggagtattcacaattgcctcagaaaatactcattggcagtgcttgaagttcaatgtaattcttgatctacatatttgtttcactggccatgttgtgagctccctgatgatagaaactgtgttgtatttgtgaatttccaaaaaccagtgaagagctgacatgcactgagcattccaatagggttgttttgaaattcaaag

SEQ ID NO: 20878 - DNA, 601 bp, Human
aactggtattgctaccttgccaacaactgtctcttttatgagaggaggcccagtagctttatttcaattttctcatcccatagtgactcatgttttaataaaaactgtttactgtcataaccttggacacttacaggcagagaagacttcttgataaaataatgcagtaacttcaagcaccccaaaaattcacttaaaatacattatcccataggaatatttccattgagttatttatggcaactagcagtcagaatttcttagtcaggtgactatgattaattttctttttgtatatatwtcccttacatataatagttttgccaatttttctcccctgataataatttttaaaaattaaaaattgcctaagggaatggactgaaggagaaatatatgaagaatgatgtatttcattaagggatatagtagatttctttgagcatttgtgttatttgcatcaattaaggacaatgttgcatattccagattaattagctattaggttttttgcagatataaacatgctatgtacaatgatatttataattattttattttttatagacttcaaagtgtttcttttatagacactggaaca

SEQ ID NO: 20879 - DNA, 601 bp, Human
gacagttccaggcagtgtccgatgtttgggagaagcaaagccccctgggcatcctttaaaacaccccccttaatgtgagcatcaactctgctcactcttaatgttccagtttcattgacattactctgaaggaggaaactgaggcaggaaggttaaggagctcccttgagagctgtggctcacgcctgtaatctgcactttgggagaccgaggcaggaggattgcttgagcccaggagttcgagtttagcctgggcaacatggcgaaaccttgtctctacaaaaaaaaaaccaaacaaaamaaaacaacaacaacaaaaaaaaaccggtgtggtggtgcgtgcctgcagcccagctactggggagggtgaaggaggattgcttgagtctaggagttcaaggttacagtgagctgtgatcacaccactgcactccagcttggacaaaagagtgagatcctatttcttaaaaacaacaaaaacagagctaacaaccaagcaagagcagtggcacctgatttccctggtgctcgtgttggtgccggttcattcagagccacctgtgaccactgcttctggctaagggcagccacaacacttttc

SEQ ID NO: 20880 - DNA, 601 bp, Human
agatagcaagcatataaatacgtggaaatgtgtaatgtcaggaagtgagaagtgctaatataaaaaataaagcacagcgtggggacagagagtatgcaggatacttagaggggatggatgttttggcctgtctgaaagggtggcatttgagcagtgactgggatgcagtgaggagcaagccatgcaaacatctggggagacagcatccaggcagtgggaatggcaggtgcaaaggtcctgaggtaggaggatttctgtgtgcttaaggaggtaggttggtgggcctggcaacatgggcagkggcctgattactagggctttataggtgatggtaagggtttgggttaaatgaagaaacagggattgtgagtctaacatctcctcgcttctccttcccccacttccaaacaaatattggtatttttaacataatggccaacaagtttgtgctctattgatttttaaaattagataagctagttcttatctacggactcactttgtctatgggccaaatgtcctgtggttatttgtaaagtataatctggagatattgattctgtttttgcaattacccattagaagaaattgtgttaatctt

SEQ ID NO: 20881 - DNA, 601 bp, Human
ctttttttttttttttttttgagatcgagtctcactctgttgcctcctgagtagctgggactatgaaactgcaagcacccaccaccacgctaatttttgtatttttagtagagatggggtttcactatgttggccaagctggtctcaaactcctgaccccaggtgatctccctgactcggcctcccaaagtgctgggattacaggcttgagccactgtgcccagcctagcataaactttttcgttccagagagtaagggattgttgagaagagtgtgagagaaaatccaccctagaagagrgcttttgaagtcaaacacaatctctggaattaaaaactcacctttgaaaaagaagcttagaagtgaagccacttaggagaaaataggtgacatgattggcttctattctgctttttgctaaattttctcaggtcaccaaaagttgtcctcaggcagaaggtaacgacatctggaggcaaggacagcgcacgttggccagggacctagttgcagagagatttctgaaatcttattcactctaccaaggcccccagaagaacagatgacccatttaacatggagtttaagggaggaagagcc

SEQ ID NO: 20882 - DNA, 601 bp, Human
cttatttgaggaagaagcgtatccttttctttactttgactgtgtatgtgtgtgtgtatttgtataactccaatatcctcattaaatgatatttcaaatatacattagagacactgagacatattccctactatcatggttttatgctcatatttgagaaagtcctatcattttataggcagtgcacaaatgtggccgtcagaagaaccaattttcttctagtctctgtataaaatggggaaactagtaatggaaacttaatagacgttaaaaggacctaactaagcatcctttagaattagagtcacaatatttatactctgtccttaaggactaattattatgcccattaggaaaagagagcacagaagtcacctgaaatgaaagtaaaaggaaaacggaagaactaaacctgaaaatgttatcctagaaaaacttgccaaataaatgccatcaaaggaatgtatttttagcttgctatgcatgaactccagtgggctacccgacggtgaaagacactactgaattatatgcaaaattatgtttcaaagagggtgtgtacatttttccccctggagagagtaaaattaccaaaagagta

SEQ ID NO: 20883 - DNA, 601 bp, Human
ggaaacttaatagacgttaaaaggacctaactaagcatcctttagaattagagtcacaatatttatactctgtccttaaggactaattattatgcccattaggaaaagagagcacagaagtcacctgaaatgaaagtaaaaggaaaacggaagaactaaacctgaaaatgttatcctagaaaaacttgccaaataaatgccatcaaaggaatgtatttttagcttgctatgcatgaactccagtgggctacccgacggtgaaagacactactgaattatatgcaaaattatgtttcaaagrgggtgtgtacatttttccccctggagagagtaaaattaccaaaagagtacataactccaaagcatcaataattatttttcagacacatgaatatgtttctgaaacatgctcatgaaagtcattcaagatctttagacataaaaaaacaatgaacatgactccctgattatccacagtacctatgtataatatttaaagtttggttcactatgagtgacagaaaactccacctcatggtaaacaagatagaaggtaggagtttctttctttctcattgtgttagttcaggttcttcaggat

SEQ ID NO: 20884 - DNA, 601 bp, Human
aatgaccccacctagctgcagaggagtctgggaaagtctattttttactctgggaagccatgtgtgtggctaaaaatcagtgtttctatttctaaggaattatgagagaacagatattagggaacagatggcagcttttgcgactgaaaggcagagaaatacacaaacatggctaagatgacacaaatattccaagcattatctacaatttaatattttgctttgtgtcatcaaagacagagataaggatgagaataaatgtgcaatgtgttcataccttcaaatactcaagtgcttacayatatagactcttcttttttcagttcagccctatttttggcaacctgacgtccagttgttttcaaagggagaatgcaagatataacacacaaaaggaaatcaagaatttacaagattattatagcttctataatagtaattaagacataaacacattatttgatgaatatgtattgaacttaactaacatttaagagtctgtgatattactgtctcctagtggcagggctattctagaaagagaattacataacacatatgatctttaactatacctcttccagttcgactcacaggaact

SEQ ID NO: 20885 - DNA, 601 bp, Human
aggaaatcaagaatttacaagattattatagcttctataatagtaattaagacataaacacattatttgatgaatatgtattgaacttaactaacatttaagagtctgtgatattactgtctcctagtggcagggctattctagaaagagaattacataacacatatgatctttaactatacctcttccagttcgactcacaggaactaagtatggctgtggaggaggaggctgtggtgcttgtacagtgatgatatcacgatacaaccccatcaccaagaggataaggtaccgtgcagcraagtccagatatggttgaatttttataattttgaactttgttatattccttcatttggtaaatatatattgagtacctaccatgtgaaaagaactggccacttggcgtacaatgatgaacaagacagacatggtcctaggaatatgaatgttttgggaaaaaaatgtagcatcaatgaggataacatacggtcaaagaattccccatcaaagccaggcacagtggcacacatttctagctacttgggaggctgtcaggaggattgcttgagtttgagtccagcctgggcaacacagcaag

SEQ ID NO: 20886 - DNA, 601 bp, Human
atggctgtggaggaggaggctgtggtgcttgtacagtgatgatatcacgatacaaccccatcaccaagaggataaggtaccgtgcagcaaagtccagatatggttgaatttttataattttgaactttgttatattccttcatttggtaaatatatattgagtacctaccatgtgaaaagaactggccacttggcgtacaatgatgaacaagacagacatggtcctaggaatatgaatgttttgggaaaaaaatgtagcatcaatgaggataacatacggtcaaagaattccccatcaaakccaggcacagtggcacacatttctagctacttgggaggctgtcaggaggattgcttgagtttgagtccagcctgggcaacacagcaagaccttgtctctaagaaaaaaaaaaatcccctgtcaaaacttgaatggctccctaactccctgtctggggaggaaaggcaaggctgaaattgcagtggaggataatgccatcatcacattcatatattactcttccagcccctaacttatctccttcctcccatctggtgcattctccatacatcagccagagtgacctgctttaattatcat

SEQ ID NO: 20887 - DNA, 601 bp, Human
ggcttttctcctaaagaagcaccttgttagagttttagactcaagtaaaaaggcatcttcagacacctgagtctttatgtatatattgcccataagaatgccatttctaggccaggcgtggtagctcatacctataatcccagcactttgggaggcagaggtgggcagatcacgagctcaagagatcaagaccatcctggccaatgtagtgaaaccctgtctctactaaaactacaaaaattagctgggcatggtggtgcatacctgtagtcccaagctactcgggaggctgaagcaggaataatcacttgaacctgggaggtggaggttgcagtgagccaagatcatgccactgcactccagcctggcaacagagcaagactctgtctcaaaaaaaaaaaaagccacttttcctcatttttattgaagttaatgaagatcaaatatgagaaaagatagaaggaaaagataggagcaacatagaaaatgacccaagttcaaattttctagatttgaaggaatcttggattctgtttatttgaaagatcattacccagagggagagaattttgcctggatcattatgacatatcattaacta

SEQ ID NO: 20888 - DNA, 601 bp, Human
gcttttctcctaaagaagcaccttgttagagttttagactcaagtaaaaaggcatcttcagacacctgagtctttatgtatatattgcccataagaatgccatttctaggccaggcgtggtagctcatacctataatcccagcactttgggaggcagaggtgggcagatcacgagctcaagagatcaagaccatcctggccaatgtagtgaaaccctgtctctactaaaactacaaaaattagctgggcatggtggtgcatacctgtagtcccaagctactcgggaggctgaagcaggaakaatcacttgaacctgggaggtggaggttgcagtgagccaagatcatgccactgcactccagcctggcaacagagcaagactctgtctcaaaaaaaaaaaaagccacttttcctcatttttattgaagttaatgaagatcaaatatgagaaaagatagaaggaaaagataggagcaacatagaaaatgacccaagttcaaattttctagatttgaaggaatcttggattctgtttatttgaaagatcattacccagagggagagaattttgcctggatcattatgacatatcattaactag

SEQ ID NO: 20889 - DNA, 601 bp, Human
gcttccaaaatcgacttgaaccttagaagttagactccaaagcaaaaatgctagggggagggaaacgtataaaagaaataaaagcattttattttttatttattttttttccacttctcaacttgagtgtaatttggtttatttctctgaaggatttcttttatctcagtaattcacaaccacaactgcacgttgaaaccaaccatgtgggaatctttaaaagatgtatgcccgtgccccattcccagagactctgtcagttggtttgtggtgctgtgtggggcttgaaatcttaacactstccgggtgattctcaagagtggtaaccactgccttaagtgaagctcaaaagcagataaggcccaacctcacaacaacccagccctggggagggaggtgcctgggatgagaagggctcccaggggcctctgctgcaatcttaacatgcagacaaatcacctggggatcttgctagaatgcaggctctaattcattaggcccgggatggggccccaaattctgcatttctaacctttctgtgcttccaggagaggattgccaagtgtcatggcacccagtgtggcttctgcacacctgggat

SEQ ID NO: 20890 - DNA, 601 bp, Human
aatttgtgggtaatgaagattcctgggacccacccctagagagtttgactcagtaatattgttttttaaataagacttcagatttaggggtggaggaggaacaccggatcgcactgtgagagaaacgctggcctgatgatttattataaataaataatgtgcccgactgctttcacagtttaataactacctttgctgctgtataataactttgatctttctgtcagctgaagcttagagtgctttttttttttttttttttgtcacagtaagtgttaagaatgaggggttttttccttaraaaaagaagtatagcttgctatttgcaacaacgtaaatgaacctggaggacattatgctgagtaaaataagccaggcacagaagaacaaatactacatgagcccacttatatgaggaatctaaagtagtcaaactcacagaagtagagaatagaatggtgattaccagggcctggggaacgggaaaacaaagatgtattcgtcaaaggtaaaaagtttcagttatgcaaaaggagtaagtcctagagatactgtatagcataatgcttatagttaacactgtattgtatactcaaacatt

SEQ ID NO: 20891 - DNA, 601 bp, Human
tttttttttttttttttttgtcacagtaagtgttaagaatgaggggttttttccttagaaaaagaagtatagcttgctatttgcaacaacgtaaatgaacctggaggacattatgctgagtaaaataagccaggcacagaagaacaaatactacatgagcccacttatatgaggaatctaaagtagtcaaactcacagaagtagagaatagaatggtgattaccagggcctggggaacgggaaaacaaagatgtattcgtcaaaggtaaaaagtttcagttatgcaaaaggagtaagtccyagagatactgtatagcataatgcttatagttaacactgtattgtatactcaaacatttgctgaaagggcagatgttatagtaatcacaaaataaatgaataaataaataaatgatgggagggaagttagaggtaatagatatgtttataacattgaccgtggtgatggtttcatgggtgtaagacttatctccaaattcaccaagttgtacagctttttgcatgtcaataacagctcagtaaaatggattttactttttaaaaaaaaaattagtttggctgaacacagtggctcacgcct

SEQ ID NO: 20892 - DNA, 601 bp, Human
ctcaaaaataaaagtaaaaataagttgtttttaaaataaggcttagctcttgaatgtgactgtagagcaagtttttggcttgaaattattgtgttgtttgagcacctgtcacaagcagaaggcataactttacaggagaaagtacaaatacctgagcttttaaaatctgcctcaagattcttaatgaaatatcccaagttgctgttgaaaagatctgactttgtagattaggtggactaaaatgtcaaacagatctttcctctatgatagggtcctcatttccatcacactcttggtagastgtgcctctatctgggtcacttggctaacagagctgggtttttctccttcaggtaacctgtgccgttgcactggatacaggcccataattgatgcatgcaagactttctgtaaagtaagtggaaaggaccacatgtttgagtatgttttccccagtgaaacgaaatggtaatggttgtcagtgattaggggggcagccatcttactaatacatggctacttcttatctccaggtttctagctgctgtttgttatttgatcttgagcagggcacttaacctcattcattgagcttgccttg

SEQ ID NO: 20893 - DNA, 601 bp, Human
atttccatcacactcttggtagactgtgcctctatctgggtcacttggctaacagagctgggtttttctccttcaggtaacctgtgccgttgcactggatacaggcccataattgatgcatgcaagactttctgtaaagtaagtggaaaggaccacatgtttgagtatgttttccccagtgaaacgaaatggtaatggttgtcagtgattaggggggcagccatcttactaatacatggctacttcttatctccaggtttctagctgctgtttgttatttgatcttgagcagggcacttarcctcattcattgagcttgccttggtggtcgcataatgaacacctgagcattttgacactggctgtgtgtcattgcttccaagaggtctttcctgacctctttgcctgggtcaggtaccctggcctggtgttcctatagccctctgcgaacatgtgacgggcatacacatgtcccgtcacagctttggtcacaatgtggtgcaactgatcatttgctatcccatgtcttcaccagactgtgggctgcttcacagtagaggctgtatatctccgggtccagtcaccatatagtcattgagta

SEQ ID NO: 20894 - DNA, 601 bp, Human
ccatctctctataaaaaaaaattatatcgcagcaactttgtcctcattccagatattattcccatttaaatacagttatctacaggagggaaaacacattggttccttagtgtctcttagcttttaaaagcattttttcaagttatttttcaagggccagaagtaaagtggagatgtcatgaaaataaaagaacaggtagaacaagtagagacaggagaggttcagggagccgttcttgttccagctgtgtctgcggctgctgcctcctcttctactgtccccagactccaaagagaaggyacagggagttgaggcctccagaggcccattggcatcagcactgagttgctgatgacaaggtttgtgttagagcccttggtttggagcgcggggattgtggctggccagtggacttttttgtcggtttgctgtatctgactgtgtatctatatcttttgaccttattccacaaaggattttaaagttgctcgataacagtaatttctgatatgttctctttttagacaagtccaaaactcttcgcagaagaggagtttctgccattggatccaacccaggaactgatatttcctcctgagc

SEQ ID NO: 20895 - DNA, 601 bp, Human
gaggttcagggagccgttcttgttccagctgtgtctgcggctgctgcctcctcttctactgtccccagactccaaagagaaggtacagggagttgaggcctccagaggcccattggcatcagcactgagttgctgatgacaaggtttgtgttagagcccttggtttggagcgcggggattgtggctggccagtggacttttttgtcggtttgctgtatctgactgtgtatctatatcttttgaccttattccacaaaggattttaaagttgctcgataacagtaatttctgatatgttctstttttagacaagtccaaaactcttcgcagaagaggagtttctgccattggatccaacccaggaactgatatttcctcctgagctaatggtgagtaaagcaatgttgagctcatcctagaagaattcatggtgaaatatcaggaagggtatttgtttatgggttctctcaaaagctgattggcaaataggtgaggcctctctgtcatccttagctcaaggtctaaagagtatggactaaggaagaggaggaggaatgggggtggggtccccatgggggacagctgagttgactgtaagaag

SEQ ID NO: 20896 - DNA, 601 bp, Human
gtccaaaactcttcgcagaagaggagtttctgccattggatccaacccaggaactgatatttcctcctgagctaatggtgagtaaagcaatgttgagctcatcctagaagaattcatggtgaaatatcaggaagggtatttgtttatgggttctctcaaaagctgattggcaaataggtgaggcctctctgtcatccttagctcaaggtctaaagagtatggactaaggaagaggaggaggaatgggggtggggtccccatgggggacagctgagttgactgtaagaagcagcagatagcwtctataaaatcgtgaaatcacagtgtttgtaggtatagacatgtgtcctactttcacttttgctgaagtttattcctccatagaatgatttaacaagattcagcatgttactatatttgctaacattaaaatgatgttctttgagacaagagcaccaaagggagacagaccaagcagttcccaggagtaaagaaccatcgtgcttttattctgaattctaattccttgtaaagctctacttttaggtcactttgtactttattttttagaagatatgtattttctcattctgtatctaca

SEQ ID NO: 20897 - DNA, 601 bp, Human
cccaggaactgatatttcctcctgagctaatggtgagtaaagcaatgttgagctcatcctagaagaattcatggtgaaatatcaggaagggtatttgtttatgggttctctcaaaagctgattggcaaataggtgaggcctctctgtcatccttagctcaaggtctaaagagtatggactaaggaagaggaggaggaatgggggtggggtccccatgggggacagctgagttgactgtaagaagcagcagatagcttctataaaatcgtgaaatcacagtgtttgtaggtatagacatgtktcctactttcacttttgctgaagtttattcctccatagaatgatttaacaagattcagcatgttactatatttgctaacattaaaatgatgttctttgagacaagagcaccaaagggagacagaccaagcagttcccaggagtaaagaaccatcgtgcttttattctgaattctaattccttgtaaagctctacttttaggtcactttgtactttattttttagaagatatgtattttctcattctgtatctacagtgctaatgattgagtggaaacaggtggagatggcatcattgggt

SEQ ID NO: 20898 - DNA, 601 bp, Human
agaagaattcatggtgaaatatcaggaagggtatttgtttatgggttctctcaaaagctgattggcaaataggtgaggcctctctgtcatccttagctcaaggtctaaagagtatggactaaggaagaggaggaggaatgggggtggggtccccatgggggacagctgagttgactgtaagaagcagcagatagcttctataaaatcgtgaaatcacagtgtttgtaggtatagacatgtgtcctactttcacttttgctgaagtttattcctccatagaatgatttaacaagattcagcrtgttactatatttgctaacattaaaatgatgttctttgagacaagagcaccaaagggagacagaccaagcagttcccaggagtaaagaaccatcgtgcttttattctgaattctaattccttgtaaagctctacttttaggtcactttgtactttattttttagaagatatgtattttctcattctgtatctacagtgctaatgattgagtggaaacaggtggagatggcatcattgggtaccttgaatccctattgctttttcaatagataatggctgagaaacagtcgcaaaggacca

SEQ ID NO: 20899 - DNA, 601 bp, Human
accctgaaggaactgctggaatttaaattcaagtatccccaggctcctgttatcatgggaaacacctctgtgggtatgtagaaccccagggattttttatagggaaattgagaaaaagggcttgggatggggccggggtgggctggggaaacttcatatacatgtgttctcaggaaaagcagtctgaaatagcatttttaatcatttgagctagacttcctgagcattgctcaagagactttctaactgttattaagtagattcctcttgcctcttattggagcagtgtcaagagttgtascgaaggggcttgctccatagcaaaccagcagcaggagcttcagtgacagctgtcctgtctttccttttggggactaatctgggcctcaaatttcaaattgctctttgtttcctctctcagggtgtctcaataggtatatgttttacttaaacaaccgctacagggtcttcctgttgcatccagtgtgtgctcagcttgaggagcagcccctagagtcttcccagagagaattttgaacatgccatatggcccaagtttcaaggttgacaattccagagtcttccaagtttgatgaaaatc

SEQ ID NO: 20900 - DNA, 601 bp, Human
aatggtagcttgatggggatagcattgaatctgtaaattactttgggcagtatggccattttcatggtattgattcttcctatccatgagcatggaatgtttctccatttgtttgtgtcctctcttatttccttaagcagtggttggtagttcttcctgaagaggtccttaacatcccttgtaaattgtattcctaggtattttcttctctttgtagcaattgtgaatgggagttcattcatgatttggctctctgcttgtctattgttggtgtattggaatgcttgtgatttttgcacaytgattttgtatcctgagactttgctgaatttgcatatcagcttaaggagtttttgggctgagacgatggggttttctaagtacacaatcatgtcatctgcaaacagaggcaatttgactccctgtcttcctatttgaatacctgtatttctttctcttgcctgattgcactgggcataacttccaatactacgttgaatagtagtggtgagagagggcatccttatcttgtgccagttttcaaagggaatccttccagcttttgcccattcagtatgatattggctataggtttgtcaca

SEQ ID NO: 20901 - DNA, 601 bp, Human
aatttgcatatcagcttaaggagtttttgggctgagacgatggggttttctaagtacacaatcatgtcatctgcaaacagaggcaatttgactccctgtcttcctatttgaatacctgtatttctttctcttgcctgattgcactgggcataacttccaatactacgttgaatagtagtggtgagagagggcatccttatcttgtgccagttttcaaagggaatccttccagcttttgcccattcagtatgatattggctataggtttgtcacaaatagctcttattattttgagatatgrtccatcaatacctagtttattgaaagtttttaacatgaggagatgttgaattttatcaaaggccttttctgcatctatagagataatcatgtggttttcgtcactggttctgtttatgtgagggattacatttattgatttgcatatattgaaccagccttgcatccctgggatgaagccaacttgatcgtggtggataagcttttcgatgtgctgctcatcatcactgatcattagggaaatgcaaatcaaaaccacactgagataccatctcatgccagtcagaatggtgattattaa

SEQ ID NO: 20902 - DNA, 601 bp, Human
aactctggtatgcatcccttgggtgactctccctgatgaatcatgacattttcattcttttggaacagacaaaaaaaatagttctccaaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaaggtaagtgacagcccctacttggagattattaagctgtttctytacccctttttctctctggggaggcaggaaatccagtcttgaaaatgacttttccctataatatcaatacatttctctgcttttctggatactggaaattttgtgagtcttgtcttaatagcacaggctttcttcccctgtgtctttctggttttttgtttgtttgtttgtttttcctcatactggtcaccctacactggacatgtttgtgttggttaatgtccggatgtgatctgattattgctgggaactacatgctattgagaactattgggtccctttgttgaagacattctccag

SEQ ID NO: 20903 - DNA, 601 bp, Human
tttggaacagacaaaaaaaatagttctccaaagccttgcttaatccttattttagcacttgcttttttatgattacataaatgaaaataactcattatttttaaaagtctttagggggacacatcattagcaggcatccagattcagatctgaatcccatcctggctgtgggtaactgtaccctcaacttgctatcaaaaggtaagtgacagcccctacttggagattattaagctgtttctctacccctttttctctctggggaggcaggaaatccagtcttgaaaatgacttttccctrtaatatcaatacatttctctgcttttctggatactggaaattttgtgagtcttgtcttaatagcacaggctttcttcccctgtgtctttctggttttttgtttgtttgtttgtttttcctcatactggtcaccctacactggacatgtttgtgttggttaatgtccggatgtgatctgattattgctgggaactacatgctattgagaactattgggtccctttgttgaagacattctccaggtggtacaggagtgttgtggcacccacatcgtgctttgagctcacacttaatttatca

SEQ ID NO: 20904 - DNA, 601 bp, Human
ttgtttgtttgtttttcctcatactggtcaccctacactggacatgtttgtgttggttaatgtccggatgtgatctgattattgctgggaactacatgctattgagaactattgggtccctttgttgaagacattctccaggtggtacaggagtgttgtggcacccacatcgtgctttgagctcacacttaatttatcattgatggaaacgtacaggtctttttcaggtgaaaaatgattgggcctcattctatatttatttacttgatttttgttattaaaactaagtccacaacatctratttatcgcttcttccaacttgcttgaaaattattaggaagttctaattggtcctctgtaaatttgtggggttttttttcgttaaaaaatatggactagttttctatcatctgcattgttaaatacttactcttcataccatttaaaccataaaactatcttttttttttttttgaaatggagtctcgctctgtcacccagtctggagtgcagtggcacaatctcagctcactgcaacctctacctcctgggttcaagcgattctcctgccttggcctcctgagtagctaggactgcagg

SEQ ID NO: 20905 - DNA, 601 bp, Human
ttgtttttcctcatactggtcaccctacactggacatgtttgtgttggttaatgtccggatgtgatctgattattgctgggaactacatgctattgagaactattgggtccctttgttgaagacattctccaggtggtacaggagtgttgtggcacccacatcgtgctttgagctcacacttaatttatcattgatggaaacgtacaggtctttttcaggtgaaaaatgattgggcctcattctatatttatttacttgatttttgttattaaaactaagtccacaacatctaatttatcrcttcttccaacttgcttgaaaattattaggaagttctaattggtcctctgtaaatttgtggggttttttttcgttaaaaaatatggactagttttctatcatctgcattgttaaatacttactcttcataccatttaaaccataaaactatcttttttttttttttgaaatggagtctcgctctgtcacccagtctggagtgcagtggcacaatctcagctcactgcaacctctacctcctgggttcaagcgattctcctgccttggcctcctgagtagctaggactgcaggcatgtgcc

SEQ ID NO: 20906 - DNA, 601 bp, Human
ctttgagctcacacttaatttatcattgatggaaacgtacaggtctttttcaggtgaaaaatgattgggcctcattctatatttatttacttgatttttgttattaaaactaagtccacaacatctaatttatcgcttcttccaacttgcttgaaaattattaggaagttctaattggtcctctgtaaatttgtggggttttttttcgttaaaaaatatggactagttttctatcatctgcattgttaaatacttactcttcataccatttaaaccataaaactatcttttttttttttttgaaatggagtctcgctctgtcacccagtctggagtgcagtggcacaatctcagctcactgcaacctctacctcctgggttcaagcgattctcctgccttggcctcctgagtagctaggactgcaggcatgtgccaccatgcccagctaatttttgtatttttaatagagatgtggtttcactatgttggccaggctggtctcgaactcctgacctcgggtgatccacccgcctctgcctcccaaagtgttgggattacaggcatgagccacagtgcttggtcacaaaactatcttaaaga

SEQ ID NO: 20907 - DNA, 601 bp, Human
tcagaatatcaaaagagatattaatatttactccctacttgtaaagttttaagtgaattgtgttgtcaggaagaggactgctaaggttctattctacctgaaactctgggctactctgtgagatcttttcatctattttttaaatctattttttatttttaaaaaaattttttagatggagtctcactttgtcatccaggctggagtgcagtggcatgatctcagctcactgcaacctctccctcccgggttcaagtgattttcctgcctcagcttcctgagtagctgggactacaggtgygcacaaccatgcccagctaatttttttgtatttttagcagagaggggtttcaccatgttggccaggccggtctcaaactcctaacctcaaatgatccacctgccttggcctcccaaaacactaggattacaggtgtgaaccaccacgcccggtcgatgtttttatcgatgagaaagcaaggaaaacaaaaagagatggggcctagactagaagaaacattgcaagacgcattatagggtaaaagatttgcgaagcataggaagagcacctgtttccctgaacaaccggtttcctcaggta

SEQ ID NO: 20908 - DNA, 601 bp, Human
atagctaatatttcttgagcattacttggtatcagctgccataacaaagcatagtgattaaaagcatgagctttaaaacttgagaaaggcagactggccaaaatctcagtttaccctctgttaactcctccatgctctcagtcagcttacttaattatattggtactttggttccctagctgtcaaagatgggtgatcatacctacctcacagggcagttgagaggattaaatgagtgaatacatataaggtgctaaaagcagatcttggcatgcaataaatgtcctagtgaggacatttrttagtgagtaaatgagggtcagttactcctggactatggattttatatgagttgtcacttatttctctagatcattctgtgagttgggttctaatattccccttttacaggtgaggacatggcgagacccaggctagccaccttgagaatggtgggccaatttgaactcgggctgcctgatccagagcttgtactcttatttcctgtattaaactatggctatttgtcttacccattagatgaagatatggggtaataaaccctgtcaggctaggagtcttctctttggactttccaggc

SEQ ID NO: 20909 - DNA, 601 bp, Human
taaaagcatgagctttaaaacttgagaaaggcagactggccaaaatctcagtttaccctctgttaactcctccatgctctcagtcagcttacttaattatattggtactttggttccctagctgtcaaagatgggtgatcatacctacctcacagggcagttgagaggattaaatgagtgaatacatataaggtgctaaaagcagatcttggcatgcaataaatgtcctagtgaggacatttattagtgagtaaatgagggtcagttactcctggactatggattttatatgagttgtcayttatttctctagatcattctgtgagttgggttctaatattccccttttacaggtgaggacatggcgagacccaggctagccaccttgagaatggtgggccaatttgaactcgggctgcctgatccagagcttgtactcttatttcctgtattaaactatggctatttgtcttacccattagatgaagatatggggtaataaaccctgtcaggctaggagtcttctctttggactttccaggcactggaacgaacagatgctggatatagcctgcaggcttattctgaatgaagtctccct

SEQ ID NO: 20910 - DNA, 601 bp, Human
ggcgccaggtgggaaagtggagttcaagaggactctcatcatcagcttcctcttcaagttctacctggaagtgtcacagattttgaaaaagatggtaaacaactgtttacacattaacttccccagtactgggagctatgatgacaccaaaagtagaggcaatgactccctaccaaatagctgtagaataaaaaagacaatccacattagaaacacacgtacttgctgaacatccctcagcctgtctgtgggtgggtatgagtttagggaagaattgaaagtagagccaagagttgatcargcttttatttaacaccactcaattatttggtttctgactgttagtttttccagatcatgttcagaaaacttgctaatgatttgggtatgttttccctctgtatgtcatttctttctcttgagctattaccttcacgttgaggttgacttcatgtgtttggtgttcttttccagattcagcttcatttccctagcccgtaaggtggccatgatggcagccactgcacaagatgactgtgaaatgcgtcattgtaggaaaagggcttcatatggtccctagtgcttcagaggaaatctgtag

SEQ ID NO: 20911 - DNA, 601 bp, Human
tcagcttcctcttcaagttctacctggaagtgtcacagattttgaaaaagatggtaaacaactgtttacacattaacttccccagtactgggagctatgatgacaccaaaagtagaggcaatgactccctaccaaatagctgtagaataaaaaagacaatccacattagaaacacacgtacttgctgaacatccctcagcctgtctgtgggtgggtatgagtttagggaagaattgaaagtagagccaagagttgatcaggcttttatttaacaccactcaattatttggtttctgactgktagtttttccagatcatgttcagaaaacttgctaatgatttgggtatgttttccctctgtatgtcatttctttctcttgagctattaccttcacgttgaggttgacttcatgtgtttggtgttcttttccagattcagcttcatttccctagcccgtaaggtggccatgatggcagccactgcacaagatgactgtgaaatgcgtcattgtaggaaaagggcttcatatggtccctagtgcttcagaggaaatctgtagtagtagtcataataatagtagtgacaatccatgcattcttt

SEQ ID NO: 20912 - DNA, 601 bp, Human
caatccacattagaaacacacgtacttgctgaacatccctcagcctgtctgtgggtgggtatgagtttagggaagaattgaaagtagagccaagagttgatcaggcttttatttaacaccactcaattatttggtttctgactgttagtttttccagatcatgttcagaaaacttgctaatgatttgggtatgttttccctctgtatgtcatttctttctcttgagctattaccttcacgttgaggttgacttcatgtgtttggtgttcttttccagattcagcttcatttccctagcccrtaaggtggccatgatggcagccactgcacaagatgactgtgaaatgcgtcattgtaggaaaagggcttcatatggtccctagtgcttcagaggaaatctgtagtagtagtcataataatagtagtgacaatccatgcattcttttgcctggtctctcttagggcaaacaattaaagctacaagattcttggctggggaggacacaactaaaaaaaattctctgaataaatccattagacccaaaggagacttgagcctcattggcctcacaaaccccatgctataaccagctgaccaaaa

SEQ ID NO: 20913 - DNA, 601 bp, Human
gcctcaacttcctggactcaagcaattctcccacctcagcctcccaaatagctgagaccacaggcatgcaccaccatgcccagctaatttctttatttttttggagagacagagtcttaccatgttgctcaagctggtcttgaactcctggactcaagcaatcctgctgccttggcttcccaaaatgctggaattacaggcatgagccatgacacctagctggttttattttctattaaaattatgtaaattagaaaaaataaccaccatgtgtattgttgaaagcctttccccccatccrgctctaggctgtgcaatgttcagtcttgtgtaaagaaccaaatgactcacttccctcagtcctgaggaatgttcttgctggggaccagaatccttcccctgtagggcagcgacagggatgcagcctgtgtccccctttctacacagctggcaggcaacatggaacctttatgcttatttgcaatggtgtactttgactctgatgttttcctggcttaagtattttcttcctttctattttatttacttagcttctatcttcttgttggatcagtttgtaagtcctcatatcatttaggag

SEQ ID NO: 20914 - DNA, 601 bp, Human
ctcccaaatagctgagaccacaggcatgcaccaccatgcccagctaatttctttatttttttggagagacagagtcttaccatgttgctcaagctggtcttgaactcctggactcaagcaatcctgctgccttggcttcccaaaatgctggaattacaggcatgagccatgacacctagctggttttattttctattaaaattatgtaaattagaaaaaataaccaccatgtgtattgttgaaagcctttccccccatccggctctaggctgtgcaatgttcagtcttgtgtaaagaaccraatgactcacttccctcagtcctgaggaatgttcttgctggggaccagaatccttcccctgtagggcagcgacagggatgcagcctgtgtccccctttctacacagctggcaggcaacatggaacctttatgcttatttgcaatggtgtactttgactctgatgttttcctggcttaagtattttcttcctttctattttatttacttagcttctatcttcttgttggatcagtttgtaagtcctcatatcatttaggagagtatatgagagaatcataagaaacatagagctggtggaa

SEQ ID NO: 20915 - DNA, 601 bp, Human
aaaacaaagttttagatgcaatatgtctgccacatagatgagttttgtttttgttttgcccgtggtttttcacacacacatacaaacatccacattgctagagcaacgtcagcactcacgaagagcatttttcccctaaatcagttcatttgctttgaaaatattttgacacagcttcaaaagatcaccagtttgaggagacagcattcttccttccatagtatctttagccaaatactaagcagaagcaggtaattgaggacagcttctttcaccagtagatttatcacaactaactgcmaaaaaaaaaaaaaaaaaaaaaaaatgtatgatatctttgacggtaggacaaagacattttttggaatttttcctcagttttttggcaggcctcacacaacatggtttcaaaagactttttttcaatgtgatgaagtgttttgtttgttacagtgaaatgtgttatgtcagttaactcccagacccattacagatacctatgaatgtctttccttaatgtctgagcttatgaattatctggaattttgcttttcaggatgaaaaaacttcttagggttttaaaaagaagatgtgggtgatt

SEQ ID NO: 20916 - DNA, 601 bp, Human
tttgaggagacagcattcttccttccatagtatctttagccaaatactaagcagaagcaggtaattgaggacagcttctttcaccagtagatttatcacaactaactgcaaaaaaaaaaaaaaaaaaaaaaaaatgtatgatatctttgacggtaggacaaagacattttttggaatttttcctcagttttttggcaggcctcacacaacatggtttcaaaagactttttttcaatgtgatgaagtgttttgtttgttacagtgaaatgtgttatgtcagttaactcccagacccattacagatacctatgaatgtctttccttaatgtctgagcttatgaattatctggaattttgcttttcaggatgaaaaaacttcttagggttttaaaaagaagatgtgggtgattttttttcactcaaatgtggttcaggttgagagcccaagcagcatcacagctcagcactttgggggatattttgcagaggaagtcaattcctaccatctgcaacatatgaaaaaccacacctggtagaacctcattgttggtttttccttttcatcactatctcagctcctcgaagcagagggggaagagga

SEQ ID NO: 20917 - DNA, 601 bp, Human
atattttggttatttattaaacagaatataggcccaaagcagcatcctgaagacccaattggccaccccatcatgcatctgtctggtgtgaagcatgccacgggggaggccatctactgtgatgacatgcctctggtggaccaggaacttttcttgacttttgtgactagttcaagagctcatgctaagattgtgtaagtggtaaaattcttactcaatgggcataaatgattgtcttttcatctaagtcacactagtgaaaagtaatggtgtgaagaaataggctatttgttggtgatakccaatgcagaccagaggtgaaacaggatcgaaatgtaggatttactacaacttcgttgtcccaagaattttttcccaattgtctggcagagactgttggacagttcttacctctctcatatcttattatccaattaaccatgttcttggcctctatggccactctaaggagctctgctgtgtatatcatctaggtctattgatctgtcagaagctctcagcatgcccggtgtggtggacatcatgacagcagaacatcttagtgacgtcaactccttctgcttttttactgaagctgaga

SEQ ID NO: 20918 - DNA, 601 bp, Human
atttattctgatttatttatatttccatgtgttaaatgcgctttttattttttattttattttattttattttgaaatggagtttctgtttgtcacccaggctggagtgcagtggcatgatcttggctcactgcaacatccacctcctgggttcaagcgattctcctgcctcagcttcctgagtagctgggattacaggcacaaatcaccatgctcggctaatttttgtgtttttagtagacagcatttttgccatgttggccaggctggtctcgaactccttacctcaggtgatctgccygcctgggcctcccaaagtgctgggattgcaggcatgagccaccacgcccggcttaaatgggatttttaaaagtgagcatctatgatgtctggtcaccatagctgaacaagatatgtatgatctctactctcatggagcttaaagtctagaggagaaaacaaagtgacctttatgtactttctaccttgtgttaagcttgtttattttgatgtcttatatatttcttccacctagtataaattccttgagtgaggacccatgtctgattcatctgtgtattccacacactgcttctcacat

SEQ ID NO: 20919 - DNA, 601 bp, Human
ctttgaggtgtgcttatgaagatcataagcatctcaggggccacatctatgtgccaggtcacaggagcaaaatcaggagtctttggagtgccattgtgaatgattgcctttgttggtttaatgctttttaaaacattcatttatggcacttaatggcttttaaaagtcttttcattgtagaaattgtaagcatacacaaaaatgggaaagtattatacaatgaaccccatagatccatcacccagcttcaacagttatcaacacgttaccattcttgtttcatttttctctccttcactgsccctaccccaaacaaacacactttttttgtgttcatgctagattttatgtttttaatgcctttttttcgatgataaaactactttatgttcattgtggaaaagacataatagttcaaagtcaatttttaaaatgagtgattacattgaaattgtgaatcacagcataaagtaggagagagaactcagcaatgatggtgacttcttccagtccagactgtttttacctttctcaagtcttaaggtttcttttccccatctaaatttctgctgtggtccctgtgtgaactcctgagcctagc

SEQ ID NO: 20920 - DNA, 601 bp, Human
tatggcacttaatggcttttaaaagtcttttcattgtagaaattgtaagcatacacaaaaatgggaaagtattatacaatgaaccccatagatccatcacccagcttcaacagttatcaacacgttaccattcttgtttcatttttctctccttcactgcccctaccccaaacaaacacactttttttgtgttcatgctagattttatgtttttaatgcctttttttcgatgataaaactactttatgttcattgtggaaaagacataatagttcaaagtcaatttttaaaatgagtgatgacattgaaattgtgaatcacagcataaagtaggagagagaactcagcaatgatggtgacttcttccagtccagactgtttttacctttctcaagtcttaaggtttcttttccccatctaaatttctgctgtggtccctgtgtgaactcctgagcctagctgccccacctgcaggcgaataatcctagctgtcaacccccccaggaaggggatgctgtctgcttggtcacgtcttggctaggacatcttttcatgaaaagacagtttgtgaggagagatgtgctcaccatcagggttctgt

SEQ ID NO: 20921 - DNA, 601 bp, Human
cactgcccctaccccaaacaaacacactttttttgtgttcatgctagattttatgtttttaatgcctttttttcgatgataaaactactttatgttcattgtggaaaagacataatagttcaaagtcaatttttaaaatgagtgattacattgaaattgtgaatcacagcataaagtaggagagagaactcagcaatgatggtgacttcttccagtccagactgtttttacctttctcaagtcttaaggtttcttttccccatctaaatttctgctgtggtccctgtgtgaactcctgagyctagctgccccacctgcaggcgaataatcctagctgtcaacccccccaggaaggggatgctgtctgcttggtcacgtcttggctaggacatcttttcatgaaaagacagtttgtgaggagagatgtgctcaccatcagggttctgttatcacaggggactccccttcccaggtcatcccctttttctctctggttgagatgatctgtgacttcctggtcctccctgtccgtgcaggcagaggctgcctctctcagaacagctctgattgtcgtgtgacagccaaacatcaagccatggga

SEQ ID NO: 20922 - DNA, 601 bp, Human
taggagagagaactcagcaatgatggtgacttcttccagtccagactgtttttacctttctcaagtcttaaggtttcttttccccatctaaatttctgctgtggtccctgtgtgaactcctgagcctagctgccccacctgcaggcgaataatcctagctgtcaacccccccaggaaggggatgctgtctgcttggtcacgtcttggctaggacatcttttcatgaaaagacagtttgtgaggagagatgtgctcaccatcagggttctgttatcacaggggactccccttcccaggtcaycccctttttctctctggttgagatgatctgtgacttcctggtcctccctgtccgtgcaggcagaggctgcctctctcagaacagctctgattgtcgtgtgacagccaaacatcaagccatgggacaggctggccctcacacagcctcataggcttggcctggagcctgagcctgctgtcctcaagacagcatcactcctgctcctctgatacagcacaaggatctaaacttcccccagtgcctcgggtcaggaggccagctgtggttatagtcatggacagatgtggaggggtcacacct

SEQ ID NO: 20923 - DNA, 601 bp, Human
tattaacaatttccccaaggacatggcttctttttgccactcttctctgctgcccacaatacaagctcaattcctgtggtcacacagatggccgccaggacaacctggacttccttgttcatgttcaaggagtaagaggaaccctattgccccagcattctaagcacaaatcctgagatccagcctaattaagccacttaggtcacatatccatctccaaattaatgactggcagaggaatggaggagctgttggttacttctaggggtaggagttggggtcaggtttctctgaagtaagygggctatgtaggggagtgtaggaaactgaaacaaatctgagccctgtttggaaagggaaaggggaggggatgctagatgggaaacagtgatgtccaggaaagtggatccactctatgactttttacccaccttcacccaggcacatggtgaggaccaacaggatgttccatgaagtgagtgtcagagacacgatttttagatttttcaagagataagtcgtatgatgcctacaggtattttggcaacttaaactggagaattgcattttctatcctgatttttagaaaggagttgaaaat

SEQ ID NO: 20924 - DNA, 601 bp, Human
agccctgtttggaaagggaaaggggaggggatgctagatgggaaacagtgatgtccaggaaagtggatccactctatgactttttacccaccttcacccaggcacatggtgaggaccaacaggatgttccatgaagtgagtgtcagagacacgatttttagatttttcaagagataagtcgtatgatgcctacaggtattttggcaacttaaactggagaattgcattttctatcctgatttttagaaaggagttgaaaatttataaaggctataagactcatctccatgaaatgataggrtgttctcttgtgtgcattccattggttcttataatttcctggatgatgaaagaatgaacactggggaggcagtgtaaatagatgagactcagtccatacaggccgcatgtgctctgggacacaatattagcttcacagcataatgaacatgttgttctctgggtgaccggcatggcctgaggcagaattgaggaaacaacctgggcacgatcagtgtctccaggagaactgggtgttgggggtgcttcttgccatgctgcttgatgcttaggaacatggagtttgtctctgggaattttt

SEQ ID NO: 20925 - DNA, 601 bp, Human
gtggatccactctatgactttttacccaccttcacccaggcacatggtgaggaccaacaggatgttccatgaagtgagtgtcagagacacgatttttagatttttcaagagataagtcgtatgatgcctacaggtattttggcaacttaaactggagaattgcattttctatcctgatttttagaaaggagttgaaaatttataaaggctataagactcatctccatgaaatgataggatgttctcttgtgtgcattccattggttcttataatttcctggatgatgaaagaatgaacackggggaggcagtgtaaatagatgagactcagtccatacaggccgcatgtgctctgggacacaatattagcttcacagcataatgaacatgttgttctctgggtgaccggcatggcctgaggcagaattgaggaaacaacctgggcacgatcagtgtctccaggagaactgggtgttgggggtgcttcttgccatgctgcttgatgcttaggaacatggagtttgtctctgggaatttttcttacattttaaaataaaaataaaatcatgtcaaatagacaaaaacgtagaagtctaattgg

SEQ ID NO: 20926 - DNA, 601 bp, Human
atgaaagaatgaacactggggaggcagtgtaaatagatgagactcagtccatacaggccgcatgtgctctgggacacaatattagcttcacagcataatgaacatgttgttctctgggtgaccggcatggcctgaggcagaattgaggaaacaacctgggcacgatcagtgtctccaggagaactgggtgttgggggtgcttcttgccatgctgcttgatgcttaggaacatggagtttgtctctgggaatttttcttacattttaaaataaaaataaaatcatgtcaaatagacaaaaaygtagaagtctaattggagtcgaagtgtgattaggcctcccaaattttcctggccagtttcaaattcaaacactctgttcccttctcaggcccttttcatttacatgttgcatgctgctcttgcttcatatattctgtcccctgaagtttgctggagagttagaattacttattagaaattatttacgtaacacttcatcaatattttgtttataaatctttgcccaatatcaggggctaaatatctactctccactccccctaccttccagccaaataaaagccccaataagcaaatata

SEQ ID NO: 20927 - DNA, 601 bp, Human
taaatctttgcccaatatcaggggctaaatatctactctccactccccctaccttccagccaaataaaagccccaataagcaaatataatagatgccactccccccaccctcaccacttcaaccagcagactcgtgattgtctgccagagaatcccagcatcagatacaagctctggctttgtggaaaagagttgcctcacattgtgttcagagattaagctctcaaagtctaaagatcatcaactggatcagagcaaatttaatcaaagtttagagcagggaaatatgcccctctccctrtacattacagttcttttatcactttcctgactaagaaaaattcagaaaattggctcaaagttattcaaagagcaagcagccagtgaagttgaaaaagatgaaacttttaaaaataggatttataaaacctagcttttttttcaacctggaatctctttaatcttagattaataagaaaagcacatgaacagattccaataggaagtgtgttatcaatcaaaatagaacaaaaacaaatatatctctgtcactatcacaaagatttaatctggcacatgcttttcgagtttttagtagatt

SEQ ID NO: 20928 - DNA, 601 bp, Human
attgtaactacatctctggttatgtgcaccactgtacccttttactgggcacccagggagagccaataggagctagtgtataaatggatttgtacacccagctcccagacagggcttgtctgaaatcttacttccagagctggaggtcccaggtgctctactgccctgtgcaaatgaaatgctcatccccgcaaagaaggaatatggggctggcaggcagagccaccatgatcccaatcactagagtcttttcaactagcaattattgagtgtttactatatgcaatataagctcttcacrtcttatttcattttatcttcaccaaccacgatcctattggagctatatgcacacctgttacttccattttacagacaatgataagagaggtgaagtgataggcccacagtcaaagctggtaagtgggaaaaatgtgtgcacaatgctgactgggtctagagcccaggctctgaagccctgtgctgtatggccttggctacatgaaatggattgtggtgtgcagacaataacctgcctggaaaatactagtttcattctgggatcacttagatgccagtttttttctgtgcatattatttc

SEQ ID NO: 20929 - DNA, 601 bp, Human
taaaacttacataaaagttgcagaaacattaaagaaactcccaaatatttttcactcagattccccaattatacacacacacatacacacacacacacttctgagccatttgagagtaaattgtaaacatgatgtatgtctctttacccctaaatagtcagcatttgtttcctaaaaacaggatgttgtctaacataaacatagttatcaaaatcagaatattaacacatattctattaatctacacagtttattcaaatttcgctagttgtctcaataatgtcctttatagcagaaaaaagaggttcatcataagtcttaaataacccatgctttccccgccacactctgctgtcattgctgctgtgaaagctgtcctaatgcctgcctcacaagatctctgatttacagacatgctattgggtgggtatgggcagtctgtgccacatctcagagcagagaaatcatccggcattatctgtctttaagtgaatttccagggcattggcctctagtgcatgttaaaaactcccatcttctgggctgggcatggtgactcatgcctataatcccagcactttgggaggccgaggtgagtgga

SEQ ID NO: 20930 - DNA, 601 bp, Human
taaagaaactcccaaatatttttcactcagattccccaattatacacacacacatacacacacacacacttctgagccatttgagagtaaattgtaaacatgatgtatgtctctttacccctaaatagtcagcatttgtttcctaaaaacaggatgttgtctaacataaacatagttatcaaaatcagaatattaacacatattctattaatctacacagtttattcaaatttcgctagttgtctcaataatgtcctttatagcagaaaaaagaggttcatcataagtcttaaataacccrtgctttccccgccacactctgctgtcattgctgctgtgaaagctgtcctaatgcctgcctcacaagatctctgatttacagacatgctattgggtgggtatgggcagtctgtgccacatctcagagcagagaaatcatccggcattatctgtctttaagtgaatttccagggcattggcctctagtgcatgttaaaaactcccatcttctgggctgggcatggtgactcatgcctataatcccagcactttgggaggccgaggtgagtggatcacttgaggccaggaattcaagaccagc

SEQ ID NO: 20931 - DNA, 601 bp, Human
tgacaccaacctggtcaacgtagcaagataccttctattaaaaaagaaaaaggaagccgggcatggtggctcatgcctgtaatcccagcactttgtgaggctgaagcaggcagattgcttgaggccaggagtttgagaccagcccggtcaacgtagcaagactccttctatttaaaaaaaaaaaaaaaaaaaaaaaaaggaagctgggcacggtggctcttgcctgtaatcccagaattttgtgaggctgaagcaggcagatagcttcaggccaggagtttgagtccagcctgggcaatayggcaaaaccctgtctccaataaaaatacaaaaattagccaggtgtggtggcaaacacctgtaatcccagctactcggaaggctgaggcaccagaatggcttgaacccggtaggcggagattgcagtgagacaagatcaggccactgtactccagcctgagcaacagtgagactgtcaaaaaaaaaagatggatggatggaaggaagggaggaaggaaggaaggaaggaaggaaggaaggaggggaagaaaagaaaaggaaagacaagggaagggaaagacaagggaaggcaaaagaaaac

SEQ ID NO: 20932 - DNA, 601 bp, Human
tttttagctctgaatattttaaataaagtgactacttaacaaaataaattctgagtggataggcagaatcaataatactgcaagcttgaatgtaagcctagtgacaatgacatgggtctttagactatttgataagagcttaaattgaagttaagatctgagcttgtgaaattttaatgtttatatattataagtgaagcagaatctattcatttttctgtgctctttttttaaactcagattttcgataagataggaagtccagattgcaatttaaaacatctcattttttatgcaaatwgagggaatcctcaatttgcaaatcactattgctgagtaaatttttaatttttaaaagttctgccttccattaacatgatcgtcagtaataattgtattctgtttgttccctctgctttttattcttttccccaccttcctgtgggttgcctgaatatttgcttagaatttcattttgattaatctatagtattttttagtatacctccttgtacagattttttttagtggtagctctagatagtttacacatatacatatacacatcatatataaaataaaatttatatacatataaaat

SEQ ID NO: 20933 - DNA, 601 bp, Human
ttgcaatttaaaacatctcattttttatgcaaatagagggaatcctcaatttgcaaatcactattgctgagtaaatttttaatttttaaaagttctgccttccattaacatgatcgtcagtaataattgtattctgtttgttccctctgctttttattcttttccccaccttcctgtgggttgcctgaatatttgcttagaatttcattttgattaatctatagtattttttagtatacctccttgtacagattttttttagtggtagctctagatagtttacacatatacatatacacaacatatataaaataaaatttatatacatataaaatatttacatatataaaatatcacagtctggtttcaacattttacaagttcaagtcaagtgtagaagctttacctccctttacatccctctccctttttataatataattgataattctatttatttattctacatacattgataatcacatgaagcaatgttataattttgcttcaaacacaatttaggaaacccaagaggagaaagaaagtctattgtatatactggtatttttattatttctgttgttctttcttccttcctgat

SEQ ID NO: 20934 - DNA, 601 bp, Human
tgttgttctttcttccttcctgatattttaagatttcttcatttaaaaaaaaaaatcattttctgtctgttttaaaaacttccctcagccattatttcagggtaaatccgtttaaaacaaactcttagttttccttcatctgaaaatgtcctcatttccctttcattgttgaaagatatttttgctggctatagaactctgagttgacaggtattttcacactagaaaaattttaccacttcttctggcctccatggttcctgaagagaaatctactgtctttaaaagtgcttttttttttctttctttctttcttttttttttttcagatggaatctcactctgtcgcccaggctggagtgcagtggtgtgatatcagctcactgcaacctctgactcccaggttcaagctactctcctgtctcagcctcctgagtagctgggattacaggcatccaccaccatgcctagctaatttttgtatttttagtagagacagggtttcaccacgaaagtacttttctcctatagatgaagtagtgtttctttctcatagctttcaacatggtgcttttgtccttagttttctgaagtttgacta

SEQ ID NO: 20935 - DNA, 601 bp, Human
gtggagaggacatggctaaatgatttctggccagtgaaatatatcaagagcaattagaggtaaaagtatatttgggaatttgaggtggggggattgcttgaacccaggagctcaaggcttcagtgatctatgatcacaccactgcactccagcctgggagatagagtgagaccctgtctctaacacaaaacaaacaaaacaaaaccaataatgttatttcttcagggactgaagaaatattgagtattaatagccatattgatttcagtattaatagccatataagttcagtgcttttaaragagtgttattaaagtgggagccttttgtttgtggattgtagctttaaaaccagttatggaatcagcagatctcttgctcagctcttggcaccactgttaggaacacaagagaagaaagaggaagacctgctctccaaagcctatggtgcctaactcacaggaaacagttaagaaacaatattgaaaattatgcaaccaggtgctaaatcagcaaaggcaaaatttacgtgggtggagaaattaggaaagagtttgctgagggctagaatcatccaggaagtcccacaaagaagtcttaa

SEQ ID NO: 20936 - DNA, 601 bp, Human
tttgaacaatgtacctatatatacatacacacatatatatttatatacatataaaccatgtacctatatatacatacacacatatatgtttataaacgtatatgtatgtttgtgtgtatatatgtacattcttcaatatatcaaagatatttttgtaaaatggggtcccatatacacacatacatatatacatatatgtacatatacatacacatatatacatatacgtgtatgtatatatgtgtatatatgtatatgtgtgtatatgtatattttcttgatttaaatatagactttgctyttgttatgcttacattcatttgtatcgccattttcctttgaggatctcaaaaaattctcatgtaaaattgtctctggagcaggcacacctagaaggcttaatttgtttgctgagtaatatgggtcagttcctccatcccaggaagcaaaaataccttgattccagatctctcctatcagggagcacttggtagttagatctgcattcttccatttgtggccagtctaaagaccttgggacgatttgcctataataaaggttgttattacaatgggaaatgcccccaaagcaatgtcctgg

SEQ ID NO: 20937 - DNA, 601 bp, Human
cattcttccatttgtggccagtctaaagaccttgggacgatttgcctataataaaggttgttattacaatgggaaatgcccccaaagcaatgtcctggagcccctggcacccaagagcctctgtcccacaagttgcaaatgcctggcattattccctgacctaacgggaggaaagcccacggtgtatgcctgagatcagcagaggataggcatgcgaaatagttgtgttgttctgtgaggcgtgtaggctccactcaggctcttgccaggagttatataaaccccagagaatgcctgctargtaaaagaggttacctcacttactttttttctgttttagacatggccgtgcagttcgctgtgttctggaacgaggagaagacatgttaataactggaggccgccatccttaccttggaaagtacaaagtgagtacaagagggcatggaggaaggatttatgttgtagatacaacatcctatcagtgcgcagggcagtctttggctactctctagtggggagtaacaatgagcaaatcaaaaacagagcatctatttaactttctattggttgcactgacttttaattactagctggttca

SEQ ID NO: 20938 - DNA, 601 bp, Human
ctacagtcccagagtgggaagtttaaacttgatcttaaaagaaacagtgagactgagtggatccttgaatggctcagtgccgtaattaaacacagatgctttggggagggtaacaggatagtctggggaggagagaggatggaagctggtagacagcgggaggcagctgatgcattcagacatgaagcacatggggtctgagatatgacagtaagttgtagaagagatgggtccaagagccattatagtgtaaaataaaagagaattggtgaaaatcttggcaaaatgctatgaagaatamaaccgcaaacatgacttggagggttttagaagaaagcgacaagttggaaggaggaaccgatctggaagaacgatgaagagcttgtttgtgtaaatgctgggggtagaagtgacaacaggaccctgaagcagaaatgtcctttaccaccatgggactttgctgaaaggactggattatagtgacagaagccattgtcataatggtgactaaaactatgagaaaataatgttttctgatggagagtagtgtgaggaaaggtgatatgaatactacttacgatactattattaattatattta

SEQ ID NO: 20939 - DNA, 601 bp, Human
gagacccagaggggcaaatgatttgtgccaagtcccccagctaactggttaatgcggagcccagactccaaagttcagcaatactcaccttactcagactcctgctccaaaatcctgaagcagaagatcctgaggactgagcactgcattctcccctggctggtgagaagcttccattggctgggggtataactgctacccacaattccatcaaggccctcattccccgcttcctgaacatctcagccagctgtcaaaaagttggtcatttcagttgctaaactgatctccttttggttcttttttttttttttgtaacattaataggttggtttttatttttatttatttatttccataagttattggggtacaggtagtatttggttacatgagtaagttctttagtggtgaattgtgagattttggtgcacccatcacccgatgggtgtatgtatatacatatacacacgcacacatatatatgtgtatatatatatacacacacacacatatatatatatatacatacatacatacacacaccacagtttctttatccactcattgattggtgggcatttgggttggttccaagatt

SEQ ID NO: 20940 - DNA, 601 bp, Human
cacaattccatcaaggccctcattccccgcttcctgaacatctcagccagctgtcaaaaagttggtcatttcagttgctaaactgatctccttttggttcttttttttttttttgtaacattaataggttggtttttatttttatttatttatttccataagttattggggtacaggtagtatttggttacatgagtaagttctttagtggtgaattgtgagattttggtgcacccatcacccgatgggtgtatgtatatacatatacacacgcacacatatatatgtgtatatatatatccacacacacacatatatatatatatacatacatacatacacacaccacagtttctttatccactcattgattggtgggcatttgggttggttccaagattttgttattgtgaattgtgctactataaacatgcaggtgcaagtatctttttcgaataacaacttgttttcctctgggtagacacccagtagtgggattgctgggtcaaatggtacttctacttttagttctttaaggaatctccacactgtcttccatagtggctgtactagtttacattcccaccagcagtgtagatgt

SEQ ID NO: 20941 - DNA, 601 bp, Human
aaggccctcattccccgcttcctgaacatctcagccagctgtcaaaaagttggtcatttcagttgctaaactgatctccttttggttcttttttttttttttgtaacattaataggttggtttttatttttatttatttatttccataagttattggggtacaggtagtatttggttacatgagtaagttctttagtggtgaattgtgagattttggtgcacccatcacccgatgggtgtatgtatatacatatacacacgcacacatatatatgtgtatatatatatacacacacacacttatatatatatatacatacatacatacacacaccacagtttctttatccactcattgattggtgggcatttgggttggttccaagattttgttattgtgaattgtgctactataaacatgcaggtgcaagtatctttttcgaataacaacttgttttcctctgggtagacacccagtagtgggattgctgggtcaaatggtacttctacttttagttctttaaggaatctccacactgtcttccatagtggctgtactagtttacattcccaccagcagtgtagatgtgttccctgttca

SEQ ID NO: 20942 - DNA, 601 bp, Human
cttcctcagcaacactgattattcttaagtttggttgtttaacataatcccagacttcttggagattttgttcctattttctattcttttctccttgtctttgttggattgggttaattcaaagaccttgtcttcgagctctgaatttctttcttctacttgtttaattctactactgagactttccagagcattttgcatttctaaaagtgtatccaaagtttcctgaatttttttattgttttttctttaagctatccatttccttgaatatttctccctaacttcttgtaactttttwaaaatttctttgaattgggctttgcctttctcttgttcctccctgattagtttaataactaacctcctgaattctttttcaggtaaatcagagatttcttcttggtttggatccattgctggtgaactagtgtgattttttgggggtgttgaagagccttgttttgtcatgttaccagggttgcttttctggttccgtctcatttgggtaggctctgtcagaaggaaagtttggggctgaaggctgttgttcagtttcttttgtcccatggaatgttcccttgatgtagtactctccccc

SEQ ID NO: 20943 - DNA, 601 bp, Human
cactaccagagtgaatagggaaggaccatcaggtgggggcagggctaggcatgtctgagctcagactgtccttgggtgggtcttgctgtggctgctgtgggggatgggtgtgagattcccaggtcactggagttgtgtacctaggaggattatggctgcctctgctgagtcatgcaggttgttagggaagtaggggaaagccagcagtcacaggcctcacccagctcccatacaagcagaagggttggtctcactcccaatgtgtaccccccaacagccctgagtttgtttgcaggcagasagtgtgatgggcttgaaaacttgccctgtgctgcacccctagctgagagagaaaagggcttggtttctccccctgcctgtggagtctgcacaccagatttgtgccctcccactgagctctgaccaggaggcttcttgccccattcaaattgttacaaagttcagctagagatttctttctccctgtggagtttcaccccctacttctctggtcccccgccccctccgcccccaccatggatccctgtgttgttaggcaggaatggcctggcctgctaggggacacagcaagctcctaggg

SEQ ID NO: 20944 - DNA, 601 bp, Human
ggaaggaccatcaggtgggggcagggctaggcatgtctgagctcagactgtccttgggtgggtcttgctgtggctgctgtgggggatgggtgtgagattcccaggtcactggagttgtgtacctaggaggattatggctgcctctgctgagtcatgcaggttgttagggaagtaggggaaagccagcagtcacaggcctcacccagctcccatacaagcagaagggttggtctcactcccaatgtgtaccccccaacagccctgagtttgtttgcaggcagacagtgtgatgggcttgaamacttgccctgtgctgcacccctagctgagagagaaaagggcttggtttctccccctgcctgtggagtctgcacaccagatttgtgccctcccactgagctctgaccaggaggcttcttgccccattcaaattgttacaaagttcagctagagatttctttctccctgtggagtttcaccccctacttctctggtcccccgccccctccgcccccaccatggatccctgtgttgttaggcaggaatggcctggcctgctaggggacacagcaagctcctagggcctttctgctgcttcctc

SEQ ID NO: 20945 - DNA, 601 bp, Human
ctagggcctttctgctgcttcctctacccctgcattttgcttggctctctaaattgtctcagcttcaggtaaagtcggaatcttctcctgcaaacagaatttcagcttctcccgtgggggtgtgtgtctgggagaggaggatctcccttccccctcacagctggggcactcacggtatttggggtatctcctgggtcctgcaggagtagtccacttccttcagagggtttgtgggtcctctcaggattattgctttgttcttgcagtcgatctagagctaaaattcggcgaacttccacargctgctctgtccagagctgcaatctagtcctgcctcccgtccgccatgatgatccaatttctccttttggttctttcagtctcagccccaactttgtttattgacaacgaccttccccttcctggctcctcctcccagatcctggaatggaattagtgtggggagatggggtgagctctctctcagccccttctcctcccctgtgccttctgctgtgatgctggtgcaaggaggaagagaagaaggaccaggaaaacagtcagtttctccctgtgtgacttctcccggcaagctcacagt

SEQ ID NO: 20946 - DNA, 601 bp, Human
gctcatgccccagcagtctttagaaggccccaggtcccaattcatctaccagctttcacccaacagtagccactttctttgcttctcttgaacgtgtgggaggccttgcccctcccttcctggccatcccactaaactctctcctgatgtcctgccacatttggtagcactaaggaggagaattacatccttcccttcattcccagggaagttagagcagggaacagcctcttaaaaacaccactttcccccaaatgagatggcttactaatttccagtgtttctcttacaatgatctgawaatttgcttcggagggtggggagagtgtgtctgtgatggctctgtcagcttagggagggggctggccacaagtgctatgagttttctcagctgagaatgtgacatacttggcaccttttattctcagcttagggtcttagtcaccaattctgggaatacaggaagaattctactcagtgcttcagacatcctgggatagaatcttttaatttgttcttcatcctagatattggttatatttaaacgaactttcatgcttgcctgttttggaggtgagtagtcttatcttgcaacatagca

SEQ ID NO: 20947 - DNA, 601 bp, Human
gatgagcctatgtctgctgggtttcccctcccagctttaatctccttttctttcataggtgcgaatcataaacatgtacaaggaaattgatcaaacaccctacaaacaagagatcaatgccaagaacctaatccagtgttggagagaatgtatggccatgtcttcctactccttgaggaaagttgctgtggaaaagttcaatgcagagaattattggaagaagaaaggactggccatggtccccctgaagtttcctgttggccttggctcacgtgctgctggtcaggtgagttctccaaaygcacatgaggatgctgcctggaagcagccctgacaaagcaagaggtgttgaggaaacttctccttaagtcatattagccatatggttgcaatgcccaattgttaaatttcacaaaagccaccaaagtcaaagtaattaagctagctttactccagaggagaccagagctcctctgctcacatgcccatggttggtcaaaaacattcttgctggaaattgggagactgaggtttactcctggccctggcaacaggagttggcaaatggcagctgagtccatttgctctgggctcagactgc

SEQ ID NO: 20948 - DNA, 601 bp, Human
ttaaattcagaaaaataaatcactttttaaatagaatttttgaagtttattcaccttgtaccttttaaaactgtgaaaggggggactgggaatctgctcttgcagtttaatttctttcattgattaaagaaatccccttgcttggttgcagtttccacctcttcattcttgacttcattcattcttaagaatgaataaaacttacccctaacggctggtgaaggactgcaacattctagctcattgtatggcagccgggaacccctattatctattttattacatacacacatccatgtayatacagataagctgggaggaccctcacaattgtcactcctctttgcagaattcactccttggttggagtcatgaagaaggcatggcagctgtgctgagcgatcacaaaataggaacaaatggcagggtaggggagcttcgagaggggcgttagtgtggatgttgtgtgttaagggatcagaagaggccaggaaaagtgggtaggaaggtcctttcctccatcccatatccatccattcacctaactgtcctagttgagctttggtgccatcctgagaacatttgcatgcagctttgattg

SEQ ID NO: 20949 - DNA, 601 bp, Human
tcattgattaaagaaatccccttgcttggttgcagtttccacctcttcattcttgacttcattcattcttaagaatgaataaaacttacccctaacggctggtgaaggactgcaacattctagctcattgtatggcagccgggaacccctattatctattttattacatacacacatccatgtacatacagataagctgggaggaccctcacaattgtcactcctctttgcagaattcactccttggttggagtcatgaagaaggcatggcagctgtgctgagcgatcacaaaataggaayaaatggcagggtaggggagcttcgagaggggcgttagtgtggatgttgtgtgttaagggatcagaagaggccaggaaaagtgggtaggaaggtcctttcctccatcccatatccatccattcacctaactgtcctagttgagctttggtgccatcctgagaacatttgcatgcagctttgattgtaggcaggtggtaggtcagagaagtgttataacaaatgatgatcttattgcagtcttctcattccttgcctgtttgtgatggcaaaaaataacacagagccatgtagtcatctgca

SEQ ID NO: 20950 - DNA, 601 bp, Human
aatggcagggtaggggagcttcgagaggggcgttagtgtggatgttgtgtgttaagggatcagaagaggccaggaaaagtgggtaggaaggtcctttcctccatcccatatccatccattcacctaactgtcctagttgagctttggtgccatcctgagaacatttgcatgcagctttgattgtaggcaggtggtaggtcagagaagtgttataacaaatgatgatcttattgcagtcttctcattccttgcctgtttgtgatggcaaaaaataacacagagccatgtagtcatctgcatrcagtttactcaaatgtgggagacagtcaagatactgtggttgagaaataaaagcaaaaacgaggttattacaaaagaagagagaaagaaactaccactgggaaaagggtttgtaagcattgagtcttggtatagaattttggggtaaactgattagctggcagctaccaaagaggtcagctggggctgtctgtccttgtgcagactagtcaggatcatcaggaaaaacagcctccattgttcatggatcctctggaaatcctctcacgtttggccgtgggtaaacatggcgcactgcctc

SEQ ID NO: 20951 - DNA, 601 bp, Human
gctggcagctaccaaagaggtcagctggggctgtctgtccttgtgcagactagtcaggatcatcaggaaaaacagcctccattgttcatggatcctctggaaatcctctcacgtttggccgtgggtaaacatggcgcactgcctctatttgatggctgccattactttatatctggcctccaccatagaccaggtctcacccattttcctcatcagaattttctcaaaaagtagatttgaaaaatatggtgaggtgcagtggctcacgcctgtaatcccaacactttgggaggccaagacrggagaattgcttgaggccagaagtttgaaaccagcctgagcaacatagtgaggccccatctctacaaaaaagaaaaaataataatagtgacaattactgagcactacgatgttgtaagtacttttaggtatttcatttaatcttgggacaacctagaagatttgtatcctcattttaggtataaaaaaaatctaggcttagaaggtttaaataactggctcaaggtcctgcagctggtagaggtaaggctggggctagaactcaggcctgagtggctctgaaagctgggttttctagtta

SEQ ID NO: 20952 - DNA, 601 bp, Human
ttttttacaaattaaaagtttgtggcaaccttgcttcaagcaagtctattggtgccatttttccaacagtatgtgctcactctttgtcaccttttggtaattctcacagtgtttcaacctttttcataattatggtgatctgtgatcagttatctttgattttactgttgtaattgttttggagcaccatgaaccacatccatataagacagcaaacttaataaatgttttgtgtgttctgactgctccacaaatagaggagcattcttcccccatttctctccctctcctcaggcctccmtattccctgagacacaatgatattgaaattaggtcatttaataaccctgcagtggcctctaagtgttcaagtgaaaaaaagagtcacaagtctcacttgaaatcaaatgctagaaatgattaagcttagtaaggaaggcactgcactccagcctgggtgacagaagagaccctgtctcaaaaaaaaaaaaaaaaaaaaaaaaacagaaaagaaattgttacaactacctcctcaatcgtcagcaaccaccaccctggttagtcagcagccatcaacattgagaaaagaccctccaccagc

SEQ ID NO: 20953 - DNA, 601 bp, Human
caaattaaaagtttgtggcaaccttgcttcaagcaagtctattggtgccatttttccaacagtatgtgctcactctttgtcaccttttggtaattctcacagtgtttcaacctttttcataattatggtgatctgtgatcagttatctttgattttactgttgtaattgttttggagcaccatgaaccacatccatataagacagcaaacttaataaatgttttgtgtgttctgactgctccacaaatagaggagcattcttcccccatttctctccctctcctcaggcctccctattccmtgagacacaatgatattgaaattaggtcatttaataaccctgcagtggcctctaagtgttcaagtgaaaaaaagagtcacaagtctcacttgaaatcaaatgctagaaatgattaagcttagtaaggaaggcactgcactccagcctgggtgacagaagagaccctgtctcaaaaaaaaaaaaaaaaaaaaaaaaacagaaaagaaattgttacaactacctcctcaatcgtcagcaaccaccaccctggttagtcagcagccatcaacattgagaaaagaccctccaccagcaaaaaga

SEQ ID NO: 20954 - DNA, 601 bp, Human
tcctcagagaaagggtatcctgatgtccccatttgcccagtacatccctagtttacacctgccgaccaaataaatggagtgcattttcactgtcaaacttgccttatttggaatgatagaggtttctggttgtcattcacgggggtaatgtgaacctttggatacaaataaagagacagttctccaagcatggtccacggtccccaggcagcttggaaggcccttctgatgggcagagaattgatctggaaatgcagtctttttcttgggtttatctggtgattaacatgcagttccatcraccttcacttaatgaccagggttgcttacaaataatctaagtgagcaactaaggcttaggaaaatttttggtttattaagttgacattggcttattaccagaattttctgaagaccttgacattacaaatcctagattattatgtcactctgcctaaaaaattagatgtgaagaaacctagctgacccagaccacacccatgcggtcagcacttccctgctgcaaaactgtaaaggttgccttgcaggctttcccggaccacagtggaaccactgagagatatctgttctaggaggacca

SEQ ID NO: 20955 - DNA, 601 bp, Human
attatgtcactctgcctaaaaaattagatgtgaagaaacctagctgacccagaccacacccatgcggtcagcacttccctgctgcaaaactgtaaaggttgccttgcaggctttcccggaccacagtggaaccactgagagatatctgttctaggaggaccattgctgctgatgttgctcttacattgcagagccaaagggaagaagccatccttctttcctgctgtgattttctgggatatccccatattctagtttagcacaggcagatacgcaagaaggcacattcttgttaattataaaaaacatgtttagcttagagactggatgtttctgattataagagtctttaatgctgttagcagtctggttccttctggatccttgtggggagctatacagttagataagattacttccaagttcttgtctaactccaaagctctgtagttctgtgccaagatgatttagggtgagcttagtcattttgcagcaaaacaattttagtgtctatctatctcatcttatatgggattataagaaaatggatttccattttcatttttctgggacatgcctacaactatgagaatatgtgtgc

SEQ ID NO: 20956 - DNA, 601 bp, Human
actgtaaaggttgccttgcaggctttcccggaccacagtggaaccactgagagatatctgttctaggaggaccattgctgctgatgttgctcttacattgcagagccaaagggaagaagccatccttctttcctgctgtgattttctgggatatccccatattctagtttagcacaggcagatacgcaagaaggcacattcttgttaattataaaaaacatgtttagcttagagactggatgtttctgattataagagtctttaatgctgttagcagtctggttccttctggatccttgtsgggagctatacagttagataagattacttccaagttcttgtctaactccaaagctctgtagttctgtgccaagatgatttagggtgagcttagtcattttgcagcaaaacaattttagtgtctatctatctcatcttatatgggattataagaaaatggatttccattttcatttttctgggacatgcctacaactatgagaatatgtgtgcacacaattattcaccctctccctctacctgtctatactttactttgtattttaaaatagagtccccgccctggtttcccccaccccaa

SEQ ID NO: 20957 - DNA, 601 bp, Human
gggaagaagccatccttctttcctgctgtgattttctgggatatccccatattctagtttagcacaggcagatacgcaagaaggcacattcttgttaattataaaaaacatgtttagcttagagactggatgtttctgattataagagtctttaatgctgttagcagtctggttccttctggatccttgtggggagctatacagttagataagattacttccaagttcttgtctaactccaaagctctgtagttctgtgccaagatgatttagggtgagcttagtcattttgcagcaaaamaattttagtgtctatctatctcatcttatatgggattataagaaaatggatttccattttcatttttctgggacatgcctacaactatgagaatatgtgtgcacacaattattcaccctctccctctacctgtctatactttactttgtattttaaaatagagtccccgccctggtttcccccaccccaaaaagaaacctaaaatgttgctccaccctggggggtgcgggattcttggagggaaatatttccaaggaaaatgttttaattgacacgatatgtgataatatcaaaaagatc

SEQ ID NO: 20958 - DNA, 601 bp, Human
attaattttaagctactgtttctcttttgttaatcataatagtaacattatagattataaaatatttggaagcagcagaacattttaaaaaacaaagaccctacacagtttcaccacatagaataatcattatttgggagtctttacatcttgtcttttttgcttttgcaaaaaagtcaccaacatgcttttgtttaattttgtattctgtttttccacccactttatatagcgtgaacactttctcctgtcattaagcagtctttacaatcatgaattgtatgtggctgcatgtggatayatatatgatttatttaaccatcccccagttgtttgaatacttcagtgaatatttttgtacactaacctgtgatcaaatcattgattgtttcttaaaatagacttctgggaatagaattactgggtcacaggtgtgaccattttaaattgtttgacacacattatcaaattgttttccagaaagtatccctctcatgacacccctaaccaacagtgaatgttatggattgttgaaaatttgtagataatttgataagtgaatgaaagtatctcattattgctttcatttacatttttctga

SEQ ID NO: 20959 - DNA, 601 bp, Human
tcaatggaatggaaatactcaactgcttcctttgatctgcttataatctagttggaaaagaagacacattctaaagtcagctaacaaacttttcaaagtaatagtttatcaactaccagatgttgtggaacaaatatccataaaagctgggagcatgtgtcacgctggctattctagaatgtcagtttttgcaaccttacaaatacaggtctgggggaaataacatttgaggatcccacttagaaatggtttctgctattccatggagtaaggactcattttataattcatatttatgggrtctgtctatacttcctgggcatatttgtttctgtcctctgtcccatgctgcctgagcccagaaagcctgagtcagtgtggctggagaaagctggagagaggtgcagcatggagagtagtactccaccaccatgagatgcagccattcagcccactttcttcgctaatgattgatgtgcttctgaccttcattcctagacttagggacttggacctgaccctgatttttgtgcatagtagtcagctctgtgtactgcagagttttggtgtaaatggtacaatttagcaaaattattcccct

SEQ ID NO: 20960 - DNA, 601 bp, Human
gtttctgtcctctgtcccatgctgcctgagcccagaaagcctgagtcagtgtggctggagaaagctggagagaggtgcagcatggagagtagtactccaccaccatgagatgcagccattcagcccactttcttcgctaatgattgatgtgcttctgaccttcattcctagacttagggacttggacctgaccctgatttttgtgcatagtagtcagctctgtgtactgcagagttttggtgtaaatggtacaatttagcaaaattattcccctcacctgaaacaaatgtgtccagaaagrattgacagttcccataaatatgaattataaaatgaacccttactctatagactagcagaaacctgatattaaaattaagcagccaaccaagcattgttttctaaaatgtcccatcttaattgaaaattttctgcagatgactgagtgaatttcttcctaagtggaacatatgttgatgactttagtccagcctgtatcataccacagcgggcatttagtacaatcataggtgctgaacaaacagctacaagccgtgaaccacagaggagaaagccaaaaggaatggattaatctgggtcc

SEQ ID NO: 20961 - DNA, 601 bp, Human
gcctgagtcagtgtggctggagaaagctggagagaggtgcagcatggagagtagtactccaccaccatgagatgcagccattcagcccactttcttcgctaatgattgatgtgcttctgaccttcattcctagacttagggacttggacctgaccctgatttttgtgcatagtagtcagctctgtgtactgcagagttttggtgtaaatggtacaatttagcaaaattattcccctcacctgaaacaaatgtgtccagaaaggattgacagttcccataaatatgaattataaaatgaacscttactctatagactagcagaaacctgatattaaaattaagcagccaaccaagcattgttttctaaaatgtcccatcttaattgaaaattttctgcagatgactgagtgaatttcttcctaagtggaacatatgttgatgactttagtccagcctgtatcataccacagcgggcatttagtacaatcataggtgctgaacaaacagctacaagccgtgaaccacagaggagaaagccaaaaggaatggattaatctgggtccttcctggttactattgctgatagttttatttaacacac

SEQ ID NO: 20962 - DNA, 601 bp, Human
tgactgcctgtcaggaacaggcattggaagcatttttaatggccacctccaggttgcagggcagcagaggagagagggtagagagttctgcaagctgctgacccatgcttctgttttaccattatttatttgatgttcttaaagattagttaggaacagagcaggccatggagcttgatggtgagagaccagagtagagacaaagaatgggagccatgggacctgatccttcacacagaggggcaaattctggagccagaaagatagacaaagcaggcaagcatgcacctttgaaatagcrtttggtgtaaaatgaaggttgagttccccaaatctgatgatccaatattagccaaaagcagtaagatggacattcaggaagtaagaagctaacctccaggagtaaggaggcaccagtcaggagtagttagatgtttttatcagacaaagcaagttttaaaagaaaaaactaaatacttatttattcaacacatttatcgcacatacattaggtgctggcacatacattaggtacaggtatattcctgtggcttgcataaatcctcatgggtctgtttagtcatcatggtctgcaattagg

SEQ ID NO: 20963 - DNA, 601 bp, Human
gttagactagcagccctacactactagggagcgggttcttgcatagaactgatttctgtttgtttgtttgtttgtttttgagacagaatttcactctgtcacccaggctggagtacagtggcttgatcttggcttactgcaatctctgcctcctgggtttaagtgattcttgtgcctcagcctcccaagtagctgggattacaggctgcgccaccacacccagctaatttttgtatttttagtacagacatggcttcaccatgttgcccaggctggtctcaaactcctggccttcaagtgrtccacccaccttggccttccaaagtgctgggattataggcctgagccactgtgccctgcccatataactgatttctaagtcccttctccctcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggtta

SEQ ID NO: 20964 - DNA, 601 bp, Human
cccatataactgatttctaagtcccttctccctcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggttagtgtcactgctaggcaaagggccagaatgtgacattctaccaggggccctccccaaagkcctgtttctcagccattctcctgttgatagacttgcccttattccggcaaaattttcctcactttgaacctacatctaaatatcagttacctgttctgtacaacaaattacccccaaacttagtgctgaaaacagtggatgctcattagctcacaccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgt

SEQ ID NO: 20965 - DNA, 601 bp, Human
tataactgatttctaagtcccttctccctcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggttagtgtcactgctaggcaaagggccagaatgtgacattctaccaggggccctccccaaaggcctrtttctcagccattctcctgttgatagacttgcccttattccggcaaaattttcctcactttgaacctacatctaaatatcagttacctgttctgtacaacaaattacccccaaacttagtgctgaaaacagtggatgctcattagctcacaccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgttgac

SEQ ID NO: 20966 - DNA, 601 bp, Human
tcaaagcaaaagttggtgaaaacttagtcatgtggattttcttatattcctatatatgcattgtccttgttaagatccaagaacaaggtaataattagcctagtatgaaattttaaggcatgttcctataacttatttgaatgatcttaggggatgtgtcatatagcctcatcagatgccttcataaaagctaaatctcagctcaggttagtgtcactgctaggcaaagggccagaatgtgacattctaccaggggccctccccaaaggcctgtttctcagccattctcctgttgatagamttgcccttattccggcaaaattttcctcactttgaacctacatctaaatatcagttacctgttctgtacaacaaattacccccaaacttagtgctgaaaacagtggatgctcattagctcacaccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgttgacaggaggctcagcttctcactggctgttg

SEQ ID NO: 20967 - DNA, 601 bp, Human
caccacttctgaggggctggcctccgggagtggcttatctgggtgattctgcatgaggcttgtcaagctgtggctggggcaacagtcatctcaaggctcaacggggacaggagaatcctgttccatctccctccatcatagcgttgttgacaggaggctcagcttctcactggctgttggccagaggcctccattctttgtcatgtggatacctctttgtaggctgcctgagtgtcctcaggacaagacaactggcttcctccagagagaccagcccaagagaaaaagagagagcatgtgyaagcgagagagtacccgagacagaagcccagctttataacctaatctcagagtgactactgtcacctctgccatagcctactggtcaaacaggctggcctggtagagtataggaggagactacatatggatgtgaataccaggaggtgaggattatccagagccatcttttaggcagcctaccacaacctagatccactctctccagtcctaacaaaagacacgacagacagcactaagcctacagctttgtgggttgtttttttctgttttgaggtggattcttgctctgttgcccagg

SEQ ID NO: 20968 - DNA, 601 bp, Human
ccagccccaccagcctaagcacacagctttgaaagcacaaccttcactaacactgaagactttagagctcctcctctaaccttcagctgaggccacttatctcctggaaggccagtcttgctgactgatgtcaaagaggactttacattttactgtgtgtttaaataagaaatgtgagttcctgaagttttattattgtcaaacattccagatcattatctaattttcaaatgttacatgaaagtcccagatcaaataaggaaactcttggatttcttttgttcaattagtaattataagwacaatctgttagtcatggcagagaccattatatcacattaaaaaaaatgtacagacttgctggaaagcaaaggtgttactaacactctggctgggcctgctgtacttctcctcatttgtaggttatcagtagcaagttgtagtgtcaactttattctcttctctgctacaaaaatgaaaagtctagaacagcagatgacaatttgaagacttttttgttggtgcaccctgaactctgtggttcagtaaacattcctcagccagttgtacctggatgtttggttgtatgctagccattaag

SEQ ID NO: 20969 - DNA, 601 bp, Human
ttatctcctggaaggccagtcttgctgactgatgtcaaagaggactttacattttactgtgtgtttaaataagaaatgtgagttcctgaagttttattattgtcaaacattccagatcattatctaattttcaaatgttacatgaaagtcccagatcaaataaggaaactcttggatttcttttgttcaattagtaattataagaacaatctgttagtcatggcagagaccattatatcacattaaaaaaaatgtacagacttgctggaaagcaaaggtgttactaacactctggctgggsctgctgtacttctcctcatttgtaggttatcagtagcaagttgtagtgtcaactttattctcttctctgctacaaaaatgaaaagtctagaacagcagatgacaatttgaagacttttttgttggtgcaccctgaactctgtggttcagtaaacattcctcagccagttgtacctggatgtttggttgtatgctagccattaagctttgcaactaggatcgtgagggccatagatgttttcttttgttgtgtcatatgttatatctgttgtagtgaattaaactcaatctgttgcatcat

SEQ ID NO: 20970 - DNA, 601 bp, Human
ggtgcaccctgaactctgtggttcagtaaacattcctcagccagttgtacctggatgtttggttgtatgctagccattaagctttgcaactaggatcgtgagggccatagatgttttcttttgttgtgtcatatgttatatctgttgtagtgaattaaactcaatctgttgcatcatacagcttgaatcaaaatgaagtaaatatttttttctcctattatttccaagaaaaaaagacagtgcttcagctggctaagagtatttgtataattttgaaagttttacataataaactttgtcmtataataaaatctttgttgcttctttcgaaatgacatggctgaaagaaaggctttataccaaagtcagcctggcaggaagtgttcctcagcttcttctccctaagttattctcattaaaataaacattttaacttttttttaatactagaacatcagaacagacattgtcatggatgttggctgcagtataaatccagccattgacataggccaggtacgtgtaactgatgtgtctcactttctatttgtaaaagccaaaagtgcggtggggtctgcaggagagcattccatcagtctta

SEQ ID NO: 20971 - DNA, 601 bp, Human
acataggccaggtacgtgtaactgatgtgtctcactttctatttgtaaaagccaaaagtgcggtggggtctgcaggagagcattccatcagtcttattcatcatcttatttttctaaccctttagtcaactctattcagaccaactgcagagctcaaatgttttactgtttaaaagggggaaggaaataaaggtgttttaggtagtttttgaagaaacataaaatctgtgactagggagcttgaatgaggcaagaccaagcctacaggtgactgatgagctccaaacttctgggacataartagagttagtgcccagtgctgagccttagccacacgatgggcttcagcttcgaggagtttgaagtcgtgttgggataataagcctcaagtcatcagagcagtagctgttggtaggcagcctgtagtgctggattccacccacagacattttcaaatttaaatttgaaatagttgaaaagattggaaagtcataaatatctagtttctcttgaaaacagaaagtttgcccacactggatcctcatttccatgagtgaagtcggtgggctgtacctttagagtcccacactctccaatgaca

SEQ ID NO: 20972 - DNA, 601 bp, Human
gcattccatcagtcttattcatcatcttatttttctaaccctttagtcaactctattcagaccaactgcagagctcaaatgttttactgtttaaaagggggaaggaaataaaggtgttttaggtagtttttgaagaaacataaaatctgtgactagggagcttgaatgaggcaagaccaagcctacaggtgactgatgagctccaaacttctgggacataagtagagttagtgcccagtgctgagccttagccacacgatgggcttcagcttcgaggagtttgaagtcgtgttgggataayaagcctcaagtcatcagagcagtagctgttggtaggcagcctgtagtgctggattccacccacagacattttcaaatttaaatttgaaatagttgaaaagattggaaagtcataaatatctagtttctcttgaaaacagaaagtttgcccacactggatcctcatttccatgagtgaagtcggtgggctgtacctttagagtcccacactctccaatgacacaggacccacctggaatcttcatatactgggtttacgtgtctcgaacctggaggcaattcagctcattacctctgattt

SEQ ID NO: 20973 - DNA, 601 bp, Human
cgatgggcttcagcttcgaggagtttgaagtcgtgttgggataataagcctcaagtcatcagagcagtagctgttggtaggcagcctgtagtgctggattccacccacagacattttcaaatttaaatttgaaatagttgaaaagattggaaagtcataaatatctagtttctcttgaaaacagaaagtttgcccacactggatcctcatttccatgagtgaagtcggtgggctgtacctttagagtcccacactctccaatgacacaggacccacctggaatcttcatatactgggtttrcgtgtctcgaacctggaggcaattcagctcattacctctgatttagggcaccatcttgtgtcccctcccccccaccccccgcccccaccatcatgacattgcattattggcgaatgggaagaatctgtggtgtggagaagtcaaaggaggcttagggaggaagtgggtgtgaaccaggttgtcaaggaaagaatgagaaacgacattaggggtgaaagaagagtggaggaagtcaccctacagaaacacatggaatttagcatgcctgttcatggctgctaatcaggccagggcagatga

SEQ ID NO: 20974 - DNA, 601 bp, Human
ggaggaagtcaccctacagaaacacatggaatttagcatgcctgttcatggctgctaatcaggccagggcagatgactatggggaaggcctgtgtgggaggggtgggccatgaggagggagtcagagagcagaagagggctggggactgccaggggtgggtggagggcttttagagacaagacttcacttagtggggatggactgaagtgtttggaagactgatctaaaatcagagtccagagatgtgaggctagccactttgtgggcaaggaggtgggatgagacaatgggattgtagcwttcactagcaccctggggtctctggacacatcagtcaggggggtttgtctgcctcatgggcaaaaaacaaaagaagagggtgcttgggctccagactctgtgaagactcttcctgagcactcatttcaatggccaaaccaaaattagaaccctagtcctttgtctttgaccttctttttttcatgatttttatttattattattattattttttttttttgagactaagttttgctcttgttgcccgggctggagtgcaatggtgcaatctcagctcaccgcaacctccgcctcccaggt

SEQ ID NO: 20975 - DNA, 601 bp, Human
tctaaaatcagagtccagagatgtgaggctagccactttgtgggcaaggaggtgggatgagacaatgggattgtagcattcactagcaccctggggtctctggacacatcagtcaggggggtttgtctgcctcatgggcaaaaaacaaaagaagagggtgcttgggctccagactctgtgaagactcttcctgagcactcatttcaatggccaaaccaaaattagaaccctagtcctttgtctttgaccttctttttttcatgatttttatttattattattattattttttttttttgaractaagttttgctcttgttgcccgggctggagtgcaatggtgcaatctcagctcaccgcaacctccgcctcccaggttcaagcgattctcctgcctcagcctcccgagtagctggaattataggcatgcaccatcacacccagctaattttttttgtatttttagtagagacgggatttctctatgttagtcaggctggtctcaaactcccaacctcaggtgatccgcctgcctcggcctcccaaagtgctgggattacaggtgtgagccaccacgcccggctgactttgaacttctttt

SEQ ID NO: 20976 - DNA, 601 bp, Human
tcctctagggtgatattcgtcattactctgtctcttcaatccatccagctaaatggaataggtgatgacttgcatgtgactcctacttggcttctatccaccaacagaaattataccatatagtgaaaggcaattttctaaataatttcattactaatatgaactgtgaagttgtcattttttcatttgtccttttctgctatcaccttcctcttgtcagaatgaatatagacactgtatctaagtgggaccaaagaaaaaatagcgaactttcaccaaagttttcatgaaaacccaaaarctttaaaagttactatcaagaaattgaaaggaaacccacagaataggataaaatatttgtaaatcatatattgataaaagtcttgtaaccagatacataaagagctcttacaactcaataaaaggcaagtaatttaaaaataggcaaaagaattgctggatggtatggtagttctatttttagtttttaccctaactactctgacttgatcatttaacattctgtgtatgtaacaaaatatcacatgcataaatattatgtatcaataaaattttttaatgggcaaaggatttgagtaga

SEQ ID NO: 20977 - DNA, 601 bp, Human
agaatctttagaaatatatgttcttgaaaggtattccataaatgttcttccttttacacttgccttcccagtcttcaatatgagagggaatgaaaagtcaggaaataattgggtgagtaaagcagatatagatagaaacttccattttctttagtcatcttgaaggatatatgtttgtctttgctctctgttgtctgagaaatcagaaaattgaagttaatatgctagccacattttcttaacttctcttggaaattttcaggctaagcctcagctttgctctttgttttttatggtattrcttcagtaattattccaaagttctattcattcatgcttgttttgttttggattttagtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggtaagtgtcttagtccatttcatagtctagtaaggtagatagaca

SEQ ID NO: 20978 - DNA, 601 bp, Human
ggtcaccatacatggaatggcaggctgtgggaagtctgtattagctgcagaagctgttagagatcattcccttttagaaggtaagtgtcttagtccatttcatagtctagtaaggtagatagacatgtaaaaatattatgatatatcaatacgtgataaattgaatggtagaaacaagtataaggtacagagttagaacaaaggaaggatatgttaactctctgaagggaggggatggataggacaagcttcctgaatgagatgacatcttagcaggagtttggagaaagaataaaagttwgctaggcagtgaaggtagggatgggagactagggaaggtgggaaaggtagtgggtggttactggggtggggaagggcatactgggtagaagagggtttaagaaatgttggcaggtataccactgaccttagcgatcctggtaggttctcagggtattcatcaggaatagttgtatagctccatcagttctaggctgcccccattcatcagtgtgttctcattcatcagtgtgttctctctgtatgacacttctaggggaattcaaagacagttcccaacttctagtagttaataattttt

SEQ ID NO: 20979 - DNA, 601 bp, Human
ttaagttcctttagtgtgaaggaatgagttttcctttcaatattatgaactttctttgtgtatttataatattccaatttataggtttaaaagaacactccctctccccatttaaattgctctacattattgtgatgaattttcaattctagggattaaaattgactaacaatctatggaattaaatattcaggagtcatattgtataaattgttatcttggaacaggttttaactactttgttttgagaaaatcctagagatactggcaactgtacatgtgagcttaattcatattcctygtacttttgtgggatctcaagttcagaggactgagttattcatattccttagttcacggcttattatagtagatctgtactaggctgagcttttcactgtatttatttatttccatttcaaaatttcctattcttatttcctttcccctctccatggacaatcctaatgtatttaatgtatgttctttgtaaatgtctgtgtaaagtgtgtactcttgtaaaatatgtatgttgttggtatgcaggtattttaaatttgcatagatgttatggtattattctgttttttatctcccatga

SEQ ID NO: 20980 - DNA, 601 bp, Human
tatgtatgttgttggtatgcaggtattttaaatttgcatagatgttatggtattattctgttttttatctcccatgacacaatgtttttaagatttatccttgttgctatgtatacatgttatttgttacacctgattgccaccaacccattttactgctcattaccctaagtaaatggatatgtagattgtatccaactctctgctgctgcagcaaagctgggttgaacttctatgtgagtaagaatttcttgggtatttgtagctaggagcaaaattagtaattatttatttatttttgtttttttttaaagagacagagtgtcaccctgttgcccaggctgagtgcagtggccatatcatagctcactgcagcctcaaacttttaggctcaagtgatcctcccaccttagcctcctgaggagctgggtgcacacgccaccatgcctggctaattatttatttatgaaacagggtcttgctttgtcacccaggctggagtgcagtggcacaatcttggctccctgcaacctctgccttctgggctcaagtgatcttcccacctcagcctccggagtagctgggaccacaggtgcatgct

SEQ ID NO: 20981 - DNA, 601 bp, Human
caggatggtttcgatctcctgaccttgtgatccgcccacctcggcctcccaaagtgctgggattacaggcatgagccaccgcgcccggccttgcctggctaattttttgtatttttttagggacgtggtttcaccatgttgctcaggctggtctcgaaattctgggctcaagcagtctgtctaccttggcctcccaaagtgctgggagccaccgtgccaggctctaaattctaaatcttatcctagagataatcttggttaacaattcggagtaaatttttccaaactttattctctgcawttataaatatatacacatacagaacacagctttaagtttaagtgaagtctcaaggacttgctgtttcataactgcaaacttacactgaaggaggcctgaggggacctcaggaaactttaggagtaagcagtagggcttgtctaccttcttctaagacattggcactgataatcaaaccaggcttcacagccctgtctctacctcagttactgtagagttctctgtctccagttgtttgttatattttagactttcatgcagtcactattcagtacattgccaaattctgatctaggtctt

SEQ ID NO: 20982 - DNA, 601 bp, Human
gtacattgccaaattctgatctaggtcttcttctgtcattcctatgtgtttctgccataccctgtagaactcctctgtgagcaggaaactctcttgtatcatcaacttcttagaatattcgccgtcttgccttatctgaaactgggcagtttcctgagtttactaccttctccataaccttcttaagtgacatggcaacttttttcctttatatcctacatactttagcaccaggaaatgggtgggcgttgttcttgctctctgttgtctcatccagaccattaatactcccttctccagytgaatgctttgaggttcatgtctctaacctttcctattgatgtaatcaccgtctcattcattgacgattggagttcgtagattataaccttcctcttatgctctttgtctgttagcactcttagtgattttgatacctgtgtggatgagtcatccaaaaccttaacctcttacctccttaacctctttgtctcctgtgaacatttcttaactcttccctgattacaggctagaccctgatctttgtcattactagaactacagcacttttgaaatcttgatgttgagcattctcttctac

SEQ ID NO: 20983 - DNA, 601 bp, Human
caggtgcagtggctcacgcctgtaatcccagcactttgggaggccgaggctgttggattacctgaggtcaggagttcaagaccagcctgactaacatggtgaaaccccatctctactaaacatacaaaattagccaggtgttggtggctcatgcctgtaatcccagctgctcaggaggctgaggcaggagaatcgcttgaacccgggaggcagaggttgcagtgagccgagatcgtgccattgcactctagcctgggcaataagagtgaaactccatcagaaaaaaaaaaaaaaaaaaaaagagagagaaagaaagaaagaaccattgctttcctgcttttctctcttgtatttaaaacgaaaaaaaaaagtggctgccactcggcctaaaattgctttttctctttgcatgctacctaccacatcatctcatatgtaccattgtaggctttcaggaaatgtcttaagtaggtgagttggtgagtggtctttgctagaaagtgcaaacttcttactttgaatccgttatttctaatgggttaacatagaacaacagagaataaatgcaggcaactgataaatgtcaggaaggggccaggga

SEQ ID NO: 20984 - DNA, 601 bp, Human
ctagtttttaggtaaaaaatggtcacatatcatcattattgtatgattcattctaatgctaacctgagctcagttctagtttggttttggtgcttaaagactgagttggaaaatcccattacttggatagtaatggtcgcttttttttttttttttttggcactcagtaagtgatggctgaaccttttatggtaggatctgtaattttaatatgttctgatttagggtttgaggagaaggcagtctctaattttttttttccttatttgaatcagcatattgagaagagtatagcaaagargaagaatcattttcctagatctagccatctatttgttttaaaaaaaatttaatttggtagattttaaaagacactggtgggattatctttttaaaaggaagcttaagataagtgtcattagtgattaatattttttttttaaattaggtctctcttgatcttggatgatgtttgggactcttgggtgttgaaagcttttgacagtcagtgtcagattcttcttacaaccagagacaagagtgttacagattcagtaatgggtaaggattattcgtttactttttagtacctttatattta

SEQ ID NO: 20985 - DNA, 601 bp, Human
tgtatgattcattctaatgctaacctgagctcagttctagtttggttttggtgcttaaagactgagttggaaaatcccattacttggatagtaatggtcgcttttttttttttttttttggcactcagtaagtgatggctgaaccttttatggtaggatctgtaattttaatatgttctgatttagggtttgaggagaaggcagtctctaattttttttttccttatttgaatcagcatattgagaagagtatagcaaagaggaagaatcattttcctagatctagccatctatttgtttwaaaaaaaatttaatttggtagattttaaaagacactggtgggattatctttttaaaaggaagcttaagataagtgtcattagtgattaatattttttttttaaattaggtctctcttgatcttggatgatgtttgggactcttgggtgttgaaagcttttgacagtcagtgtcagattcttcttacaaccagagacaagagtgttacagattcagtaatgggtaaggattattcgtttactttttagtacctttatatttaatttaattacatttaaatatgtgacataccaaattactt

SEQ ID NO: 20986 - DNA, 601 bp, Human
aacaagctcatagtattataaaagaatgtaaaggtatggttatttatttgtttatgaggagattatagggagttatataatttcccttttgttaattgagctaatgaatatggtaatttagcacatgaacatccaaaaacttttctgggagatttagtattttaggttctctgatatcttaaatggatacatgatattatggtatttatttattcattaaaataatatttaccatctacccacagtgtgttagagaccacattagtgagagaagtgagacacagatgtgacctctgctgtyagagttaaaaatagagtgagaatcagattttaaaacttgtttttgcttgggattttataaaaatagtgttctaatttggtaagtaaaaactggtgtcttaatttgcatttttttttagcgaagttaaactttttacttgtttattgaatacgttttaagaagttatccttgactttaagaaattatccttgactcacttttcttttttgatataagtatttttaatttatttctaaatactcaaaaaatagaaactattagctctttgtcatatttttacaagtattatttcccagtaaa

SEQ ID NO: 20987 - DNA, 601 bp, Human
gagttatataatttcccttttgttaattgagctaatgaatatggtaatttagcacatgaacatccaaaaacttttctgggagatttagtattttaggttctctgatatcttaaatggatacatgatattatggtatttatttattcattaaaataatatttaccatctacccacagtgtgttagagaccacattagtgagagaagtgagacacagatgtgacctctgctgttagagttaaaaatagagtgagaatcagattttaaaacttgtttttgcttgggattttataaaaatagtgytctaatttggtaagtaaaaactggtgtcttaatttgcatttttttttagcgaagttaaactttttacttgtttattgaatacgttttaagaagttatccttgactttaagaaattatccttgactcacttttcttttttgatataagtatttttaatttatttctaaatactcaaaaaatagaaactattagctctttgtcatatttttacaagtattatttcccagtaaaacaattttttaacttaaaatttatatatagaatctcgctgtgttgcccaggctggtcttgaactacttg

SEQ ID NO: 20988 - DNA, 601 bp, Human
aatttggttttgtgtgatgtttttcctgactagattgaagttatagatatttggcaagaataccaatgatgttgtatctttctcagtggcgtcataggctgagagtacttggtggtttttaaaaaattttttgtagagatagtgttttgccatgttgcccaggctgttcttgaactcctgggctcaagtgatccacctgtcttggcctcccaaagtgctgagattgtaggtatgagccactattcccagactcctggtgttgatatgttttattatgggtgatgttaatgttgataatttrtttaaagtggtatctgccaggtttctgcactgtaaagtcattattttgtggggagattctctgtatatatatatgtatttttttttttttgagacagggtcttactgtgttgcccaggctggcatgcagtggctcactgcaatcttaaactcctgggctcggttggtcctgagtagctaattcccgagtagttgggtctgcaggcatatgccaccacacctgactgattttttttattttttattttttgtaaaaaaattaaatatacggatatctctctatgttgcccaggctagtctc

SEQ ID NO: 20989 - DNA, 601 bp, Human
gtggcacaatctcagctcattacaccctcacctcctgggctcaagtgatcctcccacttcagccccccatgtagctgggactataggcacatgccaccatgcctggctaatatttttgtatttttggtggagatggggtttcactatgttgctcaggctggtctcaaactcctgagcttgacgtgagctcaagtgatccactcgcttcagcctcccaaagtgttaggagtacaggcatgagccaccgcggctggctgaagatttgaatttttatgtagttaaatttaccactgttgttgtygtcgttgtttggtattttgctttgctgtcctgttcataaacatgtattgttttattagtataattttttattagtaaaaatgggattatagcttgcataattatttttgtttttacctgtagtgattagaaaaggtaccttagtaactagtaaatgaaccacctcagaattaatcctcttcttactagtagctttcctttttgggcagtatggatttgttttgtaagctttgagaggaaatggatagtggaaaagtatattcattgattcaataaatatttattgagtgcttgttatgta

SEQ ID NO: 20990 - DNA, 601 bp, Human
gtgtatattggaatgatggtattccaataaatacttgtgccctaatttacttaaccaaactctagttatcgaacatttaggttttcagtttttttggtccttatgatgtaatgagcattcttgtttatctttgtacctatgttgtttccttggcaaattccgagaagtagaattactgagccaatgcatctttttaaagcttttgacatgtatgatagtgtggcaggattcagtttctctttagccttttttctgactttaaaggtaatggttgattttcattggaaaaacagaaaaaaamgatgaaaaggaaaacagagatcacaaccattactaatgctcttgtgtatagttttctagatcattttgctgcttctataaacatacttgtctcttaaaaccaaatgggatcataatagaaatagtctcatatattgctttttaccatttaattacattgaatggtcatcttttcatgtcatttatatagagtgacatgatttttaaagctgcatattatttcattgtatagctacattatgaatggccagttggttgatggacaattagattgtttaagcatattcatctggttattttc

SEQ ID NO: 20991 - DNA, 601 bp, Human
tgccagactgctctccagaagggtaccctgttttacatgcctaccaacagtggttgaaagtgttcatttcctctgattctagctaatcacctcctctcctctcctccctcccttcccctcccctcccctcttcctgccctcccctcttcctgccctcccctcttcctgcccttgccctttctttgacaggatctcaccaggatgtcactctgttgcccaggctggagtatagtggcatgatttcagctgaaatcactgcaaccgccacttcctgggctcaggtgatccttccacctcagcytcctgagtagctgggagcacgggtgtgcaccaccacacccggctaatttttgtatgttttgtagagttgaggtttcactgtgttgcccaggctgatcttgacccctgggctcgagtaatccaccctcttcagcctctcaaagtgctgggattacaggtgtgagccactgtgctcagccccagctaatattcttgttactcctttagtcttcagaaatctgatactttaaaaatggtaaatttttcttgttctcctttgattaccggtgagattttggccatctgtgctttttgttttgtg

SEQ ID NO: 20992 - DNA, 601 bp, Human
ttcatgtgacttgctgaatgggatttaaaccttggatcttgtggctgggcatggtggctcatgcctggaatcccagcaatttgggaggccgaggcgggcggatcacctgaggtcaggagtttgagaccagcctggtcaacatggtgaaacccatctttactaaaaatacaaaaattagctggatgtggtgaattgtttgaacctgggaggcagagactgcagtgagccgagattgtgccactgcactccagcctgggcaacaaagtgaagctctgtctcaaaaaacaaaaaaaaaaaaaamaaaaaaaaaaccttgggtctgcctggctttattttgcatgctctttccatatgtcatgcttcccttacagcttgaaataataaatatgagtggctctcttttcatatgtataatttatatctaaatagaagtccaggttggtatctgtgatctttatggcattaggccctctttccaaataagtcagactactgtaggtgattttcttgattcagtttagttcaagaagcgtttgagtttctgtactgtgctaagcactagcatttgagtttctctactgtgctaagcactgttactaga

SEQ ID NO: 20993 - DNA, 601 bp, Human
tgtgacttgctgaatgggatttaaaccttggatcttgtggctgggcatggtggctcatgcctggaatcccagcaatttgggaggccgaggcgggcggatcacctgaggtcaggagtttgagaccagcctggtcaacatggtgaaacccatctttactaaaaatacaaaaattagctggatgtggtgaattgtttgaacctgggaggcagagactgcagtgagccgagattgtgccactgcactccagcctgggcaacaaagtgaagctctgtctcaaaaaacaaaaaaaaaaaaaacaaamaaaaaaccttgggtctgcctggctttattttgcatgctctttccatatgtcatgcttcccttacagcttgaaataataaatatgagtggctctcttttcatatgtataatttatatctaaatagaagtccaggttggtatctgtgatctttatggcattaggccctctttccaaataagtcagactactgtaggtgattttcttgattcagtttagttcaagaagcgtttgagtttctgtactgtgctaagcactagcatttgagtttctctactgtgctaagcactgttactagatgtg

SEQ ID NO: 20994 - DNA, 601 bp, Human
catgcttcccttacagcttgaaataataaatatgagtggctctcttttcatatgtataatttatatctaaatagaagtccaggttggtatctgtgatctttatggcattaggccctctttccaaataagtcagactactgtaggtgattttcttgattcagtttagttcaagaagcgtttgagtttctgtactgtgctaagcactagcatttgagtttctctactgtgctaagcactgttactagatgtgaggtctttcccctaaggagttcaaaatctcgtagtgaagaaaggagtttargcaaataattacaatataatgcaatgagtataacaacagaactatgtataagtagagatagaactgataagtatttggcttggaaaaatgaggaattcaagggagggttccatgaaggagagaatggtatctgagagaattaaaattttttttttaagttaaaatgtttaatttttgttggttttatttatttatttattttgagacaggacctcactttgtcatttaggttgagtgcagtggtatgatcactgctcactgtagccttgacctcttgggctcaagcaaccctcctgcttc

SEQ ID NO: 20995 - DNA, 601 bp, Human
tttatttttttgtagagataaggtctcactatgttgcccaagctgatctcaaattcctggacacaattgatcctccttccttgacttcccaaagttcttggattacaggcatgagccaccacacccagcaggttttattttaaataatacattcctgattaagacaaaaaacaatagtaataggatgtaagatgaaaagtcaaagactagccatttccctcctaccttcccactttccagagttgaccattccttaatactttcttgtgaagtggaggtctctctctctctctctctctccgagaagcagccccctaacttactgaagctagattagatctgtctgtattcgagagaactgtttgccccatatcataggatttgtcacactttatagtgattatctgtttacttggttttctctcatactagtccatgtgttctgaagtatagaatagtttggaggttaaaataacataccctggctctagactgcctgggtttgaatcccagctctgctattgattagttgtgtatcataaggggaaagttatttaacttcctttgcctaatggtagtattttatagcattgttgtgagg

SEQ ID NO: 20996 - DNA, 601 bp, Human
gaggaattgagtagatagatcaagcagacataaagaacattttaaaatctaatcctcttaactttgctagaacttatctgttcttctagttgtcatcactctagttcttatattatacagtcgaccctccatatccgtggttctatatccatagattcaaccaacctggattgaaaatattagaaaagaagtagatggttatgtttgtattgaacatgtacagactcttttcttgttattatttcctaaacacgatggtattacaactgtttacatagcatttacattgtactaggtattytgagtaatctatagatgatttagggtatacaggaggatgtggtgggttacatgcaaatcctataccattttatgtaagagacttgagcatccatggattttggtatctgtagtgggtcctagaaccaatccctcatcaatactgaggaacaactgtacttgtttgttttatcacttctactaaagtgtaatactttgtaggcaggatctaaatatgatttacctttgtgttcacttttatcacttgatctgtcttgtgtgtggttaagttttttgaagaatgatagtagtggcaccttta

SEQ ID NO: 20997 - DNA, 601 bp, Human
gcctcccaagtagctgggattacaggcacgtgccaccacacccagctaatttttatctttagtagagacggtgtttcgccatgttggccaggctggtcttgaactcctgacctcaggtgatccacccaccttggcctcccaaagtgctaggattacaggcatgagccactgcgcctggctgagaagagcagctttaaagtacatcataataatggtgggtgtttccttcagttaggaaatgagcattttgctatgatttttattttaaaaaagagatggagaatttttgaaggtatccttrtataatgatttatctgcacatgtatcattattaatgtatcaaaggaaaatggaaagtgacatgttgattaactagatttgattaatttgattaattagatttcttccaactcagtgacatttgtaacacgtgacaggttgcttgataaagggtaacatttctcttacaaatgctacttttgttattttttttcttttggtgatctgtgctgtcatttgcatgttagtaatctgattttaagaattttgtattttggggaacataaccatgttaaaagacagtttattttagtactgaaag

SEQ ID NO: 20998 - DNA, 601 bp, Human
gagaagagcagctttaaagtacatcataataatggtgggtgtttccttcagttaggaaatgagcattttgctatgatttttattttaaaaaagagatggagaatttttgaaggtatccttatataatgatttatctgcacatgtatcattattaatgtatcaaaggaaaatggaaagtgacatgttgattaactagatttgattaatttgattaattagatttcttccaactcagtgacatttgtaacacgtgacaggttgcttgataaagggtaacatttctcttacaaatgctactttygttattttttttcttttggtgatctgtgctgtcatttgcatgttagtaatctgattttaagaattttgtattttggggaacataaccatgttaaaagacagtttattttagtactgaaagaaaatagttacttttactctcatttatttaatttctgttcattttttccctgtatttagaaacaaaaaaaacatcacgaatctttcccgcttagttgtccgcccccacacagatgctgtttaccatgcctgcttttctgaggatggtcagagaatagcttcttgtggagctgataaaacc

SEQ ID NO: 20999 - DNA, 601 bp, Human
actttattactaattttattaatcttggcttttgagttccagagagaatgcatattaaatgaaatgttttatttgattgttaagaatttgccaaaatagtctcaagagctgaagctgtgctctgacacttctttttgatggcagcggcgggctgcctggagtggctgctgccatcatgctggctgcagcagggaggcgcagctggggctgcatgctctgtggagctggcggtagctggggacaagcaggaaccctaccccttctgaattggggcaggagctcctggttcctgctgtagccrcccaagccacagctgtggacctgggaacccgctccatggagcaggccagagccctgccctcctgggtgtagctgtagccgcccaaaccacagctgcaggctcgggcctccggctccacagagcaggcaggaccccttccccctggtgcagctgtagctgcccaagcggtggctgcagactcaggcatccctgtactcttgggggacctggaaggaccccctgcccttgtaggcttggaagtgcctgctcccgctgcctgacttctccctactgttggcacccactctgatcttagagcaa

SEQ ID NO: 21000 - DNA, 601 bp, Human
tggactcgtggcttaaccaacagttaattcactctgtagtgtctactctgactctgagtcagacttggaggtggccactgagggcagttctaaagtcagagctacatggagtaaaaggaaataataatgagtttctgttttctaagccagaggtagaaatacctattaaagaactttaaaataagataaactctctggacctctggggattctaatcagtgctttgataacatacaaaggaaatgccaaaggacattagtacctctaaaaagtcaaaatcccagtgaaggttcattaggtratttatttcttttgtttgttgttatatggcatagactgcttagttgtcttacatagtaactagaatgatgattaatttttttgtttttttttttttttttttgagacggagtctcgctctttcgcccaggttgaactgcagtggcgctatctcggctcactgcaagctccgactcccgggttcatgccattctcctgcctcagcctcccgagtagctgggactacaggcggccgccaccgcgcctggctaattttttgtatttttagtagagacggggtttcaccatgttagccaggatg

SEQ ID NO: 21001 - DNA, 601 bp, Human
gcagttctaaagtcagagctacatggagtaaaaggaaataataatgagtttctgttttctaagccagaggtagaaatacctattaaagaactttaaaataagataaactctctggacctctggggattctaatcagtgctttgataacatacaaaggaaatgccaaaggacattagtacctctaaaaagtcaaaatcccagtgaaggttcattaggtaatttatttcttttgtttgttgttatatggcatagactgcttagttgtcttacatagtaactagaatgatgattaatttttttktttttttttttttttttttgagacggagtctcgctctttcgcccaggttgaactgcagtggcgctatctcggctcactgcaagctccgactcccgggttcatgccattctcctgcctcagcctcccgagtagctgggactacaggcggccgccaccgcgcctggctaattttttgtatttttagtagagacggggtttcaccatgttagccaggatggtgttgatctcctgacctcgtgatctgcccgcctcggcctcccaaagtgctgggattacaggcgtgagccaccgcgcccggcc

SEQ ID NO: 21002 - DNA, 601 bp, Human
agagacggggtttcaccatgttagccaggatggtgttgatctcctgacctcgtgatctgcccgcctcggcctcccaaagtgctgggattacaggcgtgagccaccgcgcccggcctgatgattactttttactgaaaactgaacactataagaggctataaatactacacactttgtcatattacattatcaatttcctgctacagcttgcagggttaagtgtcgatcccgtttacagaagaggacgcagattcagagatgaagtctcttgctcaagcttacattaaactgggaacagtartagggttgaaagctgggtttctctcagactataaaacctttattttttttaactaagcaatctgcctttacttatttatatggtaccttgaagtccatagaacacttgtcatgttcattatctcatttgatatcttaaattgtgtgggagaggtatagatatccccattttacagaagagggaactgagatgcaggtaagttagggatttgtgacacacaagtcataagtggtagagccagctcttgggctcaacccttctgaccagaaatctattatgctaacctctttaaagcacttc

SEQ ID NO: 21003 - DNA, 601 bp, Human
aatttcctgctacagcttgcagggttaagtgtcgatcccgtttacagaagaggacgcagattcagagatgaagtctcttgctcaagcttacattaaactgggaacagtaatagggttgaaagctgggtttctctcagactataaaacctttattttttttaactaagcaatctgcctttacttatttatatggtaccttgaagtccatagaacacttgtcatgttcattatctcatttgatatcttaaattgtgtgggagaggtatagatatccccattttacagaagagggaactgagaygcaggtaagttagggatttgtgacacacaagtcataagtggtagagccagctcttgggctcaacccttctgaccagaaatctattatgctaacctctttaaagcacttctctgcctgctttcattcatataaacatgtgaaatcttgcccttaagaaatgtcatgtgttcatgacactctagttatgctataggtacatatatgtatatttgcaaataattttttttaaacattaaggcaaaatattgccatattttagaaaggggagaggtttcattagcatcttgtccaactaggaaa

SEQ ID NO: 21004 - DNA, 601 bp, Human
aattttagagaagcctttatttgactcattttggcttacatgctcatagctagggtaaccccagtggacagtaggatggaatccttggattgtccaagggtcacaagtttagttatatggaagtgggacaaatgagtgaggtcaactctacttgaatcgtaagtagagcttaattcaaaagagagttctgttatcacagagaggagggagaaaaggtgctggtaggaaagataaccaaaaacagaaattcattccacatatgctttgtaatgtttgattgtatctttttttcctcttaagkggataaagatagctagattaccttttctggaatcccagaaagatctgctaactttttttgaattgttttttggtttgatttcaaacctttcttccttgataccataccatctttgcaattgaacatgatatttttgagaggggtagtaaaagacatttcagtttggaaaacttcatagactctatgttttgacatttaaataaattattagaaaaattatctttagaaagtactgaaacagttattgaaaattgccgtctccatccccctgttcaggaagctaaatttttatttatttat

SEQ ID NO: 21005 - DNA, 601 bp, Human
catcaatgactgaacaagatagtgaaatttttataaagtaaatgaggaaaatatgaaaaaagtaaataagaaaattctttgcttttcttccccacatctaatagtagctggtatttgtggtattcagagtgccctcacatataatttcttttgatataagtattcaagaagcagcgggttacagtagccctatgataataatgaggcaactgaggttcagagcagccaaatgatttgtctaaagttacattgtgattaggagaaccagatcttctgatttatggctcacttacattctcakctaatagtgatttcaaaagacttgaatgagggatattactgttttaaagagcataattgaaatataaaatatggttatataagaactcactgagggatcatgtatatgattgttattgatttagtgctacaatccttggatgttggttgcttatgagtttgtacccctttagcaggaaactaagaggaaaaatacctccctttaagtttgttaaaatctataagaacagaaaagaaaccactgcataagcaagacttgaagattaaaacttttttattgtgataaaatgcatataatgta

SEQ ID NO: 21006 - DNA, 601 bp, Human
ctatatatttccaaaactttttcatcaccctaaacagaaactttgtaaccatgaagtaataactcctctttcccctctcttgctagacctttgtaatctctaatgtaatctgcgaatttgcctaggtatttcatataaatggaatcatataatatcggtccttttgtgtctgactcatttcattgagcatgttttcaaggttcattcatgttgtagcatgtatcagaactgtatttcttcttatggctgaataatattccattgtatgtatatatcacattttttctttgttttttttttycttacaaaccagtgtttattttcacatacagccttgttgtaaccaatgtacagatcaaaactcaaaatattcctcttcagaaaactttgaaccttatcccctagccgacctataatggttgaatttctgtcaagtatatatttatgtatataatgggcttaattatttaagagaataactgagtgatttgtgtgatctgtgaaaaggaattggactatcatacttgggttgtatatcacatttttttcatccattcatctgttgatggacacttggtttgtttccaccttttggctactg

SEQ ID NO: 21007 - DNA, 601 bp, Human
cttatcccctagccgacctataatggttgaatttctgtcaagtatatatttatgtatataatgggcttaattatttaagagaataactgagtgatttgtgtgatctgtgaaaaggaattggactatcatacttgggttgtatatcacatttttttcatccattcatctgttgatggacacttggtttgtttccaccttttggctactgtgaataatgctgcagcattggtgtacaagtatctatttgagccttgtgtgtttacctaggagtggaattactgggtcatatggtaattctttrtttatttagttttctgaggaaccactagatttttccacagcagctgcaccgttttacattccactagcaatgtacaagggttccaatttctccacatccttgataaaacttgttattgttcatttttaaaattatagccatcctagtaggtgtgaagtggtttctccttgtggtttgatttgtgttttcccaattaccaatgatgttgaacaaaagataatttttgaaaagattttaagagacctgttctagtgagaggaagataattttatattgcatgaaatgccttgttttaaaaat

SEQ ID NO: 21008 - DNA, 601 bp, Human
tcttaaacagtgtaggcacagactcttttcttcttaaaaaaggtggtgagaaatgagtccagttcagatttcttagatcattgagtaggataagataggatgttcattgccaggcactaatgaataaaataactcatataaattacttttttatgattttgtacttacctgttaaattttatgttcagaatgtatacctagctggccctggaagaattccacccagtgaagtgctatattagttttttcataaagtagtgaattatttttttccttcaaagatggattagtgctttttttktttgttttttaatagaaatgggggtctcactgtgttgcccaggctggtcttgaactcttggcctcaagcaatactcccccagccttggcctcccaaaatgctgggattacaggtgtatcaccttgcctggccaaagatagattagtttttccaggctttcttagtcttcattccttaggttggttttaccaccaggtagtttgaaaccccttcagatcacagttccaagaagatgggtatgggccttttggaaaatagagaaattcactgggttcacaggctcctcatcaagggagccat

SEQ ID NO: 21009 - DNA, 601 bp, Human
tagttgatttacgttctggtacaaacttctttttgtttttttgagacggagtctcgctctgtcgcccaggctggagtgcaatggcactatcttggctcactgcaacctccacctcccaggttcaagcaattctcctgtctcagcctcctgagtagctgggaccacaggtgcacaccaccatgcccagccaagttttgtatttttagtagaaatagggtttcaccatgttggtcagacgtcttgaactcctgacctcaggtgatctacccgccttggcctcccaaagtgctgggattacagrtgtgagcccctgcgcctggcccaaacttcttaccttgtggattggtatcaaacagtttgataaccagcaggaggtctttatctttgagtaacactgggttaagcaacctgcctgaagttacaactttaggtagaactagaattcatactgaggaattttggctctggagcccataactcttaatactaactgcatcttactatagattgtgttagtaaatatttatttttggattataatctaatattgaaacctttctagcatcataggtattttatgtgaaacatagtttgtctctcg

SEQ ID NO: 21010 - DNA, 601 bp, Human
ctgttcatttacacacacctttgttcagtaaatatttattgaatgcttattttggtccttgaggaggaaagggttgtatagtacaattgaaagaactgtattgcttagggatccaaacagcactactctagtctgttctccttctgccacccaacaaagagtgggacacgtgagaggaaggcatttctcaactagctgaagagagaaggagtcccaaagatccattggcagaggaatggtattcaggagctcggagtggtggtaacagatgccctaagagcagatgccctaaggagcactrgaattcaagagcaggttggcatcactgtgctggtggctaaataaggtgtcgttgcattgacagagatgtcctggaagtggtgatagcgttgtagatagtggcagcaagagaaagcagatgcctcatggaagattaaaacacaagaggctatctatatgttggtcagcccaagcagaacagcagagtatggaccattgaaggaagtgtcagcatgtggagctgacagcatgtcactgtgacttgtggctgagagaggtggtaagagcaagcagccagataagaagggcaggaggtggcatg

SEQ ID NO: 21011 - DNA, 601 bp, Human
aagggttgtatagtacaattgaaagaactgtattgcttagggatccaaacagcactactctagtctgttctccttctgccacccaacaaagagtgggacacgtgagaggaaggcatttctcaactagctgaagagagaaggagtcccaaagatccattggcagaggaatggtattcaggagctcggagtggtggtaacagatgccctaagagcagatgccctaaggagcactggaattcaagagcaggttggcatcactgtgctggtggctaaataaggtgtcgttgcattgacagagatrtcctggaagtggtgatagcgttgtagatagtggcagcaagagaaagcagatgcctcatggaagattaaaacacaagaggctatctatatgttggtcagcccaagcagaacagcagagtatggaccattgaaggaagtgtcagcatgtggagctgacagcatgtcactgtgacttgtggctgagagaggtggtaagagcaagcagccagataagaagggcaggaggtggcatggcttttatgtgaactggtgggacattctcccttgccctgaggattccctgagacataggattgagaag

SEQ ID NO: 21012 - DNA, 601 bp, Human
cagtttctctctgttgcctaggctggagtgcagtggcacgatcttggctcgctgcaacctccacctcctgggttcaagagattctcatgcctgagcctcctgagtagctgggactacatgtgtgctaccacgcatggctaatttttgtaattttagtagagacaggcttgtgccatgttggcctggctggtcttgaacacctgacctcaagtgatccacccacctcggcctcccaaagagctgggattataggtgtgagccaccgtgcccggcctaagggtttttttttttttttttttgkatttttagtagagatgaaactattttctcatagtatatttagggcctttcattagctcttgaagagcacgaatacagcttgagttaactttttccatatgggttttagaagtgctttattaacttctagggaaaggttttggcagtgataacatagtcttatgccatcttttcgtttgatttttcttgatttgcttattgaaagatagggagcatgaatgtgtgtgagagagtgaaatgagatagtgatgtcaagctagagaggagagagaggagcagaatagagaagacgagagtaata

SEQ ID NO: 21013 - DNA, 601 bp, Human
cagtgataacatagtcttatgccatcttttcgtttgatttttcttgatttgcttattgaaagatagggagcatgaatgtgtgtgagagagtgaaatgagatagtgatgtcaagctagagaggagagagaggagcagaatagagaagacgagagtaatagagcacatgtgtggaaggtctgagaggaagcagacaattgagacagatggacagagggtaggacagagtttaatgagttgtcattcaaaaaatttttttttgtagagatgggggcatctcactatgttgaccacgctggtctygaactcctggcctcaagtgctcctcctgcctcagcctcccagaatgctgggattacaggcaagagctgccatgccccactcaaaccttaacaagttgtaaagctgtagagctcagcttggtgtagtggagagaatagtgacttttcactaaggagacctaggtgtaagttcagacttctttatcaactagttctatgatgttgaataaattgtatcacgtctttgagcctcagtttgtaaaggtccttttcatctttacagtctctgagctagttacagggtcaaagtagaatccaaatt

SEQ ID NO: 21014 - DNA, 601 bp, Human
atttaagcattggtacagattatgaaattaggtaatctttgttcaagcattgtaaatccagctacacaaattatgcttatgagttcttctccattgtcctcactgccccagctccaagaaaaagaatcttaatttacactgttttgtgagtgatttggaggatataagccccattttaatttgtctttttatgtctgtctcagtcttgtttgaccaacagctttgaaatgtagcagaaaagtatattttaacaaatgatagccctattaaaagtgggctttgtgaagaaatggtgtggagstagctgtgggattacaaatcagatagatgtgtctcaggtggcgggcgcagcagctgctttttaaaccttgtaatgcttgttttattttatgaaaatgtatttgaaccaccaaagtggattgaaatgaaagtgtgaagtgctaaatgcagctgctaagactaggatatggcttgttgttcccctgagagctcttgttggttattttctgtgttttattttatttttttcaattgaagcctctgttctgacgaacaaaaactgctcttacagcctaataactgattttgcctcatttttcat

SEQ ID NO: 21015 - DNA, 601 bp, Human
gtttagatccttcctgttactatgatcactgtgtactaagggtactgtgaatgcattttttgccttaacgcaatttaggaaaatttgacctttgggtgtagttggaaattattttacactaaaactttgaagacattgctccattttcttccaagttccaaagttcacgttgaaaagtctgaagccattttgctgcctaatctttctctctggaagattttaggatcttcattttatccccagaatcttgaaatttcctgatgatacactgtgttgttagtttttattcattgttttggayattcagtcttccttttcaatttggaaacctatgatttttaattcatggaagttgaattatttctttgattctttcctttttgttccagtttgctttctctttttgtaacacccattattcagatgttagatctcccggactgataatctagttttctttttccacatttcatctttctatagtgtgctttatgtttttttctttatttttttttgagatggagtctcactctgtcacccaggctggagtgcagtggcgcgatcttggctcactgtaacctctgcctcctgggttcaggca

SEQ ID NO: 21016 - DNA, 601 bp, Human
agttttctttttccacatttcatctttctatagtgtgctttatgtttttttctttatttttttttgagatggagtctcactctgtcacccaggctggagtgcagtggcgcgatcttggctcactgtaacctctgcctcctgggttcaggcaattctcctggctcagcctcctgagtagctgggattacagccgtatgccaccatgccaagctaattttttgtattttttttagtagagatgagattccaccatgctggccaggctggtcttgaactcctgaccttgtgatccgcccgcctyggcctcccaaagtgctgggattacaggcatgagcccccgcacctggcctactgtgctctatttttggggagttttcctcagttttgccttccagccattttattgagtttttcatttctactagtatatttctaatgtgttaaattcttattttgtagatagaatattttatctctctgaggagatatacacacagacaggtaaatatatataatatatatatagaaattatatacacacacacacacatataatttttttttgtttttttttgagacggagtttcactcttgttgccta

SEQ ID NO: 21017 - DNA, 601 bp, Human
ttctttttgagacagtcttgctctattgcctaggccggagtgcagtggtgcaatctcggctcactgaaacctccacctccgaggttcaagtgattcttctgcttcagcctcctgagtagctgggattacaggcacctgccatcacatgcagctaatttttttgtatttttagtagagacaaggtttcacgatgttggccaggctggtcttgaactcctgatctcaagtgatctcaccttggcctcccaaagtgctgggattacaggtgtgagccaccgtgcccggccttcttttttatgtraaatcaagtttcctaaactccttggaggagtggggaagtccagcatttctagcttcacagctctgcagctcgttctcttattttcacgaggcattaaaaatatggccttactgggcgcagcggctcacacctttaatcccagcactttgggagtctgaggtgggaggattgcttgaggcaggagttagagaccagcctgggcaacatagcgagaccccatctctgcaaaacaaaataatttagccaggtgtggtagtgcatgcctataatcccagctactcaggaggctgaggttggagg

SEQ ID NO: 21018 - DNA, 601 bp, Human
aaagttaaattcataaggtttttatgaccagcttgacgatttcaggtattctcagctagggggaagaataatttctagagatatttttagaaaaggagttagattatatttagaaatatgagttaagtagttgtgtttcttcctctttttctgttctactcagaatactttttacatttacagtgttttaaatgtaacaaaactctatagatattttcgagaaatgactggttgggttttgttttcattttttaaggtttttgtaaatgattaagtggaggtttgttttaattatctttgyatccccaaagcctggaatccagtaagggttctgtaaatctttgctgagctgaagttattgccaaaatttgaagaatcagctcacctgattatagcccttaggattgtgaacattgaggtctactttggtagtttttgatcctttaccttgaagtaaataaaggccaagtattacccatgcttacatgagccagtatataggactatgttagttcttgctggtatgaaaagtttccagccgggtgcggtggctcacgcctgtaatcccggcactttgggaggccgaggcgggcggatcacg

SEQ ID NO: 21019 - DNA, 601 bp, Human
tctcattgggttcttaaaatatgaaaattactaattcattctctttagaattactctcacttccagttcgtcttctaaagttctcttgcttgcatacaagaccccatgctcctgatatcctgcttctgtgaatgagcattctgaggcagaagatgagagatctgaaagccagggcttgttggggaggacgactgctaaatgtggtggaaaaagaagtaaaaaaaaggggaataagagatgtcatttattttaagattttgcctaggtctgattaaagatatttctgctgtttaacattggscaataaaaagctagactcagaatgttactcatgtgcatacctgtagttgtggctgctttttctttatctttttattcttttggagctggcctgttttcccatacctcagaattttagcttcatcaggcccacggggctgtttctttggataccttcccaaccttttttctcttctgtttcttctgcgtctcctatgctctagtcagatggactcatgagcaggtcccttttcacgtttccctgctcctatactttaactccaacatttattccctttgaagaacccttctcagtttgtga

SEQ ID NO: 21020 - DNA, 601 bp, Human
atgtaattaggataattttctcaggaaaatttaatcagatggtgagctcactggcatattgtgtgtttttttttttctatcttctggtataattaactgttctccaagcaactgaagaaaacaaattttatttaggaggaaaagtattttattttgcccctagtcaatttacataaccgcagcttctgtctgtaaaatgtggacaccacagtcttctctcttattcctctctgttttactgaaatgccatgtgagtaaaagactttagacaagagaatgtacactctctccacccctccartgagataggatcgggggaggattataacagacttatttctttgatattcaggtatggaattggcaattggacaaatgtatctttctacgaggccatcaggaaacagtgaaagactttagactcttgaaaaattcaagactgctttcttggtcatttgatggaacagtgaaggtaatttaaagtataaatttgttttttgaaaaagtattctcatattgcaatgattatattgagacagtcaaaagccactgtgaggctaattacttacttaaaaatttttaatttttctcatgcttgttt

SEQ ID NO: 21021 - DNA, 601 bp, Human
tgtctataactaatcaaatgcaacctctactgcatattgtaggcaataaaaatcattgaaaagcatttacatttaattatacactgacaatacaattttaatataattaatgtaatataattgacgtgtgtctaaaatcacattctggtgaatgatgctgcttggtgggggacctcaagtactctcttctctccttttttctccttctaccagtctttccaaactataaaccttggaattgtcagggctgtatcctgtcttttgtgctctgttgatgactctttagtgcatcttagagttrtcttctcctctttgtcaccaccctgaagagcatgctttcctcctcctccactggtgaactgtcccagcatcctgcctctggtctgcacctcttccactttatcttccataccactgcctgtgtcccttgttgaaacacctattacctaacggtttataggccaaccacttagctcctcaccatctttttctgctatattgtttcctctgtgccagcctactttccaacttcatctttttgtgcatgctgctaactttggtttgataaaccttctactcttttaccttgaagcattatgac

SEQ ID NO: 21022 - DNA, 601 bp, Human
gttgcatgctggaacttgggcatctcatgacagtttatgaattgccagatattagaatgtccatgtgattgaatttatggctgaatagcaatcaaggcagatgcttattttgagtgtttatagcattgctaaacaatcctaattgccttccagatctggagttttgatctccttttgccacttcatgaattgaggggccacaacggctgtgtgcgctgctctgccttctctgtggacagtaccctgctggcaacgggagatgacaatggagaaatcagggtaggctgtttgctgacatgaragcactgctcttcttgtagcttgggctagcactgttcacagtggggacctttgttcacgggccagggaagcatagtcctgaagttgtggttggatgaggcattctttttgtttcttgtgcacattgtattcacagctgcactccactgcagaaacggattcattttagagttagagtgaagcattccctgtatatgtgaggaagcaagtgctctagtcatttgtagttcattctctgccattagcttgagaatgattcatcttaattcttggacttgaaccaaaggtttttggtagcaga

SEQ ID NO: 21023 - DNA, 601 bp, Human
gttgcagtcctctgtggactgcctgcctgttaaacagtgcagaggttcacatttccgtcattgtggggcagcgaagggctcctaattgagtcacagtctgcatgctaggccagtttttattaccctgcagtgcttaagatatacatacaaaccatgccaattttatttagaaaacaatctattttttttagatatataattttgacttttagaaaacaatctttttaggaggcttagaatgttgttctctgtgtctgtggaaatatagtaccatatggaaagaattgcatgctgaaagatkagaaattatggaaaaggagtcagttgacctagttgtgtcagaagaattggggagccgattggaaaagtttgggtattgggatgactactttggtaaccagtgtagatgaggaagatggggttttccccctttcattacaaaggaggatctaaaactccaggaacaggtatatagtgcagaagactaggagagtatacagtttgcaggaacagaggtgttatcagatgggctttccagggaaattaagattcttcttcttgaggactaagtaaccaaccttctctctaccagtcacataaa

SEQ ID NO: 21024 - DNA, 601 bp, Human
ctcacgcctgtaatcctagcactttgggaggccaaggtgggcggatcacctgaggtcaggagtttgagaccagcctggccaacatggcgaaaccctatctctactaaaaatacaaaaaatagccgggcgtggtggcatatgcctgtaatcccagctacttgggaggctgaggcaggagaatcgcttgaacccgggaggtgaaggttgcagtgagccgagatcacaccattgcactgcagcctaggcaacaagagcaaaactctgtctcaaaaaagaaaataaataaataaataaataaatwaattaattaattaaaaaaataaataaaaaggaaaagaaaaaaaaaggcagttactattatccccattttgtagtgatgaaactgagatccacaagactgctttcctcagatcttggggaagctttggtgacagtggcagggatgccctcaatccagagctgtcatactgcctcatactaaacttggggcattagaatgactagcaagttgggtgtttaacttagttctgttttccatgtcattcacaattaactatgttggttgaaaatctttaaaaaaacatatttttgaaatttcttc

SEQ ID NO: 21025 - DNA, 601 bp, Human
gcagaataggtttacatagtatagatgttatgtctgaagggtgaaagaacttctagcctatgtatttagtttgtatatttaaatgacaatcaggctgcctttgccttctggtttgattactagcttattcaactgattatgatatagcccagcctgcatctacccagcatgttaatgagactatccaaaagcacagagcaaattaaaagtaaaaaggaacagctgctgtagtgtccaagaaaataggccttttgagcctgtttactttagaatccaagctgtataaattgagtgccagtaagataaagtaggtatccagaagcttaaaaagttcttaacttccaaattattcctatttataagtgaaaaaataatttagctgtttacctgcattatgccacagagtacatactgaatgacaagaaattcacattaattcatgtgcatgaagggaaagctgatctgaagtatggaatacatggtgataaatggtggtgtgccatgacttggtggcagcagagtgtaatggtcaggagagtgggcttttggccttgagataggctgcctgagttcaaagcctgcctctgccactcattagctt

SEQ ID NO: 21026 - DNA, 601 bp, Human
gatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtctkgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaacctgatctttcctaatcctcacttttttcttttt

SEQ ID NO: 21027 - DNA, 601 bp, Human
tagtagagaagggatttctccatgttggccacactggtctcaaactcctgacctcaagtgatccgcccgcctcggcctcccaaagtgctgggattacaggcatgagccaccgtgcctggctggatggttattaattttaatgttagcataaaagcatgtcttagcctgtgactatacattaatacacaaattactattaagtcccctacctgtccacacaagaactgagtcttccagagcatccgtcgattatttaggcaagtcctagtatactgtttcacaatctcttaggacaagttgytcatgtccttccatactaaacgtatccactatgttctctattgcccttcacaaaaactcttctgggcacatacattctcatctggctgttttgactgctatcatcattctgtcctagacaaaaagaaatgctgatctctcctttcccaagcatggaccagacctataagtcccttcaacacagctgaaaacagactgcaacttttaacaagctcttactggagacttaaggaaaacggaagggaattatatcacaaatgttgatttacagctgcaactagctgtgacctctcttagtgcc

SEQ ID NO: 21028 - DNA, 601 bp, Human
aacttgcaaaccagaatatagtctacaactttgaaatgagactttttctcagttactagcaattaaattttagaaatcttaagaacttcagagaatgcattatattaggttacgtataattacaaaaataaatcttagattgaaaaactagtatacttcaacaccaagtttgtatttttattttctaatatatccctactttgctaatagaaataatttaacaaaatatattaagttctaagtcttctacccctctcaccattacttttcattcctactctttaaattatagaactaaggyttgattgttcatttgttcaacagatatttatggagcattaactttgtgccagacactattctagctcctgacccttttctcatttattctcagagcttccattattttcaaaatatgtctttagccttgtctttttgactaagcatcatctttattttctggttgttgtttttgatttttgctgttttcttttttccattttttattctttcttaaatggttctttttatgagtcctatcacttgacaaagtcagtgtatctaaaatctaacaatcctctctcccaaaacaattcttcag

SEQ ID NO: 21029 - DNA, 601 bp, Human
taaatcaatagagaacattgtctttattttcttagtttttcactgaagaagcaaactgccttttattaaaaattctttcctctttctagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcrtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaatttt

SEQ ID NO: 21030 - DNA, 601 bp, Human
taaatggtatccagggtaagatatttaattgttcattgtacaggcaagttggatagcatgcagtgggagacttgaattactttttacctcaactatttttgccttcactatggcttgaaattcatgctaggtttataaaaatgagcaaggtttataagccttctctgatgaccaaaaacattcactgcttatgtgtgatatctataacattcagattatccctttttttttttgagacgaagtctcactctcttttgcaggctggagtgcagtggtgcaatcttggctcactgcaacctcygcctcccaggttcaagtgattcttgtgcctcagtctcctgagtagctgggattacaggcacccgccactgccaccatgcctggctaattttttttttttttttttgatatggagtctcactctgttgccaggctggagtgcagtggtgcgatcttggctcactgcaacctccgcctcccaggttcaagcgattctcctgcctcagcctcccgagtagctgggacaacaggcaagtgccaccacgcccagctaattttttgtatttttagtagaggcagggtttcaccatgttggccagga

SEQ ID NO: 21031 - DNA, 601 bp, Human
cactatggcttgaaattcatgctaggtttataaaaatgagcaaggtttataagccttctctgatgaccaaaaacattcactgcttatgtgtgatatctataacattcagattatccctttttttttttgagacgaagtctcactctcttttgcaggctggagtgcagtggtgcaatcttggctcactgcaacctctgcctcccaggttcaagtgattcttgtgcctcagtctcctgagtagctgggattacaggcacccgccactgccaccatgcctggctaattttttttttttttttttgatatggagtctcactctgttgccaggctggagtgcagtggtgcgatcttggctcactgcaacctccgcctcccaggttcaagcgattctcctgcctcagcctcccgagtagctgggacaacaggcaagtgccaccacgcccagctaattttttgtatttttagtagaggcagggtttcaccatgttggccaggatggtcttgatctcctgaccttgtgatccgcccgcctcggcctcccaaagtgctgggattctggctaatttttgtattttttagtagagacagggtatcaccatgt

SEQ ID NO: 21032 - DNA, 601 bp, Human
aggctgaggcataaaaatttcttgaacctggaaggcggaggtttctgtgagctgagatcatgctactgcactccagcctgggtgatggaccgagattctatctcaaacataaataagtaagtaagtaagtaaataaataaataaataaataaataaataaaacataaattcagctccatgactgctcctgcagagcagggctacccactacgcagtgagtggcattactactatttaattgcagaacactatcattaccccaacaagaaactccatgctcacccatcaacagtcattctcsattgcccaccctacccctaggccagggcaaccagtaatctactttctgtctctatggacttgcctattctggacatttaatgtaaatggaataatgtaatatgtgtcctcaaggtgtatccatgttgtagcatatatgagtacttcattcttttttattgtagaaaaagagtccattgtataaataataccacattttgtttatccatttgtcagttgacatttggcttgtttctactttttgactattatgaatgatggttctatgaacatttgtgcataagtttttgtatagacatgt

SEQ ID NO: 21033 - DNA, 601 bp, Human
atatggtatcaggtaggggtccacgtcctttttgtttttagcaagttgagtttgagatacctgcaggacattgaagtaggaggataataaaaccttgtataaaggagagtaagatgttgctggtagggaaagtgtctggaaagactttttttttttttccggagacggagcctcgctctgtcacccaggctggagtgcagtagtgcgatcttggctcactgcaaccaccgactcccgggttcaagcgattctcctgcatcagcctccccagtagctgggactacaggcacatgccactgcrcccggctaatttttgtatttttagtagagacagggtttcgccatgttggccaggctggtcttgaactcctgacctcaggtgatccacctcagcctcccaaagtggtgggattacaggcgtgagccactgtgcccagctggaaagaccatttttcagaagggtcgatgagggaatggaagggagccaccaacatctaattaggtgggcacaagtaatggagcaacaaaacaaactgaaaataaaaacaagtcaaagataggagaagcaggaaagagcaatgtctagttgccctctggacat

SEQ ID NO: 21034 - DNA, 601 bp, Human
actgggacttccctgatttcccatcattttccccaaataattgctagtgactcagtaacaacatccactctttaagtaacttaggttaattgttaatgagtacagctagattcaaaacagttcagatttttgaagcacttaacctttttcttgcctattttaccttgcatcgtttcaaacactacaaaatacatactcattgcatttacaattaattgtaagattctgaaagtgatttttcagtgcctgaatacttcaaaaaatcttcccaaagcagctttgctttgctggtttgtttttrttctttcgcttgctccttaattttttcattttaactatattttgctattgagttgtgataatgaaaataattgtttaaattctatgttctttttcctcaccaatttttatttcagatgataccatcttccaaaatcctatggtacaagaagctatacgaatggggttcagtttcaaggacattaagaaaataatggaggaaaaaattcagatatctgggagcaactataaatcacttgaggttctggttgcagatctagtgaatgctcagaaagacagtatgcaagatgagtcaagtcag

SEQ ID NO: 21035 - DNA, 601 bp, Human
tatcctcccgcctctgcctccctgagagctgggattataggcgtgagccaccgcgcccagcctgtttgtttgtttttaactcgttgtagcattacatctaaaagtaatgtggaaattacttgttctccttttgatttttttggcatgaaatacacacttcattctgactttttttggtgttgatgctttcttataatataaatcagcttatagtgccgtttctttacttgtattttttcctctgccttgagtacgttttctctatctgtatacctagtcccattccccactctacccccarctccctgaatctactttgtgaactcatgtttcaaggttcagctcagaagtcacttctttcaagttttctcccgcacccacagcagagttaggagctccttcttatctactcctggtgctggtagagttttgttttgttttattttgttttgttttgtttttcttgagacagggtctcgctctgtcgcccaggctggagtgcagtggcacacaatctcagctcactgcaacctctatctctcaggttcaagcgattctgctgcctcagcctcccgagtagctgggattacaggcatgcgcc

SEQ ID NO: 21036 - DNA, 601 bp, Human
tagcataattattttctctttttgcagagattagtactgaagagcagctaaggcgcctgcaagaggagaagctttgcaaaatctgtatggatagaaatattgctatcgtttttgttccttgtggacatctagtcacttgtaaacaatgtgctgaagcagttgacaagtgtcccatgtgctacacagtcattactttcaagcaaaaaatttttatgtcttaatctaactctatagtaggcatgttatgttgttcttattaccctgattgaatgtgtgatgtgaactgactttaagtaatcasgattgaattccattagcatttgctaccaagtaggaaaaaaaatgtacatggcagtgttttagttggcaatataatctttgaatttcttgatttttcagggtattagctgtattatccattttttttactgttatttaattgaaaccatagactaagaataagaagcatcatactataactgaacacaatgtgtattcatagtatactgatttaatttctaagtgtaagtgaattaatcatctggattttttattcttttcagataggcttaacaaatggagctttctgtatataaatgtg

SEQ ID NO: 21037 - DNA, 601 bp, Human
atgtgggaggtgttttcagggtctggtgtcttatacggtgttgaagtcttgaagataaatcaggcattggcacccaagctgcactctggtacattctgtgctgtggaggaaagtgcatttcttggctatgagatggcagtgatttgatctcctgaagctcaaattcccatgtcaggaaactgacctacaaacccaggactacgggggtcttaatgacttccatggcagaattctctgtggctagtaatcaagatagtttctgaagctggcacaattccctcgtttgtaaaatggtgttaaytattttttgtttaaccttttataaatgttgtaatgaggacagaattacactctttttcaagtgctacataaatgtccatggtcttcataattggaaacattctgattctttagaggcaacagaacagtttggttaagaggacaagacggccgggcacggtggctcacgcctgtaatcccagcactttgggaggccgagaaaggcagatcacgagttcgggagatcgagaccatcctggctaacatggtgaaaccccgtctctactaaaaatacagaaaaattagccgggcgtggtggcgg

SEQ ID NO: 21038 - DNA, 601 bp, Human
actggaatatgttgggtctgcaaaagagtctaagaagaaatgctcccttaagtgagagctgtttgggtggagaaatgggtgggaagccataatggggagggttgagctatacgtgggaaatgaagtggagatggcaaggacagacatctctttcaagatgtttgttcgtgagggagagaagagagatgggaaaggagatacctagagcaggatatggaagcaagttttgttttgcgtttacaagttagtatctctgtctctctctctctgtctctctctctttcactctctctctctctcwcacacacacacacacacacagagagagagagagagagtttttaagtatcattcacatagaacctgtaactttttttttgaatctgtaactttaacagcttctagctaaatatgtctataaagtctccaactgaggtccctaagcagacttatgcaactatgcaccatacaagtatagactaatggaagaggcattatccttttatttgtagaaactcataaatggtattcctggggagatttgatcatcttattttttgatccataagccagagtacagggttctaatgtagttcacttg

SEQ ID NO: 21039 - DNA, 601 bp, Human
gtctgcaaaagagtctaagaagaaatgctcccttaagtgagagctgtttgggtggagaaatgggtgggaagccataatggggagggttgagctatacgtgggaaatgaagtggagatggcaaggacagacatctctttcaagatgtttgttcgtgagggagagaagagagatgggaaaggagatacctagagcaggatatggaagcaagttttgttttgcgtttacaagttagtatctctgtctctctctctctgtctctctctctttcactctctctctctctcacacacacacacacasacacagagagagagagagagagtttttaagtatcattcacatagaacctgtaactttttttttgaatctgtaactttaacagcttctagctaaatatgtctataaagtctccaactgaggtccctaagcagacttatgcaactatgcaccatacaagtatagactaatggaagaggcattatccttttatttgtagaaactcataaatggtattcctggggagatttgatcatcttattttttgatccataagccagagtacagggttctaatgtagttcacttgaatattttgccaggt

SEQ ID NO: 21040 - DNA, 601 bp, Human
gaacctgtaactttttttttgaatctgtaactttaacagcttctagctaaatatgtctataaagtctccaactgaggtccctaagcagacttatgcaactatgcaccatacaagtatagactaatggaagaggcattatccttttatttgtagaaactcataaatggtattcctggggagatttgatcatcttattttttgatccataagccagagtacagggttctaatgtagttcacttgaatattttgccaggttctgtgctaggtgtgtaggattcaaagataaaaacgatacagaycgtacccttaaggatctaacagtataatacatatattcctagcatgaaataatacaaaaaaaccacatcacactggagaaagaccttatgaaaaaataataataaccacggcatgttaaagacttgatatgtgccaggcatggggcagagggctttgcatatgttcattacataatttaattctcacagccatcccacagttaaatactatttcctccactttgtcttccttttttaatttattttttattttttgagatggagttttgctcttttgcccaggctggagtgctgtggtgc

SEQ ID NO: 21041 - DNA, 601 bp, Human
gcatggggcagagggctttgcatatgttcattacataatttaattctcacagccatcccacagttaaatactatttcctccactttgtcttccttttttaatttattttttattttttgagatggagttttgctcttttgcccaggctggagtgctgtggtgcagtctccgctccctgcaacctccgccttctggtttcaagcgattctcctgcctcagcttcctaagtagctgggattacaggcgcctgccactacgctcagctaatttttgtatttttagtagagatggggtttcatcmtgttagccaggctggtcttgaactcctgacctcatgatctgcccgcctcggcctcccagagtgctgggattacagacatgagccactgcacctggccttttatcctaattttttttaaaattgaaaacttgaggattagaaatgtcaagtaactttcccatacctagttagtaacaaatgggatttgaactctgatctgcctggcttcaaagtggtgttaattacattacaccaccctgcttcttatgttatgtgaacatatgtatatgtataatttagttgtatgtggtattatgcctc

SEQ ID NO: 21042 - DNA, 601 bp, Human
catggggcagagggctttgcatatgttcattacataatttaattctcacagccatcccacagttaaatactatttcctccactttgtcttccttttttaatttattttttattttttgagatggagttttgctcttttgcccaggctggagtgctgtggtgcagtctccgctccctgcaacctccgccttctggtttcaagcgattctcctgcctcagcttcctaagtagctgggattacaggcgcctgccactacgctcagctaatttttgtatttttagtagagatggggtttcatcatgttagccaggctggtcttgaactcctgacctcatgatctgcccgcctcggcctcccagagtgctgggattacagacatgagccactgcacctggccttttatcctaattttttttaaaattgaaaacttgaggattagaaatgtcaagtaactttcccatacctagttagtaacaaatgggatttgaactctgatctgcctggcttcaaagtggtgttaattacattacaccaccctgcttcttatgttatgtgaacatatgtatatgtataatttagttgtatgtggtattatgcctct

SEQ ID NO: 21043 - DNA, 601 bp, Human
aagccaggactgccacccatttctttagcttcacatccattgttctttgctctgtgccataatgtccagataaatgagctacaggcacaatctcacccatacctctcacccactgacatttactctttcacacaaatatggcacagctgagaaaagttatcaatagcaatggaatatacttcctgcataaaaacctacccaaaattggttataagtcaggcgagaattttggcaagggatgagaaggtgggggtaataatgtgagagaaaatgatattcactgaatttcttatttcaagartattaatttctttttcctttgaaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttc

SEQ ID NO: 21044 - DNA, 601 bp, Human
ggaggagaatgggatgacagaagggtaatgcggtagattttaacttcctcggggaaaaataagaggatgtgaccaaaaaaaaaaaaaaaatctttcttagaggactatgggaaagatttgggaaggcagacagaaaattctaagagtattaaggaacagcattatcaaagaggcctaataaatttgaattaaagataccaaaaatgcctttggattaagacatgctctgggtggatccttttgaagatttcctcattaaaaagtttaaaaacataccaaaggtatcagaagagagagaaaraaagttcaaaagcaaggttctgtttctagctgtttttctggctagctttcctgtgaatttttttttcatgtaacttaaatgaatccacatccagaggctgaggcgggtggattgcttaaggtcaggagtttgaggccagcctgggcaacatgtgaaactggctctactaaaaatacaaaaattagccaggtgtggtggcaggcgcctgtaatcctagctacttgggcggctgaagcaagagaattgcttgaaacccgggaggcagaggttgcagtgagccgggatcgtgccactgcactc

SEQ ID NO: 21045 - DNA, 601 bp, Human
catccagaggctgaggcgggtggattgcttaaggtcaggagtttgaggccagcctgggcaacatgtgaaactggctctactaaaaatacaaaaattagccaggtgtggtggcaggcgcctgtaatcctagctacttgggcggctgaagcaagagaattgcttgaaacccgggaggcagaggttgcagtgagccgggatcgtgccactgcactccagcctgggcgacaaagcaagactcttgtctcaaaaaaataaaagtgaattcacatccatttgtctttgaattgaaattttatatctsttatagtaactgtatttttatgtttcttaaatataagccaacacaatctttatttttaatgaacatttaaaaatagactgatcctgacattcacatctgagcatagtaccatgtaatgaaaacatgtctgtatttcagaatattttcaacccatctatgtctacaaccctggtgagtatgttctaatttttaaaaataatcttggttgggcatggtggctcacgcctgtaatcccagcgctttggaaggccgaggtgagtggatcacttgagcccaggagtttgagaccagcctgggcaa

SEQ ID NO: 21046 - DNA, 601 bp, Human
ctgattgcatttttttactaaatagttcttattctcgtccttaggaataaaaagccagaggctcactgtttcacctgggaaataatctatttactgagactagctacatggttaggagacgataaggattcctaggattaagaacattgtgaaaagccagcacagtggctcacacctataatcccagctctttgggaggcgtaggcaggagaatcatagtgagttatgatcgtgtcattgtaccccaccacagcctgagcgactcagcgagaccctgtctctcaaaaaagaaaaaaaaatrttactgagcctggagagtttgaggaatgagttagacaagaacaaagggacttcatttattgagtaccttttttcgctccgtgcagtgtaccaagcacttttatgcagtctttccttcaatcttcactaactacaaacctaagaggtaaatatttctcttgcaaagtgagaaactaaagttaggagggattaagtagtctgcccaaagtcacagagctaataactataattacgatagagctaaaccaagcagaaatgtaaaaccagtagtgtttcatccaaaaactgatatattgggact

SEQ ID NO: 21047 - DNA, 601 bp, Human
caaagtgagaaactaaagttaggagggattaagtagtctgcccaaagtcacagagctaataactataattacgatagagctaaaccaagcagaaatgtaaaaccagtagtgtttcatccaaaaactgatatattgggactgccttctgaagataaagctggagagacgggttagatcgtggaagttcttgaagtccaggctaaggagtttggactctgtcacatggagaatgaagagccattgaaaggtgtttttgttgttgctgtttcttttttctttccccctgcctttttttttttttgaaagttggaaatggaggaaatatagacaaaagaagagtattaacagtataagataactgattaatacaaaccaatatttatttctgcctttaggtgtgaaaatccttgaacccacccaaatacctggtaagacagctttctatttactccctgagcccaagaatgagttgagcaggattcccaggcatttaagagaatactgtcatgagactattattcatgaatatttcccttatagctacctgccagtcatctacaaatatttagctggggaagtgtagagaagtctctttcctcct

SEQ ID NO: 21048 - DNA, 601 bp, Human
ccttctgaagataaagctggagagacgggttagatcgtggaagttcttgaagtccaggctaaggagtttggactctgtcacatggagaatgaagagccattgaaaggtgtttttgttgttgctgtttcttttttctttccccctgcctttttttttttttgaaagttggaaatggaggaaatatagacaaaagaagagtattaacagtataagataactgattaatacaaaccaatatttatttctgcctttaggtgtgaaaatccttgaacccacccaaatacctggtaagacagctttytatttactccctgagcccaagaatgagttgagcaggattcccaggcatttaagagaatactgtcatgagactattattcatgaatatttcccttatagctacctgccagtcatctacaaatatttagctggggaagtgtagagaagtctctttcctcctgtgcattcatgtgctcctggagcattgtctctggggcaggaaagttagttctgctctggatgttgctgagggaaaggctcctgggatctggatgcatcagtccaacaccttccaggttctacagctaaagttattcaatag

SEQ ID NO: 21049 - DNA, 601 bp, Human
agtgaagtgctatggcagaagactcctctaatcatggtgtggatttgtataataagggtttacgtaagcagaacttttaaataaaaagccagaaactatagtgcattggggccttgggtgcttgcatctcttaagctcagcagacaagagtttgaaaattatactcagtggagcaaactgtaagtcattggaaacttccttctcatttaggaatgaaaattccagaaccttttccactacctggtaagcaactgataggcatgccagaggggaacatgccagtttggggagtacagtcacyattagatatgcatgggactttctatgcctcataattgtcatctatcaaatgtagccatcagtagtcacatgtacatgacaggaatatttgtaaggactataaaaccatggaatctcagggtgcaagccactgtccaatgcataaatccctttctcctgagttcatgtagtactttgaaatatttttttgcaggttttgttattatggaaatgatgatctgttaaggaaattagatatttggcatcttaaaaactatatccagccacacagtgctgaacttcacgtaacgctgctgtcaat

SEQ ID NO: 21050 - DNA, 601 bp, Human
gctgtacactttccgatatcccagtctgcaagccagacagggaaagtgttgagaatttctttcagtgtgagcagcaggctgctattacggttctctgggccaaacatcaaaaaaggcacttgatcttaaactggaacagttggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctayaatcgtccagtaggccactagattttgttgggactacagtgtattgtgccctctcctggaaagctatgtgtagctttttaaaaggtgatgtgaaaacagtacacaggagctcatttaatccaataagataaatattattgacacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattg

SEQ ID NO: 21051 - DNA, 601 bp, Human
ttccgatatcccagtctgcaagccagacagggaaagtgttgagaatttctttcagtgtgagcagcaggctgctattacggttctctgggccaaacatcaaaaaaggcacttgatcttaaactggaacagttggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctacaatcgtccartaggccactagattttgttgggactacagtgtattgtgccctctcctggaaagctatgtgtagctttttaaaaggtgatgtgaaaacagtacacaggagctcatttaatccaataagataaatattattgacacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattggtatttggct

SEQ ID NO: 21052 - DNA, 601 bp, Human
taaactggaacagttggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctacaatcgtccagtaggccactagattttgttgggactacagtgtattgtgccctctcctggaaagctatgtgtagctttttaaaaggtgatgtgaaaacagtacacaggagctcatttaatccaatamgataaatattattgacacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattggtatttggcttcaaagctgttaaaatatggtaatatcataatatttctatgctaggcacacacttggtagtacagatggtctccaagttacaatggtcagtctgtaagaaacacgaaaaggtggct

SEQ ID NO: 21053 - DNA, 601 bp, Human
aaactggaacagttggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctacaatcgtccagtaggccactagattttgttgggactacagtgtattgtgccctctcctggaaagctatgtgtagctttttaaaaggtgatgtgaaaacagtacacaggagctcatttaatccaataarataaatattattgacacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattggtatttggcttcaaagctgttaaaatatggtaatatcataatatttctatgctaggcacacacttggtagtacagatggtctccaagttacaatggtcagtctgtaagaaacacgaaaaggtggctt

SEQ ID NO: 21054 - DNA, 601 bp, Human
tggcttccagctgggcctgtctattccagaatgaggcaggcttctcagggtgaaggaatctgtagacatagaaatagcatcatccaagaactgtgaatgaggactgtgcagcatgccaatactgggaccagccattctgtgtgctcctcaccacactctacaatcgtccagtaggccactagattttgttgggactacagtgtattgtgccctctcctggaaagctatgtgtagctttttaaaaggtgatgtgaaaacagtacacaggagctcatttaatccaataagataaatattattracacttcagagatgagaacatggaacataagaaggctaacaaatttataataggctagagacaaccaggactcaaacttttcaagctttgttcactttgtgctacacttgtcttccaaacagatttagttatccacttctatcctgggcacctagaattggtatttggcttcaaagctgttaaaatatggtaatatcataatatttctatgctaggcacacacttggtagtacagatggtctccaagttacaatggtcagtctgtaagaaacacgaaaaggtggcttgccagttaggaca

SEQ ID NO: 21055 - DNA, 601 bp, Human
tttcactttctgtacaatattcaatagattacatgagacattcaatattttattataaaataagctttatcttagctgatttcgcccaactgcaggctcatgtaagtgttctgagcacgtttaaggtaggctaggttaagccatgatgttctgtaggttgggtgagttaaatgcatttttgacttatggtattttcagcttacattggatttattgagacacaaccccatcataagtcgagaagcatctgtatagcatagtaattcagagcaaatttgaaattagatatttctagcaccarttacacccgtgattttatgcatggcattcctcaaaacatttcataaatgttttaaggaatatctgtgaaatatggataattatacctggctaataagactaagaagtaaaggtgacagtgtacataaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaa

SEQ ID NO: 21056 - DNA, 601 bp, Human
ctttctgtacaatattcaatagattacatgagacattcaatattttattataaaataagctttatcttagctgatttcgcccaactgcaggctcatgtaagtgttctgagcacgtttaaggtaggctaggttaagccatgatgttctgtaggttgggtgagttaaatgcatttttgacttatggtattttcagcttacattggatttattgagacacaaccccatcataagtcgagaagcatctgtatagcatagtaattcagagcaaatttgaaattagatatttctagcaccaattacmcccgtgattttatgcatggcattcctcaaaacatttcataaatgttttaaggaatatctgtgaaatatggataattatacctggctaataagactaagaagtaaaggtgacagtgtacataaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaaattaa

SEQ ID NO: 21057 - DNA, 601 bp, Human
ggtaggctaggttaagccatgatgttctgtaggttgggtgagttaaatgcatttttgacttatggtattttcagcttacattggatttattgagacacaaccccatcataagtcgagaagcatctgtatagcatagtaattcagagcaaatttgaaattagatatttctagcaccaattacacccgtgattttatgcatggcattcctcaaaacatttcataaatgttttaaggaatatctgtgaaatatggataattatacctggctaataagactaagaagtaaaggtgacagtgtacrtaaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaaattaaacccttcccctaaccccacacatacccgtaaacctattaccctgcccctcagacccactcacagagataaccaagtttgcttaatttttaatcagatctttcttttctggataaacaga

SEQ ID NO: 21058 - DNA, 601 bp, Human
aaaacatttcataaatgttttaaggaatatctgtgaaatatggataattatacctggctaataagactaagaagtaaaggtgacagtgtacataaagcatttgcacaatgcatggcacatagtgaacactcaatagtaggtattaatgtacttgggaatctaagttcaatatgtagaaaatactttttgtgaataaaattttaacttttatttttatgtaaacacatattgatgggaaaaaaaattcaaagagcacagatgagaacaaattaaacccttcccctaaccccacacatacccrtaaacctattaccctgcccctcagacccactcacagagataaccaagtttgcttaatttttaatcagatctttcttttctggataaacagatatacaatataactaactcaaaatctctttatattttagaagataaaagtcaaggaaatatcaacaatcctagtaagaagtatctcatttcctcagttgataaatgcctgcttctgtaatatagaaaaagtgagaaatttatttttcctcaataaagggaacaaagttgcaaggttttaaggcatcttaataacagagtataatgtcat

SEQ ID NO: 21059 - DNA, 601 bp, Human
ttggggacaatatagctttgttttttcgataatcgttttccattgtatctagagtttctactcttagaacagtggttcttaccagtctgaagactgggagcaaaatataaaaataaaaaagaaaatatatattaaaaaaaaaaagaacagtggttctcaacccaattctccctttataacaagtattttataaagtccttatattatccagaaagaagatccatagatgagatgcatttgtacccataaaaatcaacatcatgtctaaagtagaccgatgtttacatttatgcaaataaayttgggttgaagagaagattggaagctattctatacaggaagtataagaaaatggagtgaagaaatagagtagatactaaataaaaactgatgtttaatgtttatcaaaactattaaaaatatacataaaactgctttaggttctgagtttgattattttaaataggttttaacttacatgtatgtctagcagtacatttgaaagttgtgcaggaagttggtcaatttttcatggtccagaactagagcactgcaggatatctatccctctacctccactccactgttagcaatgattaaa

SEQ ID NO: 21060 - DNA, 601 bp, Human
tataaaaataaaaaagaaaatatatattaaaaaaaaaaagaacagtggttctcaacccaattctccctttataacaagtattttataaagtccttatattatccagaaagaagatccatagatgagatgcatttgtacccataaaaatcaacatcatgtctaaagtagaccgatgtttacatttatgcaaataaatttgggttgaagagaagattggaagctattctatacaggaagtataagaaaatggagtgaagaaatagagtagatactaaataaaaactgatgtttaatgtttattaaaactattaaaaatatacataaaactgctttaggttctgagtttgattattttaaataggttttaacttacatgtatgtctagcagtacatttgaaagttgtgcaggaagttggtcaatttttcatggtccagaactagagcactgcaggatatctatccctctacctccactccactgttagcaatgattaaaaaaaaaaaacaaaaaactcttgacaatcgtccaaactgcctcttggggcagtaatgcccccctgagaaccactggtctgtggtaacatacagtcatgcattgctt

SEQ ID NO: 21061 - DNA, 601 bp, Human
tgtattatatataattgtatgtgctatacagttatacaactggcagtgcagtaggtttatttacaccatcatcaccccaaacacgtaatatgttacaacggcaacgatgttgctaggcagtaggaaattttcagctctattataattatagtcttatgggatctctgtcatacatgtggtctgtcattgatggaaacatcattatgcgttgcacgactgtactaatgcatgtgtgcatctgcctatccatttctctgtgtgtatacatccaactgcatgtttataactatggcaagtacaytgataatatgaaggcttttacaaatctgactggctatttttcttggttttatttatgaaatctgagtggtgatcccatttggatacttccagtcaacgcttccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagcc

SEQ ID NO: 21062 - DNA, 601 bp, Human
actggctatttttcttggttttatttatgaaatctgagtggtgatcccatttggatacttccagtcaacgcttccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagccctctgtatcctctgggattcaaccaactrtggatcgaaaatatttgtgggaaaaaataatacaaatttaaaaacccatacagtacaacaactacttgcatatcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggt

SEQ ID NO: 21063 - DNA, 601 bp, Human
atttttcttggttttatttatgaaatctgagtggtgatcccatttggatacttccagtcaacgcttccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagccctctgtatcctctgggattcaaccaactgtggatcraaaatatttgtgggaaaaaataatacaaatttaaaaacccatacagtacaacaactacttgcatatcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttg

SEQ ID NO: 21064 - DNA, 601 bp, Human
ttttatttatgaaatctgagtggtgatcccatttggatacttccagtcaacgcttccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagccctctgtatcctctgggattcaaccaactgtggatcgaaaatatttgygggaaaaaataatacaaatttaaaaacccatacagtacaacaactacttgcatatcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaataga

SEQ ID NO: 21065 - DNA, 601 bp, Human
tccccgtagttcaaacaaaaagagtttaggtcagcatgaaacagtttatcctgtggatggactccactgctcctctccactagttcaaatgaaagggaaagagtttctccagcagtgtatgtatggagggaaaaacatttatttttttttatcatcttgcagagattagtgtttaaaaaacaatgcagctatagttagccctctgtatcctctgggattcaaccaactgtggatcgaaaatatttgtgggaaaaaataatacaaatttaaaaacccatacagtacaacaactacttgcatwtcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaatagaagacacacagagttaaactttaccttgcatgtatatacagaaaatggaaataga

SEQ ID NO: 21066 - DNA, 601 bp, Human
ttgtgggaaaaaataatacaaatttaaaaacccatacagtacaacaactacttgcatatcatttacattgtattaggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaayagaagacacacagagttaaactttaccttgcatgtatatacagaaaatggaaatagaaaaattgctaaaaaaaatgctagagaacttgaacaacagaaaatcattatattggctatatagaaatgtaaaagcatgtgaaatcctacataaaacctagcgtagcagatcttgatgatatatagtcgacccttgaacaacacaggtttgaactgcatgggtccacttatacatggattttttttaaataaatatattggaaatatttttggatatttgcatcaatttgaagaaacttgcaga

SEQ ID NO: 21067 - DNA, 601 bp, Human
aggtattataagaaatctagagatagtataaggtatacaggaggatgtgtgtaggtatatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaatagaagacacacagagttaaactttaccttgcatgtatatacagaaaatggaaatagaaaaattgctaaaaaaaatgctagagaacttgaacaacagaaaatcattatattggctatatagaaatgtaaaagcatgtgaaatcctacataaaacctagcgtagcagatcttgatgatatatagtcgacccttgaacaacacaggtttgaactgcatgggtccacttatacatggattttttttaaataaatatattggaaatatttttggatatttgcatcaatttgaagaaacttgcagacaaactgcatgacctagaaatatatatatatataaaaagaaagtatgtcatgaatgcataaaatatatgtagat

SEQ ID NO: 21068 - DNA, 601 bp, Human
tatgcaaatactgtgtatgctattttatttatttatgtatgctattttatataagggacttgagcatctgtggattttggtatcctcaggggttctagaaccagtccccaaaggatactgagggatgactgtatatccagttgtatgttggtggttatcttgtttgaaatagaagacacacagagttaaactttaccttgcatgtatatacagaaaatggaaatagaaaaattgctaaaaaaaatgctagagaacttgaacaacagaaaatcattatattggctatatagaaatgtaaaakcatgtgaaatcctacataaaacctagcgtagcagatcttgatgatatatagtcgacccttgaacaacacaggtttgaactgcatgggtccacttatacatggattttttttaaataaatatattggaaatatttttggatatttgcatcaatttgaagaaacttgcagacaaactgcatgacctagaaatatatatatatataaaaagaaagtatgtcatgaatgcataaaatatatgtagatgctagtctatttttatcatttactaccataaaacatacacaaatctattgtaaaacg

SEQ ID NO: 21069 - DNA, 601 bp, Human
tatatccagttgtatgttggtggttatcttgtttgaaatagaagacacacagagttaaactttaccttgcatgtatatacagaaaatggaaatagaaaaattgctaaaaaaaatgctagagaacttgaacaacagaaaatcattatattggctatatagaaatgtaaaagcatgtgaaatcctacataaaacctagcgtagcagatcttgatgatatatagtcgacccttgaacaacacaggtttgaactgcatgggtccacttatacatggattttttttaaataaatatattggaaatmtttttggatatttgcatcaatttgaagaaacttgcagacaaactgcatgacctagaaatatatatatatataaaaagaaagtatgtcatgaatgcataaaatatatgtagatgctagtctatttttatcatttactaccataaaacatacacaaatctattgtaaaacgttagtatttatccaaatttgtgcacacagaccatatgtggcaccattcaaaatcaaaagaaacgtaaatgtaaagatgcggtattaaaacttaactgcataaaattaactataatacatactgtatcattg

SEQ ID NO: 21070 - DNA, 601 bp, Human
aaatagaaaaattgctaaaaaaaatgctagagaacttgaacaacagaaaatcattatattggctatatagaaatgtaaaagcatgtgaaatcctacataaaacctagcgtagcagatcttgatgatatatagtcgacccttgaacaacacaggtttgaactgcatgggtccacttatacatggattttttttaaataaatatattggaaatatttttggatatttgcatcaatttgaagaaacttgcagacaaactgcatgacctagaaatatatatatatataaaaagaaagtatgtcaygaatgcataaaatatatgtagatgctagtctatttttatcatttactaccataaaacatacacaaatctattgtaaaacgttagtatttatccaaatttgtgcacacagaccatatgtggcaccattcaaaatcaaaagaaacgtaaatgtaaagatgcggtattaaaacttaactgcataaaattaactataatacatactgtatcattgtaatcatttcatggccacctcctgttgctattgcagtgagttcaaatgtttcgagtatcctcttaaaacaccatgtgttgctaaacatc

SEQ ID NO: 21071 - DNA, 601 bp, Human
agaaatatatatatatataaaaagaaagtatgtcatgaatgcataaaatatatgtagatgctagtctatttttatcatttactaccataaaacatacacaaatctattgtaaaacgttagtatttatccaaatttgtgcacacagaccatatgtggcaccattcaaaatcaaaagaaacgtaaatgtaaagatgcggtattaaaacttaactgcataaaattaactataatacatactgtatcattgtaatcatttcatggccacctcctgttgctattgcagtgagttcaaatgtttcgmgtatcctcttaaaacaccatgtgttgctaaacatctctgaggagttcatctccagtaaattgcacatcacagcaaaaagtgatctctcacagttctcctgtattttttgtcatgtttggtgcaataccaaaaaccttgaataacaccataggactcaaaggaagtgccactagtgaggccggaagtctcacaagcagagagaagccatgacattacaagaaaaagttgaattgcttgatatatagattcaggtctgcagctgcagttgccagccatttcagacagataattcatcttata

SEQ ID NO: 21072 - DNA, 601 bp, Human
atgtaggttttcattgtgtgggggttggcaccccaacacccgtattaagggtcaactgtatatggaaatatagcctgaaatctgtaatgaattacacttatttgaaaattgcttttggctggaagtatttcaggtaagtttctacttcaactttagtgtcattgtttacatattcaggatatattttataggtggatgatacttgacataaaaaatgatgtgtcagtgactgtgtattcttgttaacagctccaggtccagttcctgttccaggtcccaaaagccatccttctgcatcctygggcaaactgctgcttccacagtttgggatggtcatcattttaatcagtgtttctgctataaatctctttgttgctctgtagtttgatgcattgtttatctttcttattctttacttgaaataactatagggatacacaggagatcaaaaggaatgatgtattttttacgtgttggccaaagtcactggataaaatgagaattgtatatttgttattcattttgcaaattcagaaagttggtccagatatatgtcacagaacttttcacttgtatactactcttacaatggaaaaaaatc

SEQ ID NO: 21073 - DNA, 601 bp, Human
gggggacagaaagggggaaataaagagaaatgatgatgatcttctagaacacaaaaatattttcagaaaagagttgggaaatctctagggttccctaacatttatggctgagaatgattcccacagtctatacttccaaaaactagctagaacccggtaaaacaggttggtatccaactatgctttaaaaccttgcttttcaaagcaaaatctgtcagcttcatctgggaacatgtaaggcatattagaaatgcagaaccttgagctccaacccagacttcggaaatcagaagcttcattytaacaaaatcctcaggtacttcagaagcactgccttaaatggccccctgcctaatctttctacgcttcaccttttctatggttctttccttttcacgcccccacccaagagaggacagtctcccccagacagtcctaaatgacaaatgaaaaataaacacattattctcttcatttgtgattttatattattcttgacctgcctaactggcttctgcctctaaagaaagcctgcacaaactccttgtgtataatttgaattaaacacacacacacacacacacacacacacacacacact

SEQ ID NO: 21074 - DNA, 601 bp, Human
atcagattaaaaagtcagggcctatcaataaccctttcaatattattccatacccaggaaaaagaaagccacatgtacttactttgtgacagccacactaatgagggaagtggttggagctcctttccttaagaaggttaaaacaaaaaaagaaaaagaaaaacttatttgacggaaaccataaataccttttattatcaaacagaagcaaaagtgtgagaaaaagctctgtccaattagacaactaacaagtgagtctagtaactgaaacagaaatctgtccttcagctgggtgtctttsagacctaaggaacaacaaaactttcatgaacataaaaatggcaccaagcaattctgaatcagcttgctgcactgatcgcaggaatcactacattaacctcagccagttataggaactgagtgaagcagaaatctaccaacgtgctgcattaagtaaacttccttggaaaactcagagagctgaggaaaactacacaatgaacctttttagattagaatgttggaaaacatgagttcctttcacaacatggggcagaaccctgaaagagctcggggctagttcccaccaaaccatgtcggt

SEQ ID NO: 21075 - DNA, 601 bp, Human
gatcacaaggtcaagacatcgagaccatcctggccaacatggtgaaaccccatctctactaaaaatacaaaaaattagccaggcgtggtggcacaagcctgtaatcccagttactcgggaggctgaggcaggagaatcacttgaaccagggagtcggaggttgccgtgagccaagattgcaccactgcactccagcctggcgacagagcaagactccatctcaaaaataataataatagccgggcgtggtggctcatgcctgtaatcccagcactttgggaagctgaggcaggtggatcaygaggtcaggagatcaagaccatcctggctaacacggtgaaaccccatctctactaaaaacacaaaaaattagctgggtgtggtggtgtgcacctgtactcccagctactcgggaggctgaggcaggagaatggcgtgaacccgggaggtggagcttgcagtgagccgagatcgcaccactggactccagcctgagtgacagagcaagactccatctcaaaaaataataataataataataataatattctaatatgaagaaccctcttgcccacagtctccaccccaatttctctactaa

SEQ ID NO: 21076 - DNA, 601 bp, Human
gctgggcacagtggctcatgcccatcccagcactttgggaggccaaggcaggcggatcacaaggtcaagacatcgagaccatcctggccaacatggtgaaaccccatctctactaaaaatacaaaaaattagccaggcgtggtggcacaagcctgtaatcccagttactcgggaggctgaggcaggagaatcacttgaaccagggagtcggaggttgccgtgagccaagattgcaccactgcactccagcctggcgacagagcaagactccatctcaaaaataataataatagccgggcgyggtggctcatgcctgtaatcccagcactttgggaagctgaggcaggtggatcatgaggtcaggagatcaagaccatcctggctaacacggtgaaaccccatctctactaaaaacacaaaaaattagctgggtgtggtggtgtgcacctgtactcccagctactcgggaggctgaggcaggagaatggcgtgaacccgggaggtggagcttgcagtgagccgagatcgcaccactggactccagcctgagtgacagagcaagactccatctcaaaaaataataataataataataataata

SEQ ID NO: 21077 - DNA, 601 bp, Human
aagcatggtggcatgcacctgtaatcccagctacttgggaggttgaggcaggacaatcgcttgaacctgggaggcagaggttggagtgagccgagattgtgccactgccctccagcctgggcgacagagcaagactctgtctttaaaaaaaaaaaaattagcccggcgtggtggcccacacctataatcccagctactcgggaggctgagacatgagaatctcttgaacccaggaagcagaaactacagtaagctgagatggccccactgcaatccagcctgggcaacaaagactgtctcaaaaaaaaaaaaaaaaaaaaaaagaaaacatattacccttgctcttttccagcccaccactttccaattcctaaaccactattctaaataatcttctaggctgggcacagtggctcatgcccatcccagcactttgggaggccaaggcaggcggatcacaaggtcaagacatcgagaccatcctggccaacatggtgaaaccccatctctactaaaaatacaaaaaattagccaggcgtggtggcacaagcctgtaatcccagttactcgggaggctgaggcaggagaatcacttgaacca

SEQ ID NO: 21078 - DNA, 601 bp, Human
cacacctgtagtcccagccactcgggaggctgaagcaggagaatcgcttgaacccgggaggcagaggtttcagtgagccgagatcgcaccactgcactctagcctggtgacagagcaagactcagtctcaaaaaaaaaaaaaagaaaaaattagccaagcatggtggcatgcacctgtaatcccagctacttgggaggttgaggcaggacaatcgcttgaacctgggaggcagaggttggagtgagccgagattgtgccactgccctccagcctgggcgacagagcaagactctgtctttwaaaaaaaaaaaattagcccggcgtggtggcccacacctataatcccagctactcgggaggctgagacatgagaatctcttgaacccaggaagcagaaactacagtaagctgagatggccccactgcaatccagcctgggcaacaaagactgtctcaaaaaaaaaaaaaaaaaaaaaaagaaaacatattacccttgctcttttccagcccaccactttccaattcctaaaccactattctaaataatcttctaggctgggcacagtggctcatgcccatcccagcactttgggaggccaa

SEQ ID NO: 21079 - DNA, 601 bp, Human
ggaggctgaggcgggcagatcacgaggtcaggagatcgagaccatcctggccaacatggtgaaaccccatctctactaaaatacaaaaaattagccgggcgtggtggcgcacacctgtagtcccagccactcgggaggctgaagcaggagaatcgcttgaacccgggaggcagaggtttcagtgagccgagatcgcaccactgcactctagcctggtgacagagcaagactcagtctcaaaaaaaaaaaaaagaaaaaattagccaagcatggtggcatgcacctgtaatcccagctactygggaggttgaggcaggacaatcgcttgaacctgggaggcagaggttggagtgagccgagattgtgccactgccctccagcctgggcgacagagcaagactctgtctttaaaaaaaaaaaaattagcccggcgtggtggcccacacctataatcccagctactcgggaggctgagacatgagaatctcttgaacccaggaagcagaaactacagtaagctgagatggccccactgcaatccagcctgggcaacaaagactgtctcaaaaaaaaaaaaaaaaaaaaaaagaaaacatattac

SEQ ID NO: 21080 - DNA, 601 bp, Human
gaacgatgaaggaaattagaggtagtcaccaccagcaaataagagatttaaacacatctctgcaaagcagagttagagaagttgtaaagcacaaattggggaaggggaagggatccccaaaacctaaagtaaatgccacagacacaaaagaaggagctggggccaccctgcagaaccctgaaagagcttgaggctagttcccaccaaaccatgtcggtcagaaaatatcagtgccctgcaggctaaagaattgcagacaagcagagttttttctcttgttagaatgagaaatacatttaartactacttaaatctgattttgagtcataaaaaaatggctaaaataattctggtttctctgaaaaaggattccattcattttgagtttccagaggaccaaagagcaaaggttattttcatcaatcatctcaacttactggctactttccaatttgtttaaatttcaaaaactctcaaatcccatgctcactttcatagaaaaggtatcattatcacacctaagttcccctaaaataccctttatagctgttttctttcttccttccaatccaggatccaatcaaggatcatgaactccagc

SEQ ID NO: 21081 - DNA, 601 bp, Human
tccatgtcatcttaatatcatgccaagtaaaagcagcaagacacaaaaggccacatgttatatgattacatttatacaaaatgtctcaaataggcaaatccatagagacagaaaattctttagtggctgtcagggcatgagggcagggggaatgggaagagactgccagtgggtatgggattaatttcttggctgatcaaaatgttctggaataagatagtggtgatagatatacaatactctgaatattttaaaaaccactatattgtacactttaaaagagagcatttcatgattttayggtacacgaattgtgaattatatggcaattaaaaaagaaaaaaacaattttactaaaaagaggctgtgttcccagggttccctttttcagtcagctgagaaactcagacaataggctaggttcttggcaggcagtgagaccccagactacaatttcatagctttctttgtaagtaaacaccttgataaaccaagtgtcaggaagtcacaggctgccccccattacagcagtttgttatttcaggatataaacaccttaacaaatagtacctctgggcaattaaaaagacaattcttattc

SEQ ID NO: 21082 - DNA, 601 bp, Human
gcactaatactcaaagtggctgctgcttaacatgctcctgtatatactaccataattatctgagctattgcaaggccagcacaaggactaaatacctagaatgcaagaatacagtcaaaggccaactcatgttttaaatgacacttagataatatttcactctgcattatacatgtgggagttgtatttctaaaattttctcattaatatgaaaaacagagtaatgaaaaacagagtaacttattgctcctttttgagattgcccagtaagtacaatagtatttaaaagtgttggaaggcraggaaactaacactttagccacaccagtatgggttgtaagacttgactcctgaaaaactcacctaatcaaagtctaagctggtaagaacctcagctttcatcccagttcagcacaagtatagtccatgtcatcttaatatcatgccaagtaaaagcagcaagacacaaaaggccacatgttatatgattacatttatacaaaatgtctcaaataggcaaatccatagagacagaaaattctttagtggctgtcagggcatgagggcagggggaatgggaagagactgccagtgggtatgg

SEQ ID NO: 21083 - DNA, 601 bp, Human
gcctaggcaacacgatgaaaccccatctctataaaaaatactaaaattagccaggtgtggaggcatgcgctacttgggaggctgaggtaggaggatcacttgaaactgggaggcggaggttgcagtgagctgaggtcaagccactgcactccagcctaggtgacagagtgagaccctgtctcaaaaagataaaaataaaataaataaaaaataaaagaattcaaacttaaaagcctgtagggaaatatcctaaagcaggggtccccaagccccaggatgctgaccagtaccagtctgtggsctattaggagccaggctgcacagcaggaggtaggcagcaggcaacctggcgagcattactgcctgagtgccacctcctgtcagatcagcagcagcattagatcttcagaggagtgtgaactctattgtgagctgtgcatgcaagggatctagattgcatgctccttatgagaatctaactaatgccttatgatctgagtggaacaatttcagcctaaaaccatccccctgccgtggtccatggaaaaattgtcttccactaaaccagtcccagtccctggtgccagaaaggttggggacc

SEQ ID NO: 21084 - DNA, 601 bp, Human
aactgctgtgtaattcctttaaggattaaaacttgggcaggaccagcctaggcaacacgatgaaaccccatctctataaaaaatactaaaattagccaggtgtggaggcatgcgctacttgggaggctgaggtaggaggatcacttgaaactgggaggcggaggttgcagtgagctgaggtcaagccactgcactccagcctaggtgacagagtgagaccctgtctcaaaaagataaaaataaaataaataaaaaataaaagaattcaaacttaaaagcctgtagggaaatatcctaaagyaggggtccccaagccccaggatgctgaccagtaccagtctgtggcctattaggagccaggctgcacagcaggaggtaggcagcaggcaacctggcgagcattactgcctgagtgccacctcctgtcagatcagcagcagcattagatcttcagaggagtgtgaactctattgtgagctgtgcatgcaagggatctagattgcatgctccttatgagaatctaactaatgccttatgatctgagtggaacaatttcagcctaaaaccatccccctgccgtggtccatggaaaaattgtctt

SEQ ID NO: 21085 - DNA, 601 bp, Human
gtgaaggacagcaggttcactcgttcatctttggccattgctgtgctgcaagggaacagacacggtcggccacccaagcagagaaacccagcaattacaacatctaatggtacccagcactgaagtgcccttgaaaaagcagtcccttgaagctacaagaaagtctgtcccaggggagcaagggaaggtcttcatgagaaggaaaaaagtttttcacaggtagaaccattaggcagaagaggctaacctgctgtgagcatttgaatagaaatcacctagaggaagttgttagggaagaaastctttcctatactgagtgagtgactggacaatatgatcttagcatttccttgctgagcattccagttttacaaacttttaactgctgtgtaattcctttaaggattaaaacttgggcaggaccagcctaggcaacacgatgaaaccccatctctataaaaaatactaaaattagccaggtgtggaggcatgcgctacttgggaggctgaggtaggaggatcacttgaaactgggaggcggaggttgcagtgagctgaggtcaagccactgcactccagcctaggtgacagagtgagaccc

SEQ ID NO: 21086 - DNA, 601 bp, Human
tatttgagagaattaaaatcctcattagaaagccaacacttaccaaacctctcctgcaccatcaggcccacctgttttcccacctgagtgctcccagtgaaggacagcaggttcactcgttcatctttggccattgctgtgctgcaagggaacagacacggtcggccacccaagcagagaaacccagcaattacaacatctaatggtacccagcactgaagtgcccttgaaaaagcagtcccttgaagctacaagaaagtctgtcccaggggagcaagggaaggtcttcatgagaaggaawaaagtttttcacaggtagaaccattaggcagaagaggctaacctgctgtgagcatttgaatagaaatcacctagaggaagttgttagggaagaaagtctttcctatactgagtgagtgactggacaatatgatcttagcatttccttgctgagcattccagttttacaaacttttaactgctgtgtaattcctttaaggattaaaacttgggcaggaccagcctaggcaacacgatgaaaccccatctctataaaaaatactaaaattagccaggtgtggaggcatgcgctacttgggag

SEQ ID NO: 21087 - DNA, 601 bp, Human
cccaagtagctgggactacaagcatgagccatcatgccttgctaattttttttaactttttataaagacagggaatcactttgttgcccaggctggtctcgaactactgggctcaaggaatactcctgcctcagcctcccaaagtgttagaattctatgcttgagccaccatgcccagtctaaaatgtttaaaatgttttactacttaaaatgtttttataaaagtgcaagactctatttttagctatagtttaataattctttttatttttatcttgttttgttctctaaatgacactgracttcgtccatattgttctaggagtaggactgaatatcagtctcatctcctagtccaactccagtcaattggtagtggaacccctattatcttggggtgggaaaaaggcaaagtccctgaatgattaacaacatctgccatgagcacagaaagagaactggaccacatatttgccagccacatctagagagcatgttgttctagcagtattgctgacacctctctaacagcagaactcattaaaaagtagtgttttaagagcaagacaatcgggcctatgcagatatactcaccagtcgc

SEQ ID NO: 21088 - DNA, 601 bp, Human
ttggcttttatgtcatttcatattttaccatgtaatgaagggtataatcatttggagtgcatggttttttcttagctttaacgtaatctttaacgcaatttaatgtttatggtgaacaaatttaataaactttaaagttacaaatgtagtatcagattatttgagaatgtcagctatgtaaaaataaagatttattttcatttatgcaaaacacctgaaaaaacaaatatgaaaagtgtgagaggccgggtgcggtggctcacacctgtaatttcagcactttgggaggccaaggcaggcwgatcacctgaggtcaggagtttgagaccagcctggccaacatggcaaaatcccatctctaataaaaatacaaaaattagccaggcacggtgatgggtgcctgtagtgccagctactcaggaggctgaggtgggagaatcacttgaacctggaggtggaggttacggtgagctgagatcacaccattgcactccagcctggccaacagagagagactccatctcaaaaaaaaaaaagaaagaaagaaaaaagaaaagtgtaaggtaaagataattttcatatatcttttagcttattctaa

SEQ ID NO: 21089 - DNA, 601 bp, Human
tatgataaatgcacacatttttaaacaatgaataatttccttgatagttactgaaatactgtaatctctaaaaatataagaaaatcaaagcatgtttatttttttaattatataatttatcattttaatattaactatatgaagtcaaaattttccttttaggtagataatagaataaaatcataagccatgtctttttttttttttttttttttgagacagagtctcactctgtcacccaggctggagtgcagtggcatgatctcagctcactgcaacctccacttcccgggttcaagcrattcttatacctcagcctcccgagcagctggaattacaggcacccaccaccacacctggctaattttttgtatttttagtagagacaggcttttgccatgttgcctaggctggtcttgaactcctgacctcaggtgatccacccacctcagtctcccaaagtgctgggattacaggtgtgagccaccacacccggtccataagccacatcttcatcaagtttccaaggatgtatttgtctaagcttcacaaatacattaaagaaggcctcaagtacatgtgtcccatactgtaaccctaa

SEQ ID NO: 21090 - DNA, 601 bp, Human
ggttcccaactcggatctgtgcataggcctttttaagtctgtttacaacctcatcatggatgctttcatgtataaactaaacgaaaaaagatattcaagggcatagtatgataaatgcacacatttttaaacaatgaataatttccttgatagttactgaaatactgtaatctctaaaaatataagaaaatcaaagcatgtttatttttttaattatataatttatcattttaatattaactatatgaagtcaaaattttccttttaggtagataatagaataaaatcataagccatgtctttttttttttttttttttttgagacagagtctcactctgtcacccaggctggagtgcagtggcatgatctcagctcactgcaacctccacttcccgggttcaagcgattcttatacctcagcctcccgagcagctggaattacaggcacccaccaccacacctggctaattttttgtatttttagtagagacaggcttttgccatgttgcctaggctggtcttgaactcctgacctcaggtgatccacccacctcagtctcccaaagtgctgggattacaggtgtgagccaccacacccg

SEQ ID NO: 21091 - DNA, 601 bp, Human
agcaatgagaagttactgaggggtattttaagcaggagagtgaattatctgattgcattttaaaaatcattctgtagcaatggatgcagaaaggtcagttaggggattcttgcagccttgcacaagagggatggtgtcggcttggacaagggtaatagtaatgagagagaagcacactaaatctcattccatctaaacaacctctcccagtctcacccactagcacacatcaagcagccagggtcgaaacctaggagcagacacgatacaccaaagcctaataacctgcttcatgtgcctwcacgcctctcaggaaagggaaagaaactccaaaactcagatcagaaacacttgttaacaacagctctcaaaaagggatcgctttgaaagcagaaggagatactcacggtcccatgggttcccaactcggatctgtgcataggcctttttaagtctgtttacaacctcatcatggatgctttcatgtataaactaaacgaaaaaagatattcaagggcatagtatgataaatgcacacatttttaaacaatgaataatttccttgatagttactgaaatactgtaatctctaaaaatataa

SEQ ID NO: 21092 - DNA, 601 bp, Human
gagcactgacagtgacccagcaacaaagaagaaggaagatgtaggtaggcctctatgaggaggaggcatgttagcagagccatccccactctgggtgaagaatgtttccagcagacagcacagtaggatagagcctggcatgcctggaacactgaaaggatgttggagaaggtggagctctgggagcaagagggaaaatagacacagaaaggctggtgagaaggcaagcggggcaggaggcagagagcagaccaggaaggatcgggagcctgcaaaaaagaagaaatcaagaggactctcrgttttaatctaaaagcaggcctggcgcaatggctcacacctgtaatcttagcactttgggaggcccaggcaggcagactgcttgaggtcaggtgttcgagaccagcctggccaacgtggcaaaaccctgtctctactaaaaatatgaaaatcagtcaagcgtggtggaatgcacctgtaatcccagctattcgagaggctgaggcaggagaactgcttgaacccaggaggcggaggctgcagtgagctgagatcaagccactgcactccagcctgagcaacagagtgaaactgtgtctca

SEQ ID NO: 21093 - DNA, 601 bp, Human
gaggacatacgtgatctccatcccaatactcaactccgtaattgtagtgcaaaagcagccataaatgacatgcaaatgagtgggtatgtgccgagaaacttttttttacagaaacaggcagagccaagtctgtttgccaatctctagtttaaaggaatggctatcaattactcaaagcactgcactcaaaatatagggtcagtttactcattacagtgtgaccattctctaaggaaacatcacagtctcagtagttggtgtataattcaagggggaagagaatgatgctgtcctatgttayggctgctggggactagagcactgacagtgacccagcaacaaagaagaaggaagatgtaggtaggcctctatgaggaggaggcatgttagcagagccatccccactctgggtgaagaatgtttccagcagacagcacagtaggatagagcctggcatgcctggaacactgaaaggatgttggagaaggtggagctctgggagcaagagggaaaatagacacagaaaggctggtgagaaggcaagcggggcaggaggcagagagcagaccaggaaggatcgggagcctgcaaaaaagaagaa

SEQ ID NO: 21094 - DNA, 601 bp, Human
aaaataaccaataaatagattataattgctctgaatacaaagtctcctactgtacttgaaaaggaattttcctttccatacaaatattaaggacccaattcaaaagcaaccatgactccgtttcttctatgtccttccagaaatgtcccatgcattttctgctgtctttttttaaaatatggaatactttttaaaatacggatatgaatttgcatatcatcattgtgcataagccatgctaatcttctctgtatctttccaattttagtatatgtgctgccaaagcaagcattgttgtcaytctttaaaacgtgtatttctggctgggcacggtggctcacgcctgtaatcccagcactttgggaggccaaggacagtggatcacgaagtcagaagttccagaccagcctggccaacatggtgaaaccccttctctactaaaaatacaaaaattagctgggcatggtaatgggtgcctgtaatcccagctactcgggaggctgagacaggagaatcgcttgaacctgggaggcgaggttgcagtgagctgagatcacgccactgcactccagcctgggcaacagagcaagacgcaggagcc

SEQ ID NO: 21095 - DNA, 601 bp, Human
tgctttgttgtccaagctgcagtgcagtgacatcatcatgactcattgcagcctcgaacttgtgggctcaagcaatcctcccacctcagcctcccaagtagctagcactacatgtgcatgccaccatactcagctaatttttttttgagacagggtctcactatgttgtccaggtgggtcttgaattcctggcctcaagcaatcctcccaccacagcctcccaaagtgctgagattgcaggtgtgagccactgcacctggcaatatgtgttaatttcttttttaatgcttatgatatgtatttttttattccttgccttaactgactttttaaaataaccaataaatagattataattgctctgaatacaaagtctcctactgtacttgaaaaggaattttcctttccatacaaatattaaggacccaattcaaaagcaaccatgactccgtttcttctatgtccttccagaaatgtcccatgcattttctgctgtctttttttaaaatatggaatactttttaaaatacggatatgaatttgcatatcatcattgtgcataagccatgctaatcttctctgtatctttccaattttagta

SEQ ID NO: 21096 - DNA, 601 bp, Human
aaggtgactctatggcctacacagcccaggattaagatgacacaggaaatgaggaccacacacttcataaactccaacactagtccactacccaatctggtttccctggcagctagcttggcatgctatagagttttaaagtgtttatctcatattttatcctgaaccttcatatatctactattcagattactttctaaaaccctcttaaaggttcatccagtgaaatttaatccaccatcattttcctcttatcatttatttcaacattaggctagcgaacagaatgcatttttacctkgaatttaaagacatagagaatcggagcaaaagtctctgtgtgtgcaatggacgcatcgtggccaagacctgtcacaattgtcggttctacataatttccagggcgatccataacctaatgcagagaaatgaaataaaaagaatgaaagcattttgttttctaggacttggggtcagaggatgcaatctttgcctacatttataaagaaaaaaattagcatcatttataggtgaattatttctccaaaataacttccaatcatgaaagaaaattctctcttcctgatattggttctaactt

SEQ ID NO: 21097 - DNA, 601 bp, Human
ataaggttatttcagaatataaggagtgtttcagtctcttggtcagccttttctaaaagctactactggtttttctttgctgcccaacatggaaaaggagaaatgattctctacgtaccaaaggcacctccaatctcagccccacttgttggaatgttgacatttacaatgccacagtctgatcctttaggtctgtgtaaaaagggaggcatggtgagagcaatgaacaggaaattaaaaacaaacaaaaataaataaaaaatctaaaccaaagctcaaaggctttcaatactgaaaaackgattttagactacagcagtttttttaagtccactcaccacataaatcagacttatataaattttcaaaatagacaaagttgtacccaagccagcgaaagattctgcccagatctttggtaaagatgctacttgaaagtccctgttttacttcattattccatgcaaagacctcttcttcattctaaaaggagagacattggaagctgtaagatgttatagtgttcaagtcaaagttcactgacattaaactcatttcctgaagtgtaccagtataatttcagtgtacaaaaggaaaccaa

SEQ ID NO: 21098 - DNA, 601 bp, Human
actaatgatataaacttttacaagtattaatgcatgtttgttttgcttctatatttaaaaaaaacaagcaatctgttttattttactttggatcatttttaataaataatacttaatatacaatggttagggagagtttttaaggaaaaactactaccaagtttcagcattaataatgtatggcttattaagaggaaacaggagcagggcccagtgaaaagaaacaactttgtattccatctagtgaaaaagagtatgtttaacatttatatgcctactttgcaaataaaaaccagaatakttcatataaaattttctggctttgaagcagggattcttaatcttttttgggtctggaaacttctccccagaaaacaaatgccaccatttcaggggttcacacatttcaagttaagggcctctgctctaacctgatgctgcctctgaggagatgacgcaggactctatgcgataactttgaatacagaatgtaagctttttcagatatgttagatcacataaggttatttcagaatataaggagtgtttcagtctcttggtcagccttttctaaaagctactactggtttttctttgctgc

SEQ ID NO: 21099 - DNA, 601 bp, Human
aactgaaaacagcaaagtccatgcatcaaatagtaattgtagtatctgctctaaaaatgtaaaagaatgccactaatgatataaacttttacaagtattaatgcatgtttgttttgcttctatatttaaaaaaaacaagcaatctgttttattttactttggatcatttttaataaataatacttaatatacaatggttagggagagtttttaaggaaaaactactaccaagtttcagcattaataatgtatggcttattaagaggaaacaggagcagggcccagtgaaaagaaacaactytgtattccatctagtgaaaaagagtatgtttaacatttatatgcctactttgcaaataaaaaccagaatatttcatataaaattttctggctttgaagcagggattcttaatcttttttgggtctggaaacttctccccagaaaacaaatgccaccatttcaggggttcacacatttcaagttaagggcctctgctctaacctgatgctgcctctgaggagatgacgcaggactctatgcgataactttgaatacagaatgtaagctttttcagatatgttagatcacataaggttattt

SEQ ID NO: 21100 - DNA, 601 bp, Human
gcttgagcctgggaggtggtggctgcagtgagctgtgatcgcgccactgcactccagcctgggcaacatagcaagcccccagctcaaaaaaaaaaaaaaaaaaaaaaaaggaatagtcaatcagagagagcaggcatgggttggaaacagggattaaattagtacaaaaggagaagatagacactcatgcattcaggcaactgcacagtggagtgcaggggcaaggggtgaactgaaaacagcaaagtccatgcatcaaatagtaattgtagtatctgctctaaaaatgtaaaagaatgcyactaatgatataaacttttacaagtattaatgcatgtttgttttgcttctatatttaaaaaaaacaagcaatctgttttattttactttggatcatttttaataaataatacttaatatacaatggttagggagagtttttaaggaaaaactactaccaagtttcagcattaataatgtatggcttattaagaggaaacaggagcagggcccagtgaaaagaaacaactttgtattccatctagtgaaaaagagtatgtttaacatttatatgcctactttgcaaataaaaaccagaata

SEQ ID NO: 21101 - DNA, 601 bp, Human
aggcacatgcctgtaatctcagctattcatgaggctgaggcgagaggaatgcttgagcctgggaggtggtggctgcagtgagctgtgatcgcgccactgcactccagcctgggcaacatagcaagcccccagctcaaaaaaaaaaaaaaaaaaaaaaaaggaatagtcaatcagagagagcaggcatgggttggaaacagggattaaattagtacaaaaggagaagatagacactcatgcattcaggcaactgcacagtggagtgcaggggcaaggggtgaactgaaaacagcaaagtccrtgcatcaaatagtaattgtagtatctgctctaaaaatgtaaaagaatgccactaatgatataaacttttacaagtattaatgcatgtttgttttgcttctatatttaaaaaaaacaagcaatctgttttattttactttggatcatttttaataaataatacttaatatacaatggttagggagagtttttaaggaaaaactactaccaagtttcagcattaataatgtatggcttattaagaggaaacaggagcagggcccagtgaaaagaaacaactttgtattccatctagtgaaaa

SEQ ID NO: 21102 - DNA, 601 bp, Human
aatagtcaattgactgggtgcagtggctcatgcctgtaatcccaacactctgggaagccaaggcaggtggatggcttgagcccaggaatttaagaccagcctgggcaacatagtgagggcctgtttctaaaaaaaaaaaaaaaaaaaaaaaatttaattagctggtgtggaggcacatgcctgtaatctcagctattcatgaggctgaggcgagaggaatgcttgagcctgggaggtggtggctgcagtgagctgtgatcgcgccactgcactccagcctgggcaacatagcaagcccccrgctcaaaaaaaaaaaaaaaaaaaaaaaaggaatagtcaatcagagagagcaggcatgggttggaaacagggattaaattagtacaaaaggagaagatagacactcatgcattcaggcaactgcacagtggagtgcaggggcaaggggtgaactgaaaacagcaaagtccatgcatcaaatagtaattgtagtatctgctctaaaaatgtaaaagaatgccactaatgatataaacttttacaagtattaatgcatgtttgttttgcttctatatttaaaaaaaacaagcaatctgtttta

SEQ ID NO: 21103 - DNA, 601 bp, Human
accaaaactttaaaaattaattataaaagcttaaatgaagaatagtcaattgactgggtgcagtggctcatgcctgtaatcccaacactctgggaagccaaggcaggtggatggcttgagcccaggaatttaagaccagcctgggcaacatagtgagggcctgtttctaaaaaaaaaaaaaaaaaaaaaaaatttaattagctggtgtggaggcacatgcctgtaatctcagctattcatgaggctgaggcgagaggaatgcttgagcctgggaggtggtggctgcagtgagctgtgatcrcgccactgcactccagcctgggcaacatagcaagcccccagctcaaaaaaaaaaaaaaaaaaaaaaaaggaatagtcaatcagagagagcaggcatgggttggaaacagggattaaattagtacaaaaggagaagatagacactcatgcattcaggcaactgcacagtggagtgcaggggcaaggggtgaactgaaaacagcaaagtccatgcatcaaatagtaattgtagtatctgctctaaaaatgtaaaagaatgccactaatgatataaacttttacaagtattaatgcatgtttg

SEQ ID NO: 21104 - DNA, 601 bp, Human
ttttgtaatttttgtagagatgagtttttgccatgttgcccaggctggtcttgaactcctgagctcaagcgatcggcccacctctgcctcccaaagtgccaggatttcaggtgtaagctactgtgcctgggcaccaaaactttaaaaattaattataaaagcttaaatgaagaatagtcaattgactgggtgcagtggctcatgcctgtaatcccaacactctgggaagccaaggcaggtggatggcttgagcccaggaatttaagaccagcctgggcaacatagtgagggcctgtttctaaaaaaaaaaaaaaaaaaaaaaaatttaattagctggtgtggaggcacatgcctgtaatctcagctattcatgaggctgaggcgagaggaatgcttgagcctgggaggtggtggctgcagtgagctgtgatcgcgccactgcactccagcctgggcaacatagcaagcccccagctcaaaaaaaaaaaaaaaaaaaaaaaaggaatagtcaatcagagagagcaggcatgggttggaaacagggattaaattagtacaaaaggagaagatagacactcatgcattcaggcaactgcacagt

SEQ ID NO: 21105 - DNA, 601 bp, Human
ttttccattataagacttttttaaaacttttatttatttagagacagggtcacactcactctgtcacccaggctgaagtgcagtggtgggatcatggcttactacagcctcaaactcttggcttaagcgagccttgcacctcagactcacgagtagctgggaatacaagtgtgtgacaccacaactggctagttttttttaatttttgtagagacagggtcctaccatgttgcccaggttcatctcaaactcctgggcttaagcaattacaggcatgagccaccatgcccagcccaaaacttttttttttttttttgcgggggaagacagggtctcactctgtccccagacttgagtgcactggcacaatcttggctcactgcaacctctgcctcccagactcaagagatcctcccacctcagcctcccaagtagctgggactacaggcacacaccatcatgcctagctaatttttgtaatttttgtagagatgagtttttgccatgttgcccaggctggtcttgaactcctgagctcaagcgatcggcccacctctgcctcccaaagtgccaggatttcaggtgtaagctactgtgcctg

SEQ ID NO: 21106 - DNA, 601 bp, Human
aatacataatgtctaaagctttcaaggagacagcagtgaaagcacactagttagaaaaactgacatcaattcaaaggtaaatttgcttttttcttttagtaaaaagaatctcggccaggtacggtggctcacacctgtattcccagcactttgggaggccgaggcaggtggatcacaaggtcaggagttcaagaccagcctggccaacatggtgaaaccccatctctactaaaaaaatacaaaaattagccaggcatggtggcgtgcacctgtaatcccagctactcacgaggttgaggcrggagaattgcttgaactggggaggtggatgttgcagcgagccaatattgcaccactgcactccagcataggcaacagagcaagattccgtctcaaaaaaaaaaaaagaatctcaatgtagcctctgggaaaggaggaggagaagaaaagtatgagcaaaactactttttccattataagacttttttaaaacttttatttatttagagacagggtcacactcactctgtcacccaggctgaagtgcagtggtgggatcatggcttactacagcctcaaactcttggcttaagcgagcctt

SEQ ID NO: 21107 - DNA, 601 bp, Human
ttgctagccaggcctgcagggccctccctgcctctgttttctactgcttcttcagtatgcaagggtactgggtgcatccaagaagaaaatgaaaagaacagcttcttctactttctcctactagttgactcccatgtgtcctgctcctggacagaaacctctatcataacagagggtcaatacataatgtctaaagctttcaaggagacagcagtgaaagcacactagttagaaaaactgacatcaattcaaaggtaaatttgcttttttcttttagtaaaaagaatctcggccaggtacrgtggctcacacctgtattcccagcactttgggaggccgaggcaggtggatcacaaggtcaggagttcaagaccagcctggccaacatggtgaaaccccatctctactaaaaaaatacaaaaattagccaggcatggtggcgtgcacctgtaatcccagctactcacgaggttgaggcgggagaattgcttgaactggggaggtggatgttgcagcgagccaatattgcaccactgcactccagcataggcaacagagcaagattccgtctcaaaaaaaaaaaaagaatctcaatgtagcc

SEQ ID NO: 21108 - DNA, 601 bp, Human
aagaaacaagtcctagtcaaaatctcccaagagactccctatccagctacgcacatgctgggggaatgaactaatccactttcaaggaccatgctcactattctgagagctggtaccccactgccctccgcttgctagccaggcctgcagggccctccctgcctctgttttctactgcttcttcagtatgcaagggtactgggtgcatccaagaagaaaatgaaaagaacagcttcttctactttctcctactagttgactcccatgtgtcctgctcctggacagaaacctctatcataayagagggtcaatacataatgtctaaagctttcaaggagacagcagtgaaagcacactagttagaaaaactgacatcaattcaaaggtaaatttgcttttttcttttagtaaaaagaatctcggccaggtacggtggctcacacctgtattcccagcactttgggaggccgaggcaggtggatcacaaggtcaggagttcaagaccagcctggccaacatggtgaaaccccatctctactaaaaaaatacaaaaattagccaggcatggtggcgtgcacctgtaatcccagctactcacgag

SEQ ID NO: 21109 - DNA, 601 bp, Human
caagataacacctcatgggtcttccccaacaaactcttttattgcacttgaataaaagctatttctacccaaggtgggcagggagggagtagggagagagcgaataaaagcagaagaaacaagtcctagtcaaaatctcccaagagactccctatccagctacgcacatgctgggggaatgaactaatccactttcaaggaccatgctcactattctgagagctggtaccccactgccctccgcttgctagccaggcctgcagggccctccctgcctctgttttctactgcttcttcagtmtgcaagggtactgggtgcatccaagaagaaaatgaaaagaacagcttcttctactttctcctactagttgactcccatgtgtcctgctcctggacagaaacctctatcataacagagggtcaatacataatgtctaaagctttcaaggagacagcagtgaaagcacactagttagaaaaactgacatcaattcaaaggtaaatttgcttttttcttttagtaaaaagaatctcggccaggtacggtggctcacacctgtattcccagcactttgggaggccgaggcaggtggatcacaag

SEQ ID NO: 21110 - DNA, 601 bp, Human
aggcatcactgccagactccctgccaccaccagtgtgcttttctcctcctagagaaataaaaaataatatcatatcttctgagcagtttccatgtgggctcatagttggtatcaatgaaaagaagataccaaaaggacaccagaacaacctgattatttactttacatttagcccacaatatctcccctgcaaacaaatcaaagacagagaccaagagaccaaaacaaacagaaaaaaggaattaagagggaaaataaaatataaggaattaagaagaaatggaaacagaaagaaacggtaaaaaaaaaaaaaaatcccattagctgggcgtggtggtgcatgcctgtaaccccaccgtgcccagcccacacatgttattcatagtttttcttttgagcagggcacaagaatatgggagctgtaactgtcttctttatctctctcaataacttgtattaaattatcagggaaaacacaaatattcccatttgatagaaatacattaagaaaatataacaattttgaaataaaagcttctctattaactactcacctggtctttctcatgagagggaaagaatctccattaaatgggttcca

SEQ ID NO: 21111 - DNA, 601 bp, Human
gtatctactgcaaagacttctgttttctcctcggttctgtattttcccaaattcctaccctggtacgtactatttttttctaattacaaaataatcattaacttttaaaaagccatgtacaactagttgacataataaaaatccacctaactcatcttttagtaactatggctatgttgtaacaattttattttgatttttaaaaaaggaatctcttgatttaatcagggctttggggtcatagggggattagtcactgtcacagtcataataatgcatttattcagggaaaactttaatyttctttgtcttctccaaaaacagctgctggaacacctcaaattaagggatgttcatctaaaacacctttactgaaacttgattccttgggccagaggaaggtctttactgtagttgatagtactagtgggaaaaaataacagaattaatgacagtacatacataacagaagattttcatgcccacttttaaaatgtagcagatctgtatatattaacaaggcaagatctccaagttacaactttttaagacaaacctttaagataaaagacaatgttagtatggatcccgttttatttaa

SEQ ID NO: 21112 - DNA, 601 bp, Human
agttttgcttgcctcccaccccccgtagctccttacataagatggccttccttcttccccagtctccaggacccggcacccccaggacagtagggctggaggatgctgactgcacctccaactccctctaccaacaccccaggcttccgaggggagcaggtagagcctcagaacacccaccaaggccagcaacctatgctgactcaggcctagctctgcctcccccatccaagtggcctaaattcccggtgaggggagccacccccgacttcctgggcttgctgggccccgatgaatgttscccagggatacatgcctggccaggccctggacccagtctagggatgttgggcagcagcaagcgctgagaaagttctctctctgcccttgaccttggctctgacctccactcccatctcccagactgttaaaggacccagttcttacagttctccggcatccagggctgggccaagaggggaagctgtgaggggcagccagaggcaggcatggcaggatcaggtccccagccggggcggcagacctgcccagggaagccttgagcttccccttccccacccggctcccggcaggctccctg

SEQ ID NO: 21113 - DNA, 601 bp, Human
gcaaggccttgttaaaacagaactttgcagccgggcatagtggcccacgaggtcagaagttcaagaccagcctggccaacataatgaaaccccatctctactaaaaatacaaaaattagctgggcatggtggcgtgcgcctgtagtcccagctactcgggaggctgaggcaggagaatcgcttgaaccttggaggcggaggttgcggtcagccgagattgcgccactgcactccagcctgggcaacagagcgagactccatttcaaaaaacaaaaaaaaagagttttgcttgcctcccacyccccgtagctccttacataagatggccttccttcttccccagtctccaggacccggcacccccaggacagtagggctggaggatgctgactgcacctccaactccctctaccaacaccccaggcttccgaggggagcaggtagagcctcagaacacccaccaaggccagcaacctatgctgactcaggcctagctctgcctcccccatccaagtggcctaaattcccggtgaggggagccacccccgacttcctgggcttgctgggccccgatgaatgttgcccagggatacatgcctgg

SEQ ID NO: 21114 - DNA, 601 bp, Human
ccaccctgggccaagcacacagccccacccccaccgcccagggcctggggaccttcgcccaccctccttccgctaggcctgggagtgttttcgaaagtgccccaagagctctcaagaaggggtggaggagggctggaccacctgtgccctcacccagctccccactcctcctcgatctgccggacagggacagggtgaaggcagaccctcctctcctccacctctaggggcaaggccttgttaaaacagaactttgcagccgggcatagtggcccacgaggtcagaagttcaagaccagcytggccaacataatgaaaccccatctctactaaaaatacaaaaattagctgggcatggtggcgtgcgcctgtagtcccagctactcgggaggctgaggcaggagaatcgcttgaaccttggaggcggaggttgcggtcagccgagattgcgccactgcactccagcctgggcaacagagcgagactccatttcaaaaaacaaaaaaaaagagttttgcttgcctcccaccccccgtagctccttacataagatggccttccttcttccccagtctccaggacccggcacccccaggacagt

SEQ ID NO: 21115 - DNA, 601 bp, Human
gcacccctcccagagccccatttccccaggcagcctccagccctcagaaggagagcgccctcctcctatcccagagggagggggtgtgcagccccaccctgggccaagcacacagccccacccccaccgcccagggcctggggaccttcgcccaccctccttccgctaggcctgggagtgttttcgaaagtgccccaagagctctcaagaaggggtggaggagggctggaccacctgtgccctcacccagctccccactcctcctcgatctgccggacagggacagggtgaaggcagaccytcctctcctccacctctaggggcaaggccttgttaaaacagaactttgcagccgggcatagtggcccacgaggtcagaagttcaagaccagcctggccaacataatgaaaccccatctctactaaaaatacaaaaattagctgggcatggtggcgtgcgcctgtagtcccagctactcgggaggctgaggcaggagaatcgcttgaaccttggaggcggaggttgcggtcagccgagattgcgccactgcactccagcctgggcaacagagcgagactccatttcaaaaaacaaaaaaaa

SEQ ID NO: 21116 - DNA, 601 bp, Human
catcacagtggtatgaaggctggcctctaagttcacggactggatatttcagctctgagcactaattctaaaatctatcacttactcctaccttcacctccagtttcaaatctactccgacactgacttccctaactctggtggtagcaatggctaacactttgtaaggtggacactaatctaagcatattttccctattttacaaaccaggagactaagggctaggaagcttcacgaaggcagtaagtggcaaagcttggatttgcacccaaatattcggtgtctttaaccacttggatkccagattatagcaagtaggagccatttctaggacctggcagaggttagcaccctcaccatcttcagtgtgatatgtggtttcaaattggaactatgaaggacagctatgtcccagctgggctggggagctgtgggggacgtccccacctcaggccccctctagagtcctgatctaaccagtcaagaccttggagtcagagctcaaaagagctgtgagctaatgcccaaaatacaagtctgggaccccgaaagagaaaaatagggggccgagaccacatgtgagttcacagcagacattgg

SEQ ID NO: 21117 - DNA, 601 bp, Human
cgagctgccgtcccacctgccccatggtgctgctaggttgcagaggtaaggtgaccatctctgggtcggcaggggcagccgccccttcagcctcctgttcctgctgatggtggtaaaaaacgtagctgcggaaaacctcctctgtgtcctgggctacctgctcctcagaagcagagggcagggcaggctctccgcactcctgcctgggaggacctgggccttgccccgaagccatttttcaggtctcagtggaggacgggatcagcctgccgggatcctggcccaacccgggtggctcagsagggtggagatggaggtcccgaggggctggcggctgctgctcccaggggctgagtgggagcccagtttccaggaatgggcgtcagtgcattcccagcatctggatgtagcctttacttgtccctgtgcagcctgagggacccgcgagactccagtgatcatagaggtgccagccaaaaatgtttttttaaatgatgttctcagtatctacgttcttagcaactaagatgatggatcttagttatagaactcataactaataaaatcctctaggactacagttcatacaccaaaaaataga

SEQ ID NO: 21118 - DNA, 601 bp, Human
gggctgcaggtgctgcaacatggtctggaactctgagtcatagcgtcggttgatgtcgtccccaatgatggcgagctgccgtcccacctgccccatggtgctgctaggttgcagaggtaaggtgaccatctctgggtcggcaggggcagccgccccttcagcctcctgttcctgctgatggtggtaaaaaacgtagctgcggaaaacctcctctgtgtcctgggctacctgctcctcagaagcagagggcagggcaggctctccgcactcctgcctgggaggacctgggccttgccccgargccatttttcaggtctcagtggaggacgggatcagcctgccgggatcctggcccaacccgggtggctcagcagggtggagatggaggtcccgaggggctggcggctgctgctcccaggggctgagtgggagcccagtttccaggaatgggcgtcagtgcattcccagcatctggatgtagcctttacttgtccctgtgcagcctgagggacccgcgagactccagtgatcatagaggtgccagccaaaaatgtttttttaaatgatgttctcagtatctacgttcttagcaactaagatg

SEQ ID NO: 21119 - DNA, 601 bp, Human
ctggcccaggaagccagtcaggccacgctggtagatgtgtagggccagacggtagctgaagcccagaagagccaccacacggccccaattgatgccactctcaaacaggctggaggcaatcttggtgaagtactcataggcattctctgccgtgggctgcaggtgctgcaacatggtctggaactctgagtcatagcgtcggttgatgtcgtccccaatgatggcgagctgccgtcccacctgccccatggtgctgctaggttgcagaggtaaggtgaccatctctgggtcggcaggggcrgccgccccttcagcctcctgttcctgctgatggtggtaaaaaacgtagctgcggaaaacctcctctgtgtcctgggctacctgctcctcagaagcagagggcagggcaggctctccgcactcctgcctgggaggacctgggccttgccccgaagccatttttcaggtctcagtggaggacgggatcagcctgccgggatcctggcccaacccgggtggctcagcagggtggagatggaggtcccgaggggctggcggctgctgctcccaggggctgagtgggagcccagtttccaggaat

SEQ ID NO: 21120 - DNA, 601 bp, Human
acccccggccccaccctgcagccctgccccgggacccccgccctccaaacccacagcccccaccccaggacccccgcccacctctacagccttcactgcaggacccccccaaatccacagcccccgccctaggacaccccccaaatccacagctccccacccctgatgtctgacaccgccccagcacaaccctcatatccccacccctgatgtctggccctgccccagcaaaacccgcattgccccgcccctgctgcctgaccccgcccagcacaaccctcatagtcccgcccttgctgcytgaccccgcccagcacaaccctcatatctccactcggatgtctgaccccgctcagcacaaccctcatagccccgcccctgatgccttgaccccgcccagcaccctcacagccctgcccctgctccttgaccccacccagatatcacggccccacccctgctgcttgactccaccccagcagcatcatagccctgcccctgctgcctcgaccctgctcagcaacctgatagccccacccctgctgtcttggctctaccactgcaccattgtagctccacccctgcaccctcatagccccac

SEQ ID NO: 21121 - DNA, 601 bp, Human
ggcgcctgggtccccacctctgtaagggcccgagtcctcccctccataagggggcgcctgggtccccacctctgtaagggcccgagtcctcccctccataagggggcgcctgggtccccacctctgaaagggcccgagtcctcccctccataagggggcgcctgggtccccacctctgaaagggcccgagtcctcccctccataagggggcgcctgggtccccacctctgaaaggcttgggttcaaccctctgtaagcgggataagggggcctgggtcccccctctgtatgggagcctgcrtctccccctccgtcagggcccgcggcgctcaccaccatgccattgatggacacccagcagttgcgcgggaagtcctgcagcatgggcaccaggaactgcaggcagccgtcccagtggcagagcagcagcatcatgctgatgagattgcagatcctcatcaccgcgctggccaggtcataggtcatgtggaagatctgcaggaaggcgccgtgagcccaccctacccgctgaccccccggcccccaccttcagagccccagccccgtgcgcccccactgcgggagctcctggccccctccc

SEQ ID NO: 21122 - DNA, 601 bp, Human
tgtctctccctctgtaaggcggcctgggtccccgcctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgwaagggcccgagtcctcccctccataagggggcgcctgggtccccacctctgaaagggcccgagtcctcccctccataagggggcgcctgggtccccacctctgaaaggcttgggttcaaccctctgtaagcgggataagggggcctgggtcccccctctgtatgggagcctgcgtctccccctccgtcagggcccgcggcgctcaccaccatgccattgatggacacccagcagttgcgcgggaagtcctgcagcatgggcaccaggaactgcaggcagccgtcccagtggcagagcagc

SEQ ID NO: 21123 - DNA, 601 bp, Human
ggcctgagtcctcccgtgtaagggggtcttgtccccacccctgaagggcctgtgtctctccctctgtaaggcggcctgggtccccgcctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgwaagggcccgagtcctcccctccataagggggcgcctgggtccccacctctgaaagggcccgagtcctcccctccataagggggcgcctgggtccccacctctgaaagggcccgagtcctcccctccataagggggcgcctgggtccccacctctgaaaggcttgggttcaaccctctgtaagcgggataagggggcctgggtcccccctctgtatgggagcctgcgtctccccctccgtcagggcccgcggcgctcaccaccatgccattgatggacacccagcagttgcgcgggaagtc

SEQ ID NO: 21124 - DNA, 601 bp, Human
ggggtttgtggtaagctgagatcgtgccactgcactccagcccggacgacagagtgaaactcagtctcaaaaaaaaataagtaaataaaataataataattaatgtgggttaattaaaagggaaatccattggaaaacgcgctaagcagatgtctgggtgacaggactcatcataaccacactcagcttctctccacggacgatcccaggcctgaaaggttccaagtggctgtttcagacccccagggacattaaggggccagtgccggggctgcagtcctgggtccccctctgtaaagargcctgagtcctcccgtgtaagggggtcttgtccccacccctgaagggcctgtgtctctccctctgtaaggcggcctgggtccccgcctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgtaagggcccgagtcctcccctccataagggggcgcctgggtccccacctctgt

SEQ ID NO: 21125 - DNA, 601 bp, Human
attatccaggcgtggtggcgggcgcctgtagtcccagctactcgggaggctgaggcaagagaatcccttgaaccctgggaggtggggtttgtggtaagctgagatcgtgccactgcactccagcccggacgacagagtgaaactcagtctcaaaaaaaaataagtaaataaaataataataattaatgtgggttaattaaaagggaaatccattggaaaacgcgctaagcagatgtctgggtgacaggactcatcataaccacactcagcttctctccacggacgatcccaggcctgaaargttccaagtggctgtttcagacccccagggacattaaggggccagtgccggggctgcagtcctgggtccccctctgtaaagaggcctgagtcctcccgtgtaagggggtcttgtccccacccctgaagggcctgtgtctctccctctgtaaggcggcctgggtccccgcctctgtaagggcccgagtcctcccctccataagggggcgcctgggtccccacctctgtaagggcccgagtcctcccctccataagggggcgcctgggtccccacctctgtaagggcccgagtcctcccctc

SEQ ID NO: 21126 - DNA, 601 bp, Human
ggctcactgcagcctcaacttctgggctcaagggatccaaccaggccgggcgcggtggctcacgcctgtaatcccaacactttgggaggccgaggcaggcggatcacctgaggtcaggagttcgagaccagcctgaccaacatggcgagaccctgtctctactaaaagtacgaaaattatccaggcgtggtggcgggcgcctgtagtcccagctactcgggaggctgaggcaagagaatcccttgaaccctgggaggtggggtttgtggtaagctgagatcgtgccactgcactccagccyggacgacagagtgaaactcagtctcaaaaaaaaataagtaaataaaataataataattaatgtgggttaattaaaagggaaatccattggaaaacgcgctaagcagatgtctgggtgacaggactcatcataaccacactcagcttctctccacggacgatcccaggcctgaaaggttccaagtggctgtttcagacccccagggacattaaggggccagtgccggggctgcagtcctgggtccccctctgtaaagaggcctgagtcctcccgtgtaagggggtcttgtccccacccctg

SEQ ID NO: 21127 - DNA, 601 bp, Human
aggctggagtgcagtggtgcaatcatggctcactgcagcctcaacttctgggctcaagggatccaaccaggccgggcgcggtggctcacgcctgtaatcccaacactttgggaggccgaggcaggcggatcacctgaggtcaggagttcgagaccagcctgaccaacatggcgagaccctgtctctactaaaagtacgaaaattatccaggcgtggtggcgggcgcctgtagtcccagctactcgggaggctgaggcaagagaatcccttgaaccctgggaggtggggtttgtggtaagcygagatcgtgccactgcactccagcccggacgacagagtgaaactcagtctcaaaaaaaaataagtaaataaaataataataattaatgtgggttaattaaaagggaaatccattggaaaacgcgctaagcagatgtctgggtgacaggactcatcataaccacactcagcttctctccacggacgatcccaggcctgaaaggttccaagtggctgtttcagacccccagggacattaaggggccagtgccggggctgcagtcctgggtccccctctgtaaagaggcctgagtcctcccgt

SEQ ID NO: 21128 - DNA, 601 bp, Human
ctttggcatggtgataccactttcccatttcagggccatgttgtaaatttttctttagttgttagagatcaggtcttgctctgtgacccaggctggagtgcagtggtgcaatcatggctcactgcagcctcaacttctgggctcaagggatccaaccaggccgggcgcggtggctcacgcctgtaatcccaacactttgggaggccgaggcaggcggatcacctgaggtcaggagttcgagaccagcctgaccaacatggcgagaccctgtctctactaaaagtacgaaaattatccaggygtggtggcgggcgcctgtagtcccagctactcgggaggctgaggcaagagaatcccttgaaccctgggaggtggggtttgtggtaagctgagatcgtgccactgcactccagcccggacgacagagtgaaactcagtctcaaaaaaaaataagtaaataaaataataataattaatgtgggttaattaaaagggaaatccattggaaaacgcgctaagcagatgtctgggtgacaggactcatcataaccacactcagcttctctccacggacgatcccaggcctgaaaggttccaagtg

SEQ ID NO: 21129 - DNA, 601 bp, Human
atgagcagccatgcctggcccatttattatttctttggcatggtgataccactttcccatttcagggccatgttgtaaatttttctttagttgttagagatcaggtcttgctctgtgacccaggctggagtgcagtggtgcaatcatggctcactgcagcctcaacttctgggctcaagggatccaaccaggccgggcgcggtggctcacgcctgtaatcccaacactttgggaggccgaggcaggcggatcacctgaggtcaggagttcgagaccagcctgaccaacatggcgagacccygtctctactaaaagtacgaaaattatccaggcgtggtggcgggcgcctgtagtcccagctactcgggaggctgaggcaagagaatcccttgaaccctgggaggtggggtttgtggtaagctgagatcgtgccactgcactccagcccggacgacagagtgaaactcagtctcaaaaaaaaataagtaaataaaataataataattaatgtgggttaattaaaagggaaatccattggaaaacgcgctaagcagatgtctgggtgacaggactcatcataaccacactcagcttctctcca

SEQ ID NO: 21130 - DNA, 601 bp, Human
ttcaagcgattctcctgcctcagcctctacagtagctggaattacaggtgcgcgccaccacgcctggctaattttttatttttagtagagacagggtttcagcatgttggtcaggctggtctcaaactcctgacctcaggtgatccgcctgcctcagcctcccaaagtgctgggattacaggcatgagcagccatgcctggcccatttattatttctttggcatggtgataccactttcccatttcagggccatgttgtaaatttttctttagttgttagagatcaggtcttgctctgtgrcccaggctggagtgcagtggtgcaatcatggctcactgcagcctcaacttctgggctcaagggatccaaccaggccgggcgcggtggctcacgcctgtaatcccaacactttgggaggccgaggcaggcggatcacctgaggtcaggagttcgagaccagcctgaccaacatggcgagaccctgtctctactaaaagtacgaaaattatccaggcgtggtggcgggcgcctgtagtcccagctactcgggaggctgaggcaagagaatcccttgaaccctgggaggtggggtttgtggta

SEQ ID NO: 21131 - DNA, 601 bp, Human
aagtgctgggattacaggcgtgagccaccgcgcccggcctcttccttttgcttttacttatttttatttatttctttgagacaaagtctggctctgttgcccaggctggagtgcaatggtgtgatctcagctcgctgcaacctctgctcccgggttcaagcgattctcctgcctcagcctctacagtagctggaattacaggtgcgcgccaccacgcctggctaattttttatttttagtagagacagggtttcagcatgttggtcaggctggtctcaaactcctgacctcaggtgatccrcctgcctcagcctcccaaagtgctgggattacaggcatgagcagccatgcctggcccatttattatttctttggcatggtgataccactttcccatttcagggccatgttgtaaatttttctttagttgttagagatcaggtcttgctctgtgacccaggctggagtgcagtggtgcaatcatggctcactgcagcctcaacttctgggctcaagggatccaaccaggccgggcgcggtggctcacgcctgtaatcccaacactttgggaggccgaggcaggcggatcacctgaggtcag

SEQ ID NO: 21132 - DNA, 601 bp, Human
gcagaggggcagggcgggcagagacaccaggccggcccaggaggtcctgccgcaccaagtcctcagctgacccggccgggaaaggggagccgcggggctctgttcaggaaatgggaccgcatgtgcgggtggcagccagacaatgggctgcctcagcctgggcagctgtgccaggctctggggaggggcactggcgggtcttccctctgtagctcctgaccccatcaatgcccacctgctctgtgtccaaaccaaacacatcccaagtcccatatgtggctggacgctggggcacagcacyccccaggcagggacaaaggctcactggccactaacctgactgtagcggccgagggctcccataactaacccttcttaacagtcagcacatctcagctaggaagcaaggagtatctgggacctaacttcatttattattccttcttttttgacggagtttcgctcttgtcgcccaggctggagtgcagtggcacgatcttggctcacggcaacctccgctcccgggttcaagcgattctcctgccttggcctctcaagtagctgggattacaggcatgcgccaccacgccaaactagtttt

SEQ ID NO: 21133 - DNA, 601 bp, Human
gtacccgatgcacagcatgtggctcatggccttgaagagtgcgaaggagtacagttcactccacgagtggttctgcaaggccagcaggaggggcggtggtgggcaggtgctcacgccccaggagccctcggtcctcaagggcccagcgcccaccctctgccaagcactggaggtggtgagctccccatgttcagaggtaaccaagagaaatggagacccaggtagatgacatggtttgcacacttgtcacagtgagttggcaggagggccagggctgattctacctgcccgcttcactccyggggaaactgagaccccaagggcgagagtctgggtcccgccttttgcagcctctgagatcagagcatctgtgaggtcaagagggggcaaaagttccagggagcatctgggccagagcagaggggcagggcgggcagagacaccaggccggcccaggaggtcctgccgcaccaagtcctcagctgacccggccgggaaaggggagccgcggggctctgttcaggaaatgggaccgcatgtgcgggtggcagccagacaatgggctgcctcagcctgggcagctgtgccaggctctggggag

SEQ ID NO: 21134 - DNA, 601 bp, Human
gccgatgaacatggcgtagcaggtggcacccacaatcatgctgagcatggtcagccagatgtccgtcatgctctcgggcgcctgccggccgtacccgatgcacagcatgtggctcatggccttgaagagtgcgaaggagtacagttcactccacgagtggttctgcaaggccagcaggaggggcggtggtgggcaggtgctcacgccccaggagccctcggtcctcaagggcccagcgcccaccctctgccaagcactggaggtggtgagctccccatgttcagaggtaaccaagagaaayggagacccaggtagatgacatggtttgcacacttgtcacagtgagttggcaggagggccagggctgattctacctgcccgcttcactcctggggaaactgagaccccaagggcgagagtctgggtcccgccttttgcagcctctgagatcagagcatctgtgaggtcaagagggggcaaaagttccagggagcatctgggccagagcagaggggcagggcgggcagagacaccaggccggcccaggaggtcctgccgcaccaagtcctcagctgacccggccgggaaaggggagccgcgg

SEQ ID NO: 21135 - DNA, 601 bp, Human
gcccgcctcccccatcagaacccaggccggggcccgcctccctcagaccttctcctggtactggcgccgcgaggagtccagcgactggatgagggcagtggcgtggccgatgaacatggcgtagcaggtggcacccacaatcatgctgagcatggtcagccagatgtccgtcatgctctcgggcgcctgccggccgtacccgatgcacagcatgtggctcatggccttgaagagtgcgaaggagtacagttcactccacgagtggttctgcaaggccagcaggaggggcggtggtgggcakgtgctcacgccccaggagccctcggtcctcaagggcccagcgcccaccctctgccaagcactggaggtggtgagctccccatgttcagaggtaaccaagagaaatggagacccaggtagatgacatggtttgcacacttgtcacagtgagttggcaggagggccagggctgattctacctgcccgcttcactcctggggaaactgagaccccaagggcgagagtctgggtcccgccttttgcagcctctgagatcagagcatctgtgaggtcaagagggggcaaaagttccagggagcat

SEQ ID NO: 21136 - DNA, 601 bp, Human
ccctccatcagaccccagggcctggcctgactctctctcagaccccagatccaggcccgcctcccccatcagaacccaggccggggcccgcctccctcagaccttctcctggtactggcgccgcgaggagtccagcgactggatgagggcagtggcgtggccgatgaacatggcgtagcaggtggcacccacaatcatgctgagcatggtcagccagatgtccgtcatgctctcgggcgcctgccggccgtacccgatgcacagcatgtggctcatggccttgaagagtgcgaaggagtasagttcactccacgagtggttctgcaaggccagcaggaggggcggtggtgggcaggtgctcacgccccaggagccctcggtcctcaagggcccagcgcccaccctctgccaagcactggaggtggtgagctccccatgttcagaggtaaccaagagaaatggagacccaggtagatgacatggtttgcacacttgtcacagtgagttggcaggagggccagggctgattctacctgcccgcttcactcctggggaaactgagaccccaagggcgagagtctgggtcccgccttttgcagcc

SEQ ID NO: 21137 - DNA, 601 bp, Human
ggccaccggcgtgtcctgaagcaaccccaggcctctcagaccccgccaggcccttccctaacccagccccatcctgagccggcctagagacccccaggtgggcccagcctcctggcaatgccccttcagcccgggggcttcccgatgtccaaagactgaccctgtcctgccctgatcccaactcaccccttcctgcccagcctgcatcccctccccagcccccgccccacgtccatctccaggctctggacctccctccctgtcacagggtcagagaacctctcaccaccggccgtttctyctcctaatcacagccacagacccccagggtcccctgctccccatcacgcggtctctgccctgagcgcgccacttgaagctgagtgaagggctgagactgcctctcccctcagaccccggggccgggcccgcccctcccctcagaccccgggacaaggactacctccgccctcagaccccagggcaaggcctccctccagcctcagaccccaggaccgggcctgcctccctccatcagaccccagggcctggcctgactctctctcagaccccagatccaggcccgcctcccccatcagaa

SEQ ID NO: 21138 - DNA, 601 bp, Human
ccaatggggccaatcctaatctccctccacccctcccagctcccccgtgtcccctccactgccaagcctaggattaacccaatggacgctgcaggccagaggccgcatctgagcagtggggcagccttgctctccctgaagcctggccctgactgccggccaccggcgtgtcctgaagcaaccccaggcctctcagaccccgccaggcccttccctaacccagccccatcctgagccggcctagagacccccaggtgggcccagcctcctggcaatgccccttcagcccgggggcttcccratgtccaaagactgaccctgtcctgccctgatcccaactcaccccttcctgcccagcctgcatcccctccccagcccccgccccacgtccatctccaggctctggacctccctccctgtcacagggtcagagaacctctcaccaccggccgtttctcctcctaatcacagccacagacccccagggtcccctgctccccatcacgcggtctctgccctgagcgcgccacttgaagctgagtgaagggctgagactgcctctcccctcagaccccggggccgggcccgcccctcccctcag

SEQ ID NO: 21139 - DNA, 601 bp, Human
ttggctcccagccaggaccagccagccgcctaacatggggaaactgaggcacagagtggtgcatgaggcccaactccaggggctgccaatggggccaatcctaatctccctccacccctcccagctcccccgtgtcccctccactgccaagcctaggattaacccaatggacgctgcaggccagaggccgcatctgagcagtggggcagccttgctctccctgaagcctggccctgactgccggccaccggcgtgtcctgaagcaaccccaggcctctcagaccccgccaggcccttcccyaacccagccccatcctgagccggcctagagacccccaggtgggcccagcctcctggcaatgccccttcagcccgggggcttcccgatgtccaaagactgaccctgtcctgccctgatcccaactcaccccttcctgcccagcctgcatcccctccccagcccccgccccacgtccatctccaggctctggacctccctccctgtcacagggtcagagaacctctcaccaccggccgtttctcctcctaatcacagccacagacccccagggtcccctgctccccatcacgcggtctctgc

SEQ ID NO: 21140 - DNA, 601 bp, Human
catagtagtcgtggatcttctggcggaagtcagctggcagcttgtggaaggacatgtactgctccacctgcttgtactgtggggaggaggcgaggctgggtcagacaccgcccccggcctgcagcgggcacaggggcacctgcttgtactgtggggaggcgaggctgggtcagacaccgcccccagcctgcagcgggcacacgggcacctgcttgtgggtcagacagccccccggcctgtggcggggagataggccttcacacctgcttgtactgtggggggtcagggctgggtcagacamagcccccgcccacagcggggagacaggcctccgccacacacaggggcggccagattcaacaagagcaaataaacatgcttctatttaaatcaaagttgaattcgtttcaatgataaattccattttttttttctgagacactgtctcgctctgtggcccacgctggagtgcagtggtgcaatcacagctcactgcagcctccgcctatgggctcaagcaatcctcccacctcagcctcctgagtagcaggggactgcaggtgtgcgccaccacgcctggctgattcttttattttttgtg

SEQ ID NO: 21141 - DNA, 601 bp, Human
ctcgcccaggatgctgtcctcgtcaaacatcttgccctggtaacggtgctcatagtagtcgtggatcttctggcggaagtcagctggcagcttgtggaaggacatgtactgctccacctgcttgtactgtggggaggaggcgaggctgggtcagacaccgcccccggcctgcagcgggcacaggggcacctgcttgtactgtggggaggcgaggctgggtcagacaccgcccccagcctgcagcgggcacacgggcacctgcttgtgggtcagacagccccccggcctgtggcggggagakaggccttcacacctgcttgtactgtggggggtcagggctgggtcagacaaagcccccgcccacagcggggagacaggcctccgccacacacaggggcggccagattcaacaagagcaaataaacatgcttctatttaaatcaaagttgaattcgtttcaatgataaattccattttttttttctgagacactgtctcgctctgtggcccacgctggagtgcagtggtgcaatcacagctcactgcagcctccgcctatgggctcaagcaatcctcccacctcagcctcctgagtagcagg

SEQ ID NO: 21142 - DNA, 601 bp, Human
gaggctcacggggcggggaggggagggtgtgtacgcaggtctagctcgagtccctcctgctgcagcctaggcacctcgcctccctcagggaccggctcctgggctccaggagagggaggccggccctgtaccggaggctgcctcccgcccgcccggcgcccgcctcacctcccgcaggggcccgttgagctcgcccaggatgctgtcctcgtcaaacatcttgccctggtaacggtgctcatagtagtcgtggatcttctggcggaagtcagctggcagcttgtggaaggacatgtactgytccacctgcttgtactgtggggaggaggcgaggctgggtcagacaccgcccccggcctgcagcgggcacaggggcacctgcttgtactgtggggaggcgaggctgggtcagacaccgcccccagcctgcagcgggcacacgggcacctgcttgtgggtcagacagccccccggcctgtggcggggagataggccttcacacctgcttgtactgtggggggtcagggctgggtcagacaaagcccccgcccacagcggggagacaggcctccgccacacacaggggcggccagattcaaca

SEQ ID NO: 21143 - DNA, 601 bp, Human
ggaaggatcctccccaggggctccgggggggtagcacggcccggcccacgccttgatgttgggcttccggcctccaggacggtgggaggccgaatctccgctgttcaagccactcagcctgtgggtatttgttcccgcaaccctgggaaacttgcccagggtcactcaggctaccggaacagagctgggagttaaacccgctccaatcagcctcagtgcccccaggacctggtgctcagcggggcctctgcggctcctccctccccaccccctgccctgcttctgccccgccctgtcaggyacagacccaggcagttctgctaagggggcagcgggaagcaaggcgggggtggcgggggtcctgggggtgcagaggctcacggggcggggaggggagggtgtgtacgcaggtctagctcgagtccctcctgctgcagcctaggcacctcgcctccctcagggaccggctcctgggctccaggagagggaggccggccctgtaccggaggctgcctcccgcccgcccggcgcccgcctcacctcccgcaggggcccgttgagctcgcccaggatgctgtcctcgtcaaacatcttgccctgg

SEQ ID NO: 21144 - DNA, 601 bp, Human
aggctgtgagcagatggaggcagagatcagggagatcaatctgcaagccgagggcgcctggagccccagacgccggaagaggcaggaaggatcctccccaggggctccgggggggtagcacggcccggcccacgccttgatgttgggcttccggcctccaggacggtgggaggccgaatctccgctgttcaagccactcagcctgtgggtatttgttcccgcaaccctgggaaacttgcccagggtcactcaggctaccggaacagagctgggagttaaacccgctccaatcagcctcagygcccccaggacctggtgctcagcggggcctctgcggctcctccctccccaccccctgccctgcttctgccccgccctgtcaggcacagacccaggcagttctgctaagggggcagcgggaagcaaggcgggggtggcgggggtcctgggggtgcagaggctcacggggcggggaggggagggtgtgtacgcaggtctagctcgagtccctcctgctgcagcctaggcacctcgcctccctcagggaccggctcctgggctccaggagagggaggccggccctgtaccggaggctgcctcc

SEQ ID NO: 21145 - DNA, 601 bp, Human
tgtggaaatagggtctctgcagacatggcccagttaaggcgaggccacgaggaaccgggtgggccctgatccaacgacggatgaatttacaagaagagacagagacacacaggggagaaggctgtgagcagatggaggcagagatcagggagatcaatctgcaagccgagggcgcctggagccccagacgccggaagaggcaggaaggatcctccccaggggctccgggggggtagcacggcccggcccacgccttgatgttgggcttccggcctccaggacggtgggaggccgaatctcygctgttcaagccactcagcctgtgggtatttgttcccgcaaccctgggaaacttgcccagggtcactcaggctaccggaacagagctgggagttaaacccgctccaatcagcctcagtgcccccaggacctggtgctcagcggggcctctgcggctcctccctccccaccccctgccctgcttctgccccgccctgtcaggcacagacccaggcagttctgctaagggggcagcgggaagcaaggcgggggtggcgggggtcctgggggtgcagaggctcacggggcggggaggggaggg

SEQ ID NO: 21146 - DNA, 601 bp, Human
tgggaccttcaagcacacggcagggcacgcagtcggcgctcaataactgtttgatgtgtgttgtgggttgaactacatctcccagaaagacaggctgacatcctgacccccggttcctgtgaataggaccttatgtggaaatagggtctctgcagacatggcccagttaaggcgaggccacgaggaaccgggtgggccctgatccaacgacggatgaatttacaagaagagacagagacacacaggggagaaggctgtgagcagatggaggcagagatcagggagatcaatctgcaagccragggcgcctggagccccagacgccggaagaggcaggaaggatcctccccaggggctccgggggggtagcacggcccggcccacgccttgatgttgggcttccggcctccaggacggtgggaggccgaatctccgctgttcaagccactcagcctgtgggtatttgttcccgcaaccctgggaaacttgcccagggtcactcaggctaccggaacagagctgggagttaaacccgctccaatcagcctcagtgcccccaggacctggtgctcagcggggcctctgcggctcctccctcccc

SEQ ID NO: 21147 - DNA, 601 bp, Human
caccgcattttatgcattttgtggtctgagtgttatatctctacaaatgaatgaatggaaaccgtagtcatcaaatgcaattaaacattcttggcgaagcgaaccgcagtgtgtgcctcctgggagcaacgggtgtacacgcccccccagaggcattcccggggcccgaggtccctagtgtcaggcccgtcctgcccgcctcctcgcccagctcctccagcccctcctcggggcctctgcccgagccaggtgctacaccggggacaccctgcctggctcacacacggccttgctgatgtcrcctccccgtcctcgtccctccccgcttcccagagctgctctctgctgcctgcgtgatcacggccgccatccctaggccccgcttcctgagggtgggaccttcaagcacacggcagggcacgcagtcggcgctcaataactgtttgatgtgtgttgtgggttgaactacatctcccagaaagacaggctgacatcctgacccccggttcctgtgaataggaccttatgtggaaatagggtctctgcagacatggcccagttaaggcgaggccacgaggaaccgggtgggccctgatccaac

SEQ ID NO: 21148 - DNA, 601 bp, Human
tgttaatactaaaagccaccgcattttatgcattttgtggtctgagtgttatatctctacaaatgaatgaatggaaaccgtagtcatcaaatgcaattaaacattcttggcgaagcgaaccgcagtgtgtgcctcctgggagcaacgggtgtacacgcccccccagaggcattcccggggcccgaggtccctagtgtcaggcccgtcctgcccgcctcctcgcccagctcctccagcccctcctcggggcctctgcccgagccaggtgctacaccggggacaccctgcctggctcacacayggccttgctgatgtcgcctccccgtcctcgtccctccccgcttcccagagctgctctctgctgcctgcgtgatcacggccgccatccctaggccccgcttcctgagggtgggaccttcaagcacacggcagggcacgcagtcggcgctcaataactgtttgatgtgtgttgtgggttgaactacatctcccagaaagacaggctgacatcctgacccccggttcctgtgaataggaccttatgtggaaatagggtctctgcagacatggcccagttaaggcgaggccacgaggaaccggg

SEQ ID NO: 21149 - DNA, 601 bp, Human
ctgttaatactaaaagccaccgcattttatgcattttgtggtctgagtgttatatctctacaaatgaatgaatggaaaccgtagtcatcaaatgcaattaaacattcttggcgaagcgaaccgcagtgtgtgcctcctgggagcaacgggtgtacacgcccccccagaggcattcccggggcccgaggtccctagtgtcaggcccgtcctgcccgcctcctcgcccagctcctccagcccctcctcggggcctctgcccgagccaggtgctacaccggggacaccctgcctggctcacacrcggccttgctgatgtcgcctccccgtcctcgtccctccccgcttcccagagctgctctctgctgcctgcgtgatcacggccgccatccctaggccccgcttcctgagggtgggaccttcaagcacacggcagggcacgcagtcggcgctcaataactgtttgatgtgtgttgtgggttgaactacatctcccagaaagacaggctgacatcctgacccccggttcctgtgaataggaccttatgtggaaatagggtctctgcagacatggcccagttaaggcgaggccacgaggaaccgg

SEQ ID NO: 21150 - DNA, 601 bp, Human
tccctttagggaccagctatcgagctgtgcccttatgacctggggcactttttggtactttttttttttttgagacggagtctcgctctgttgtccaggctggagtgcagtggcacaatctcggctcactgcaaccgccgcctcttgggttcaagcgattctcctgtctcagcctccagagtagctgggattacaggcgcccaccaccacgcccggctaattttgtatttttagtggagacggggcttcaccatgttggccaggctggtctcgaactcctgacctcaggtgatctgcccgyctcggcctctgaaagtgctgggattacaggcgtgagccaccacgcctggccatatgtgggtttaaagatttgactttgcaactcctaaacacctaaataatgactaagtagcgtgggttgccaggggctggggacggggagtgagctggtgactaacaccccaggtctccttttgggcccatgagaatgttctggagtgaggctgtggtatcgggtgcagcactctgttaatactaaaagccaccgcattttatgcattttgtggtctgagtgttatatctctacaaatgaatgaatgga

SEQ ID NO: 21151 - DNA, 601 bp, Human
ttccctttagggaccagctatcgagctgtgcccttatgacctggggcactttttggtactttttttttttttgagacggagtctcgctctgttgtccaggctggagtgcagtggcacaatctcggctcactgcaaccgccgcctcttgggttcaagcgattctcctgtctcagcctccagagtagctgggattacaggcgcccaccaccacgcccggctaattttgtatttttagtggagacggggcttcaccatgttggccaggctggtctcgaactcctgacctcaggtgatctgcccrcctcggcctctgaaagtgctgggattacaggcgtgagccaccacgcctggccatatgtgggtttaaagatttgactttgcaactcctaaacacctaaataatgactaagtagcgtgggttgccaggggctggggacggggagtgagctggtgactaacaccccaggtctccttttgggcccatgagaatgttctggagtgaggctgtggtatcgggtgcagcactctgttaatactaaaagccaccgcattttatgcattttgtggtctgagtgttatatctctacaaatgaatgaatgg

SEQ ID NO: 21152 - DNA, 601 bp, Human
cgtgtgatctcagcatttgcggaggccgaggcgggaggatcgcttgagcccaggagttctagaccagcctgggcaacacggtaagacccccgtctctaccggaaaaaaaaaaaacagccaggcgtggtggtgcaggaagtcgaggctgcagtgagccgtgatccccacaccactgccctccagcctgagcgcagaacaagaccctgactcaaaaaaaaaaaaaaagaaaatgggggaaaaataaggccgggcgtggtggctcacacctgtaatcccagcactctgggaggccaaggtgggyggatcgcctgatgtcaggagttcgagaccagcctggccaacatggtgaaaccccatctctactaaaaatacaaaaaattagctgggtgtggtggcgggtgcctgtaatcccagctactcgggaggctgaggcacgagtctcttgaacccgggaggaggaggttacagtgaaccaagatcacacaactgcactggagcccgggtgacagagcgagactccatctctctctctctctcacacacacacacacacacacacacaccagtggaaagctacattcggtcagactatcaggtgatt

SEQ ID NO: 21153 - DNA, 601 bp, Human
aaagtgctgggactacaggcgtgagccaccgcgcctggcagtaaacaggtatttaatgcctgctgtgtacatggagcaggtatcactgtgcaccaagtatgcatgtgtaccacctgtatacgctgattatgtaatgactgcctccagtgtgccacaggcataccgaaaacacctgcctgtacacagcctgtgctgagcacctgctgtatacagaagttataacctaagcacctgatactcaggaacgggttgcatactcactgtatagagcaagttgtggagagcttcctactgtacaccrgggagctccctgacaccactccgtcgcacctgtcctgcgtttcagccatggtcttcattcccattcccacgaacagcagcatgagccgccatctctctggcgcctacatccagtcatcagggctctgcccctccctgccccagagactgcccccctgagaggccaggtcaccgtctccctcctggacacggcccgccttggcggatacaatctgaccaggtcctccgcccacctagaaccctccatggctccctgatgctcctgatttagtctaaactctccctgccgcccactgggccc

SEQ ID NO: 21154 - DNA, 601 bp, Human
cctgcgggcagaagctcatggccgccgcctgctgcagcgtggcgatggccgaggtgacctgcggcggcggcggcggcggcgggaagaggcccacgcgctgacccagctcggcctgctgcaccatctcgcggtcgtacttgacgatctcctggatgatggcgttctcctggttgttgaatacgcccgagttgaggtcatgctgcaccttgtgcaggaggatggaattcttcttgcctgcgggagagggggcgttagcgtgtgcacagggagcgcctgctgcgtacagcgggcaccgagcacytactctgcaccgcgggtgcgcacacagtgcttgccgtgtagagcaagcatgcatttaccacctactgtatacaataagcacatatgtagcatctctggcctatagtatggatattgagtacctgccatatacaggctgagcacctgctatgcacagccagcatgcatgaagcacctgcatacagaaagcagggcttttgttttgctttgtttctgagacggagtcttgctctgtcgcccgggctggagtgcagtggcgcgatctcggcccactgcaaggtccacctcccgggttcacacc

SEQ ID NO: 21155 - DNA, 601 bp, Human
ggcgatgggagtgggcgcagggcgataaggggggacggccggggacgcggagggggctgccccgccggccctgcccgtccgtccaactacggctacctacgtctcgtctatggcttctgggcggactggcggccggggcagcgcaatggcatggctttggtctggatgacggccccgcccccggcccgcctgggcccgcggggcggtcggcgagggtcacaagttggacgagaggcgcgagcgcgcggagtcctgggggtccaggccgccggcggcgccgggtgaggccgagtccctgcgrtccgggctgggcgcggcggcccgggcagcgggcgtgggccccaagcgcggtgtggagctgctggccgggcgtgtggaggccgcggggccgggggcgccgtgaggcagcgagggctgcgaggcggacagtgggcgcgacgcgcggctcaggcggcgcgcgggcagggcgggcccagcaaggggggcggcgggcaggccgccgtagggcgaggtccgcggtgcccgggggctggcgggcgcgcccggggggctggcggggggcgggggcccgggtgaggcggcggcaggtgcgggccccggg

SEQ ID NO: 21156 - DNA, 601 bp, Human
ctgggccgccccgtccctgtcttacagctaggggaactgaggcactgaggtgaagggagccccctcgcacgcgaggccgccgccgggggcaggggcgatgggagtgggcgcagggcgataaggggggacggccggggacgcggagggggctgccccgccggccctgcccgtccgtccaactacggctacctacgtctcgtctatggcttctgggcggactggcggccggggcagcgcaatggcatggctttggtctggatgacggccccgcccccggcccgcctgggcccgcggggcggtyggcgagggtcacaagttggacgagaggcgcgagcgcgcggagtcctgggggtccaggccgccggcggcgccgggtgaggccgagtccctgcggtccgggctgggcgcggcggcccgggcagcgggcgtgggccccaagcgcggtgtggagctgctggccgggcgtgtggaggccgcggggccgggggcgccgtgaggcagcgagggctgcgaggcggacagtgggcgcgacgcgcggctcaggcggcgcgcgggcagggcgggcccagcaaggggggcggcgggcaggccgccgtagggc

SEQ ID NO: 21157 - DNA, 601 bp, Human
ctcagccactgggccgccccgtccctgtcttacagctaggggaactgaggcactgaggtgaagggagccccctcgcacgcgaggccgccgccgggggcaggggcgatgggagtgggcgcagggcgataaggggggacggccggggacgcggagggggctgccccgccggccctgcccgtccgtccaactacggctacctacgtctcgtctatggcttctgggcggactggcggccggggcagcgcaatggcatggctttggtctggatgacggccccgcccccggcccgcctgggcccgcrgggcggtcggcgagggtcacaagttggacgagaggcgcgagcgcgcggagtcctgggggtccaggccgccggcggcgccgggtgaggccgagtccctgcggtccgggctgggcgcggcggcccgggcagcgggcgtgggccccaagcgcggtgtggagctgctggccgggcgtgtggaggccgcggggccgggggcgccgtgaggcagcgagggctgcgaggcggacagtgggcgcgacgcgcggctcaggcggcgcgcgggcagggcgggcccagcaaggggggcggcgggcaggccgc

SEQ ID NO: 21158 - DNA, 601 bp, Human
gggctccacagccggctcctctcagccactgggccgccccgtccctgtcttacagctaggggaactgaggcactgaggtgaagggagccccctcgcacgcgaggccgccgccgggggcaggggcgatgggagtgggcgcagggcgataaggggggacggccggggacgcggagggggctgccccgccggccctgcccgtccgtccaactacggctacctacgtctcgtctatggcttctgggcggactggcggccggggcagcgcaatggcatggctttggtctggatgacggccccgccyccggcccgcctgggcccgcggggcggtcggcgagggtcacaagttggacgagaggcgcgagcgcgcggagtcctgggggtccaggccgccggcggcgccgggtgaggccgagtccctgcggtccgggctgggcgcggcggcccgggcagcgggcgtgggccccaagcgcggtgtggagctgctggccgggcgtgtggaggccgcggggccgggggcgccgtgaggcagcgagggctgcgaggcggacagtgggcgcgacgcgcggctcaggcggcgcgcgggcagggcgggcccagcaag

SEQ ID NO: 21159 - DNA, 601 bp, Human
acttagaaaacgatcctcctcggacgggggccacctagagggtggggggcgggcggggctccacagccggctcctctcagccactgggccgccccgtccctgtcttacagctaggggaactgaggcactgaggtgaagggagccccctcgcacgcgaggccgccgccgggggcaggggcgatgggagtgggcgcagggcgataaggggggacggccggggacgcggagggggctgccccgccggccctgcccgtccgtccaactacggctacctacgtctcgtctatggcttctgggcggrctggcggccggggcagcgcaatggcatggctttggtctggatgacggccccgcccccggcccgcctgggcccgcggggcggtcggcgagggtcacaagttggacgagaggcgcgagcgcgcggagtcctgggggtccaggccgccggcggcgccgggtgaggccgagtccctgcggtccgggctgggcgcggcggcccgggcagcgggcgtgggccccaagcgcggtgtggagctgctggccgggcgtgtggaggccgcggggccgggggcgccgtgaggcagcgagggctgcgaggcgg

SEQ ID NO: 21160 - DNA, 601 bp, Human
agcgttccacctacttcttcagctgacaccccgtgagccttgtcagtgtgtaaataaagctcttttgccacccccaggagccactgtcttcaggaagggtgcacgccctgcgggtctcgggcaatcacacgcggccaggcttggcgccaatgctgtcgtttattgcgcggaatgggggtgtgggggttaatggggcgtggggggccacggtgggggcactgctgcctcggctcgtcagtacattcatcacggcggcgggaccccagcctcccccccgcgccctgcgcagccaggcctgccyctcggtgccagtgctggagggaggcggggtgctgctccccgaggtcaccgggggacgcgcgcggacgggggccgggccggttattgcgtgagcgcgatgggggcagcgggaagccggcgggccaagtattgcacttagaaaacgatcctcctcggacgggggccacctagagggtggggggcgggcggggctccacagccggctcctctcagccactgggccgccccgtccctgtcttacagctaggggaactgaggcactgaggtgaagggagccccctcgcacgcgaggccgccgccg

SEQ ID NO: 21161 - DNA, 601 bp, Human
acgcctgtaatcccagcactttaggaggccgaggcgggcagatcacgaggtcaggagatcgagaccatcctggctaacacggtgaaaccctgtctctactaaaaatacaaaaaaattagcagggtgtggtagtgggcgcctgtagtcccagctacttaggaggctgaggcaggagaatagcgtgaacccaggaggcagagcttgcagtgagccgagatcacgccactgcactccaggctgggtgacagagcgagactctgtatcaaaaaaaataataaaataaaataagagagagagagaatgatttcactacaaagaattcatgatgtgtatattcatataagtatattcataaagtgaaaaaactggcttcaattaactgttttacataaattatttttagttttcaacaatttgaataattgactctgttgttgtattttgatagttttgtttttatttcattcttgttttattcagtgttttgtttagtctttgacctgttaaagacctgattttgaaattattcaactgccaggtagagactatgcctagcactggcatggaaccaagcctgcacatactaacccattgctgcatt

SEQ ID NO: 21162 - DNA, 601 bp, Human
ttttgtttacgtattcctttgtcagtggacacttgggttgcttctacattttagctattgtgaacagtgctgttatgaacacgtatatgcaagtagctattcaaaaccctctttcaattcttttgggtatatgcacagaaatggaaatgttgcatcatatggtaactctattttttaattttttgaggaactgccatactgttttccacaatggctgtaccattttacagtcccatcaacagtccataatttctccacatcctaacaaacacttattttctgttgttttttgttttgtttygttttttatagttgccatcctaattggtctgaagtgggtcaatgtcagtttggagtttctgtcctttatagttgaaagcaatcctaattaacactgagcccaatccacaaagcatagttttctgtgcccttgcatgcccatgccatgggttcaagtcaagtattctgcaaccatgaaaggtgctagaaaaccacaccaccatgttctcagaaggaaaagtcatgaactgaaggaagaacaattatgaatatgtgcaatgtgcacgcattcccagatctaaaaccatctgcgaagctgagt

SEQ ID NO: 21163 - DNA, 601 bp, Human
ctgaccaatgggatggaagcataagtctgcatggcagcttccagatacctttagttaagtaatggtgtatgtgtgccctttgcttctcattttccatccctccctccatcctgcagccagaaacatgaatgctgccttcctgaaggccacacagaaccttctgtgtcccaaatactgtacagtatcatactaaactgcttaaccagaccttacacaagtgagaaacattttggataagccaatgacattttgggtaagccagtatcactttttctgtttttttctgtatggcggggggggsgggggggggctggtaaaatatgcataacataaaatttaccaacttaaccattttaagtatatagtttgtgatagtaaatatattcataatgttgtgaaatcaccaccaacatccatctctgtaactcctcatcttgcaaagcagaaactccgtacccattaaatactaactccccattctccccatccccagccctgacaaccaccattgtactttctgtctctatgaatttgacacgcccaactaccttatgtaagtggaatcatacaatatttttctttctgtgactggcttgtttca

SEQ ID NO: 21164 - DNA, 601 bp, Human
ctctgaatgaggcaaattggagcataagtaccccagctccttttctgctcggctgggacaactgaggcacgtccctctgggggaattttaaccctaaagagagaagattccttcctaaatgacccctccccttgttccctataaggtgacccccaaatgcccattcttgctgtcttcaggagttagagcccttgatgcttggcaagcacaggactgcctagaagggagactacattttccagcattccttgcagccaggtgtggccatgtgactaagtcctgaccaatgggatggaagcayaagtctgcatggcagcttccagatacctttagttaagtaatggtgtatgtgtgccctttgcttctcattttccatccctccctccatcctgcagccagaaacatgaatgctgccttcctgaaggccacacagaaccttctgtgtcccaaatactgtacagtatcatactaaactgcttaaccagaccttacacaagtgagaaacattttggataagccaatgacattttgggtaagccagtatcactttttctgtttttttctgtatggcggggggggggggggggggctggtaaaatat

SEQ ID NO: 21165 - DNA, 601 bp, Human
gcctgcccacatgtgcaccatgctcattcctggcacctcagtctcctttaatcttcacaagaacaacggggccgatgaataaactaagacttgccttatttcactgtttctcttcagttacattggtgcattggtcttcacaaagccctgggtggcggaggcacaaaaaaaaaaagagaaaaaaaccagccctcaccagacatggtggctcacacctgtactcccagcactttgggaggccaaggcaggtggattgcttgagcccaggagttggagaccagcctgggcaacatagtaagaycccatttctacaaaaaatgttaaaattagctatgtgttgtggtgtgcacctgtggtcccagctacttaggaggctgaggtagaaggatcacttgaacctgggggtgggtggaggctgcagtgagttgtgatcaccccactgtactccagcctgagtgatagaatgagacaccgtgtcaaaaataaataagttaaaaggccctggagggcacaaaggaccctttccaacaccagcagtgtttcaaagaatgggctttggtcaatcaggcctggactaaaagacttactggctatgtgtgac

SEQ ID NO: 21166 - DNA, 601 bp, Human
atttgcatcatttccagtgtttgtggggtttttttgcttcttgtttgtttgtttgtttagagatggggtcttgctatgttgttcaggctggtattgaactcctagcctcaaatgatcctcccacctcagcctcctgagtagttgggattacaagcatgagccacctcactcagcaccagtctatatatatatatatcatgctatgcatcacaaaattccataaaccatattaggaaaagcgttactatcccgttgagcagctagagagtcaaatgaagaaggaatttggaacataatatcrgaagtaatttttcatatccaaatcttaatttttacaaattggcttcaacaatctctatcctttcccactagtttcaatgccacaggctcacataatcattagcagagctccgtcttggaaatatattcactaattatctgagattatctgtatttgaaattcattatcagattgatagggagaataaggaaacaaaccaattttttaaatgggcaagaggcttgagcagatacttccacaaagaagctatccggatggcagatgagtgcacaaaaggatgctcggcttccttagtcatta

SEQ ID NO: 21167 - DNA, 601 bp, Human
gggttgagagccaccatcctaggtcatccttgcaaaaagacccagaaccttatctcttgaccaatccaccaaaccctgtagtagcctaccacaacctctgaagaagggacactgtaacatttttatttaatttgcatcatttccagtgtttgtggggtttttttgcttcttgtttgtttgtttgtttagagatggggtcttgctatgttgttcaggctggtattgaactcctagcctcaaatgatcctcccacctcagcctcctgagtagttgggattacaagcatgagccacctcactcrgcaccagtctatatatatatatatcatgctatgcatcacaaaattccataaaccatattaggaaaagcgttactatcccgttgagcagctagagagtcaaatgaagaaggaatttggaacataatatcagaagtaatttttcatatccaaatcttaatttttacaaattggcttcaacaatctctatcctttcccactagtttcaatgccacaggctcacataatcattagcagagctccgtcttggaaatatattcactaattatctgagattatctgtatttgaaattcattatcaga

SEQ ID NO: 21168 - DNA, 601 bp, Human
cggtgaccccagcccatgggttctgcagcagtttgtctgcatgctggtcctgggcaggccccacctcctgggaagcccattcattgactcggagcatggcctgagcacacatctaggcaatttcaagtgtcaccagggttgagagccaccatcctaggtcatccttgcaaaaagacccagaaccttatctcttgaccaatccaccaaaccctgtagtagcctaccacaacctctgaagaagggacactgtaacatttttatttaatttgcatcatttccagtgtttgtggggtttttttgyttcttgtttgtttgtttgtttagagatggggtcttgctatgttgttcaggctggtattgaactcctagcctcaaatgatcctcccacctcagcctcctgagtagttgggattacaagcatgagccacctcactcagcaccagtctatatatatatatatcatgctatgcatcacaaaattccataaaccatattaggaaaagcgttactatcccgttgagcagctagagagtcaaatgaagaaggaatttggaacataatatcagaagtaatttttcatatccaaatcttaatttttaca

SEQ ID NO: 21169 - DNA, 601 bp, Human
cagggttcaaaagtgtcttctaaagcaaatttggggatttctttagctttgtataaaataattaagacgaaaaagttcaggcagccggtgaccccagcccatgggttctgcagcagtttgtctgcatgctggtcctgggcaggccccacctcctgggaagcccattcattgactcggagcatggcctgagcacacatctaggcaatttcaagtgtcaccagggttgagagccaccatcctaggtcatccttgcaaaaagacccagaaccttatctcttgaccaatccaccaaaccctgtastagcctaccacaacctctgaagaagggacactgtaacatttttatttaatttgcatcatttccagtgtttgtggggtttttttgcttcttgtttgtttgtttgtttagagatggggtcttgctatgttgttcaggctggtattgaactcctagcctcaaatgatcctcccacctcagcctcctgagtagttgggattacaagcatgagccacctcactcagcaccagtctatatatatatatatcatgctatgcatcacaaaattccataaaccatattaggaaaagcgttactatcccg

SEQ ID NO: 21170 - DNA, 601 bp, Human
tttttttaggcctttgtagcaacatcagttacatccactaaggagaacaggatcctgaaatggtaactggtgggcaattcagacaagactatcctcatgaatgccaaaaaaagtaactttcctgtcgcttagatgatactttgcagggttcaaaagtgtcttctaaagcaaatttggggatttctttagctttgtataaaataattaagacgaaaaagttcaggcagccggtgaccccagcccatgggttctgcagcagtttgtctgcatgctggtcctgggcaggccccacctcctgggmagcccattcattgactcggagcatggcctgagcacacatctaggcaatttcaagtgtcaccagggttgagagccaccatcctaggtcatccttgcaaaaagacccagaaccttatctcttgaccaatccaccaaaccctgtagtagcctaccacaacctctgaagaagggacactgtaacatttttatttaatttgcatcatttccagtgtttgtggggtttttttgcttcttgtttgtttgtttgtttagagatggggtcttgctatgttgttcaggctggtattgaactcctagcctc

SEQ ID NO: 21171 - DNA, 601 bp, Human
acacctttgagttagagttgggtttgaaaaataaaagtaacatctctggaaaggaatctctgggaaagaaaattaaggcttcaggaaaagtttttttaggcctttgtagcaacatcagttacatccactaaggagaacaggatcctgaaatggtaactggtgggcaattcagacaagactatcctcatgaatgccaaaaaaagtaactttcctgtcgcttagatgatactttgcagggttcaaaagtgtcttctaaagcaaatttggggatttctttagctttgtataaaataattaagaygaaaaagttcaggcagccggtgaccccagcccatgggttctgcagcagtttgtctgcatgctggtcctgggcaggccccacctcctgggaagcccattcattgactcggagcatggcctgagcacacatctaggcaatttcaagtgtcaccagggttgagagccaccatcctaggtcatccttgcaaaaagacccagaaccttatctcttgaccaatccaccaaaccctgtagtagcctaccacaacctctgaagaagggacactgtaacatttttatttaatttgcatcatttccagtg

SEQ ID NO: 21172 - DNA, 601 bp, Human
agtttagtgtctgtatacttatgacttagaagggtcttattacatgggaatagatgatacaattcaaaaggtatgctcggatgtaaaacacctttgagttagagttgggtttgaaaaataaaagtaacatctctggaaaggaatctctgggaaagaaaattaaggcttcaggaaaagtttttttaggcctttgtagcaacatcagttacatccactaaggagaacaggatcctgaaatggtaactggtgggcaattcagacaagactatcctcatgaatgccaaaaaaagtaactttcctrtcgcttagatgatactttgcagggttcaaaagtgtcttctaaagcaaatttggggatttctttagctttgtataaaataattaagacgaaaaagttcaggcagccggtgaccccagcccatgggttctgcagcagtttgtctgcatgctggtcctgggcaggccccacctcctgggaagcccattcattgactcggagcatggcctgagcacacatctaggcaatttcaagtgtcaccagggttgagagccaccatcctaggtcatccttgcaaaaagacccagaaccttatctcttgac

SEQ ID NO: 21173 - DNA, 601 bp, Human
aaacaccttacaaagtggctgcagcaatgacatagacatacaggaaagtgaccgtctaacttgattgtagaattgctaagctaagactcataaagatgtgacactttctcaatcggtgcttctctatcctgagcatgcacacgagtccctgcggatctggctaagatgcagattctgcctcagtgggtctgaggctggactggacactctgcacgtctcacaagcccagacgatgctgatcgatgacatcaaagtcagtttagtgtctgtatacttatgacttagaagggtcttattacawgggaatagatgatacaattcaaaaggtatgctcggatgtaaaacacctttgagttagagttgggtttgaaaaataaaagtaacatctctggaaaggaatctctgggaaagaaaattaaggcttcaggaaaagtttttttaggcctttgtagcaacatcagttacatccactaaggagaacaggatcctgaaatggtaactggtgggcaattcagacaagactatcctcatgaatgccaaaaaaagtaactttcctgtcgcttagatgatactttgcagggttcaaaagtgtcttctaaag

SEQ ID NO: 21174 - DNA, 601 bp, Human
aagaagagacaccagagcccccacccccaccccctgtctgtctgtcacgtgagacacagcaagaaggcagccgtcttcaagccagaaagagagccctcaccagacaccaattctgctggcatcttgatcttggacttccagcacccaggacagtgagaagtaaatgtctgcctgtcggccctcccatctgtagtgtcctgttatagtagcctgagaagactaagccaggcccacagcacagccatcaatgccttttgctttgtcttcaaagtctgaacctccttgggagtgtgacatgccrggaccaagtaccaggagaccagagcttagacctggctgtgccatgaacctactaagagactctagaaaaggatttgactctcaaagcctctgttttcccttctgtgaaagggaaaacctggaatgcacactctcgaagaaaatgaaggctggttggagccgcgagccatacgctgtgctcggatgtcagcgcagcacaaagcaggagccatcagccccagtgggtgaaagggaagtgacgctccagggaatggctagaaggaaatcctctgacctctccacactctgccaagcaggtccc

SEQ ID NO: 21175 - DNA, 601 bp, Human
cagaagcacagatttgaacaagtggaggataaaaatccctatggtgtccgtttcttcttattcttacgaagcttgacctgggcaaaatgaatgcatgatgtagacactggggcagcctaagcctaagactcggtggggagggcatgactcgaaggagtcccaaggggcacctctgaggggccaggaatgagcgtggcacctgtgtcccccagctcaggactctccctgtgtcctggaaaactcctcagtccaggccagagcagagcgcttggccacccactcagaaaaccccgtttctgcmaggaacataggatatgttcagcgtgtgacagctcctcaagctgcatgcgtgtgcctgcgcgtaacacctccatgaaacatgtgggaagccccaatgcacacgcggcagactcgagcgtacctgtgcctgcagctccactctctgcgcctgcaggtgggagagcacctcccggccctcctccagctgactccgcagggcggccacctcccgctccgtcaggagcttctcctgcacagagaaggccagagtcagactcatgggacatgcagagaggaaaagggcagagaaggtgcggggccc

SEQ ID NO: 21176 - DNA, 601 bp, Human
agccagggtttgtctcacaagaaggaggagttttaagtgccttacttggttcctcctgctgcgatcgtcagttcaggggaccaccacagacccgggtttgctttccagcagcccctgagagctgctgcactgtgagttttgtgtggtgcgtgctgggatgggaattaggatgtgaactccaaggtcccaaaatgaaatcctgagcagacatgggggcactggaaatcaataaaaagcgctacatctagttgtggcttcacatttttagacagagtaacacataacatccaaatggtccagrctttctgaagtgtccgatttttacacgttttgctctcttgtccccatgtgtacttgtcaaaccaaatgtcaacttactttttggtttgggaaatgtggttagagagccatacaaaggtgcagtattttaacccaagcgtccctgtggaatgacctgctgtagggtaatgagaaagagagagaaccggaaggaacaaagaagatgagccggcaagtagccaagaaggcacaggccacaggacagtttggggcttttctgttttgttttcaaattaagcttcacccaaaaggggtgggggta

SEQ ID NO: 21177 - DNA, 601 bp, Human
cacatctgtcattttatttaaaatgattcagtaatattttgataactgttttaatataattagtttctttttttttttttttggaaacggggtctcattctgttgcccaggctggagtgcagtggctcagtctcagctcactgcagcctcaacctctccaggctcaggcagtcctcccatgtcagcttcctaagtagctggaaccacaggcacgcaccaccacgcccagctaatttttgtattttttgtagaggtggggtttcgtcatgtggcccaggctggtctcaaattcctggactcragcagtccactcaccttgccctcccaaagtgctggcattacaggcgtgagccaccacacccagcctggtttcctttaaattatctgtattttattttatgcctttaccatcatttttctgagaagcggtctccatcagaatgccaagggtgggagtggaggaggcagcacagaagagatgtttgagaccctgctttagagacgagggcagcagggaaaagccaggaagtcctcctgcagccactcaggacagaaacaggcggccaaccagcggtttcatttcatgttctcagaaaccagg

SEQ ID NO: 21178 - DNA, 601 bp, Human
aagtcattgagatgagacgcaggaagagggttcagagttcgctgccggctccgaacgtggaggggcctgaagccaaggagcctgggcagccctgacagccactcctggccagcagccggcaaagaaacagggtcctcactcctgccaagaacttgaatgagactggaagcaaattctcccctaacagcctctggacaagggcccaggctggccaacatctttctttctaccttttgagacccagagcagagaaaccgataggacccacccagacttcccacctacacaactgcgatgacasgggtgctggtggtgactcatcaaggcagcaacagaaaatggacacagccgtgtttcatcagctacatgctatagcttgttactgagtgagtataagcacatctgtcattttatttaaaatgattcagtaatattttgataactgttttaatataattagtttctttttttttttttttggaaacggggtctcattctgttgcccaggctggagtgcagtggctcagtctcagctcactgcagcctcaacctctccaggctcaggcagtcctcccatgtcagcttcctaagtagctggaac

SEQ ID NO: 21179 - DNA, 601 bp, Human
ggcgcacccagccacgtctgggttttcatcagagctaaggaggcagaattttggcccccgtgaccttttccccttggtgctacaccctcgaatatgttacatggcaaaaagggactttgcagatataattaaagttcttaatcagttacccttttttaaggaaaggagtttattcaagattatcccctaaaaacagaagtcagagaaacgtgtaagtccaagtcattgagatgagacgcaggaagagggttcagagttcgctgccggctccgaacgtggaggggcctgaagccaaggagcmtgggcagccctgacagccactcctggccagcagccggcaaagaaacagggtcctcactcctgccaagaacttgaatgagactggaagcaaattctcccctaacagcctctggacaagggcccaggctggccaacatctttctttctaccttttgagacccagagcagagaaaccgataggacccacccagacttcccacctacacaactgcgatgacacgggtgctggtggtgactcatcaaggcagcaacagaaaatggacacagccgtgtttcatcagctacatgctatagcttgtta

SEQ ID NO: 21180 - DNA, 601 bp, Human
aaaccagcaaaaacccagccacaaacatttgaaatgaggcccaagcctgggacacagggggaccaggtggaacattcgcccactccctgggacccgcccttaccctgtggttctcagtgtggctcctggaccagccgcagcaccatcacagggacacctagacatgcagcatcccgggccacaccccagacccactgagtcaggagctcccgggcgcacccagccacgtctgggttttcatcagagctaaggaggcagaattttggcccccgtgaccttttccccttggtgctacaccctygaatatgttacatggcaaaaagggactttgcagatataattaaagttcttaatcagttacccttttttaaggaaaggagtttattcaagattatcccctaaaaacagaagtcagagaaacgtgtaagtccaagtcattgagatgagacgcaggaagagggttcagagttcgctgccggctccgaacgtggaggggcctgaagccaaggagcctgggcagccctgacagccactcctggccagcagccggcaaagaaacagggtcctcactcctgccaagaacttgaatgagactggaagc

SEQ ID NO: 21181 - DNA, 601 bp, Human
gggtgcctgtgaatttgcatttctgacaagttcccaggtggtgcccccgctgctgggacggggacctcaccctgacgacccctgctgtggagagttcgggaagcttcggacgccctaaccataggcggaacccgctgccacggccctggtgctagcagacgctctctctcggcccgccctccaccgagttccggccacagagcgggccctgcccggcggtgtgcggccacatcttccttcagctctagcttagctgctacattgggaagccactaaaacctttaaaaccagcaaaaacccwgccacaaacatttgaaatgaggcccaagcctgggacacagggggaccaggtggaacattcgcccactccctgggacccgcccttaccctgtggttctcagtgtggctcctggaccagccgcagcaccatcacagggacacctagacatgcagcatcccgggccacaccccagacccactgagtcaggagctcccgggcgcacccagccacgtctgggttttcatcagagctaaggaggcagaattttggcccccgtgaccttttccccttggtgctacaccctcgaatatgttacatggc

SEQ ID NO: 21182 - DNA, 601 bp, Human
cctttaggtgtaaggttttttttttgtttttgtttttgtttttgttttgtcttaaaaaaaaaaaaaaggaaactcattacatactgtcttacacaaactaaaccactagatggtgctaagtgactttaatgagaaatgagacatgggcggttcccactttgcaattttaaaaagtgactttctttacttccctgtcacagaaactctcagtccatgcaatttagggaactagaattacctgtcctttcctctccacctgtccgaagtgcttcctccggggctcttacgggtatatgtgcayttatttgaaggagaggcttccagcttccagctccaagcccaggcactattctcccatcgtccgcccagcgtctcccagactgagcccgcagagccacgtggagggcttaaacaaggcgcaccggcccgccccagagctcctgggtcagtggtctggggtgcctgtgaatttgcatttctgacaagttcccaggtggtgcccccgctgctgggacggggacctcaccctgacgacccctgctgtggagagttcgggaagcttcggacgccctaaccataggcggaacccgctgccacggcc

SEQ ID NO: 21183 - DNA, 601 bp, Human
agccaggtgactgctgtttctgcctggaccgttagattgcctggtttatatctgtctccccactgggctgtgagccgctgagggcacgacacaggcaggagcctgacgcgagccccatctggaggggtgagctctcacctcagtccttaggaccccagacacctttaggtgtaaggttttttttttgtttttgtttttgtttttgttttgtcttaaaaaaaaaaaaaaggaaactcattacatactgtcttacacaaactaaaccactagatggtgctaagtgactttaatgagaaatgasacatgggcggttcccactttgcaattttaaaaagtgactttctttacttccctgtcacagaaactctcagtccatgcaatttagggaactagaattacctgtcctttcctctccacctgtccgaagtgcttcctccggggctcttacgggtatatgtgcacttatttgaaggagaggcttccagcttccagctccaagcccaggcactattctcccatcgtccgcccagcgtctcccagactgagcccgcagagccacgtggagggcttaaacaaggcgcaccggcccgccccagagctc

SEQ ID NO: 21184 - DNA, 601 bp, Human
agacgaagagaagagaggttggcccagggttcctccaacggtggggccatgtggcaacctgaactttatccggagccaggtgactgctgtttctgcctggaccgttagattgcctggtttatatctgtctccccactgggctgtgagccgctgagggcacgacacaggcaggagcctgacgcgagccccatctggaggggtgagctctcacctcagtccttaggaccccagacacctttaggtgtaaggttttttttttgtttttgtttttgtttttgttttgtcttaaaaaaaaaaaaaaggaaactcattacatactgtcttacacaaactaaaccactagatggtgctaagtgactttaatgagaaatgagacatgggcggttcccactttgcaattttaaaaagtgactttctttacttccctgtcacagaaactctcagtccatgcaatttagggaactagaattacctgtcctttcctctccacctgtccgaagtgcttcctccggggctcttacgggtatatgtgcacttatttgaaggagaggcttccagcttccagctccaagcccaggcactattctcccatcgtccgccc

SEQ ID NO: 21185 - DNA, 601 bp, Human
tgagagcccaggaaagtcacctgtgatctttctaccctacaagtggagtgcaatctttttatgtctcaggaagtggtgattgttgtttttgtggtagtggtagggggtggagggatggggtgttttcttgggtgtgcatttgtgtttgtttgaagaaggctgcatgttttaaaggctggagatcctctgctggaacactgcgggaggagctcctgtcctgggcgcccccacagcccccatcccccacatgaccatgaggcccagagccctccaactccgtactggtcgcagatgctctacrggattctgctgagtccagtgaagtgatgacttggtttataaaagtggactgatgtctataccgatgtggtttttacagctccataatttaaacctttcatcagaaggaagagtgttcaggaaaaccagtaagagctcctgtctcaggagctcaacaggaatggagatgcctgtgacgagagccactgtggcacggcgtccactgccacccagcaccagcctggccgaggagaatgagacacggaccctcctctagaaggccgcagtccagcaggggaggcacgcccagggcatctcagag

SEQ ID NO: 21186 - DNA, 601 bp, Human
aaagcatcacagaatgggaaatgagagcccaggaaagtcacctgtgatctttctaccctacaagtggagtgcaatctttttatgtctcaggaagtggtgattgttgtttttgtggtagtggtagggggtggagggatggggtgttttcttgggtgtgcatttgtgtttgtttgaagaaggctgcatgttttaaaggctggagatcctctgctggaacactgcgggaggagctcctgtcctgggcgcccccacagcccccatcccccacatgaccatgaggcccagagccctccaactccgyactggtcgcagatgctctacgggattctgctgagtccagtgaagtgatgacttggtttataaaagtggactgatgtctataccgatgtggtttttacagctccataatttaaacctttcatcagaaggaagagtgttcaggaaaaccagtaagagctcctgtctcaggagctcaacaggaatggagatgcctgtgacgagagccactgtggcacggcgtccactgccacccagcaccagcctggccgaggagaatgagacacggaccctcctctagaaggccgcagtccagcaggggagg

SEQ ID NO: 21187 - DNA, 601 bp, Human
cagcaacaggccaacaccagcctgttctctctgaagacatgggaaagtcagtgtgagccatgcagagacctctccttgcaggttttcacttagcaaagttttaaactgtaaatagaaccacaaagcatcacagaatgggaaatgagagcccaggaaagtcacctgtgatctttctaccctacaagtggagtgcaatctttttatgtctcaggaagtggtgattgttgtttttgtggtagtggtagggggtggagggatggggtgttttcttgggtgtgcatttgtgtttgtttgaagaagsctgcatgttttaaaggctggagatcctctgctggaacactgcgggaggagctcctgtcctgggcgcccccacagcccccatcccccacatgaccatgaggcccagagccctccaactccgtactggtcgcagatgctctacgggattctgctgagtccagtgaagtgatgacttggtttataaaagtggactgatgtctataccgatgtggtttttacagctccataatttaaacctttcatcagaaggaagagtgttcaggaaaaccagtaagagctcctgtctcaggagctcaacagg

SEQ ID NO: 21188 - DNA, 601 bp, Human
tccccattcccacacagcaacaggccaacaccagcctgttctctctgaagacatgggaaagtcagtgtgagccatgcagagacctctccttgcaggttttcacttagcaaagttttaaactgtaaatagaaccacaaagcatcacagaatgggaaatgagagcccaggaaagtcacctgtgatctttctaccctacaagtggagtgcaatctttttatgtctcaggaagtggtgattgttgtttttgtggtagtggtagggggtggagggatggggtgttttcttgggtgtgcatttgtgyttgtttgaagaaggctgcatgttttaaaggctggagatcctctgctggaacactgcgggaggagctcctgtcctgggcgcccccacagcccccatcccccacatgaccatgaggcccagagccctccaactccgtactggtcgcagatgctctacgggattctgctgagtccagtgaagtgatgacttggtttataaaagtggactgatgtctataccgatgtggtttttacagctccataatttaaacctttcatcagaaggaagagtgttcaggaaaaccagtaagagctcctgtctc

SEQ ID NO: 21189 - DNA, 601 bp, Human
ctgcacctcagcctcctccctgctgcaggcaacaatatgcaagcacacacgtgcgtgcacacacacacactctgtctccagggcccctgcaaactccccattcccacacagcaacaggccaacaccagcctgttctctctgaagacatgggaaagtcagtgtgagccatgcagagacctctccttgcaggttttcacttagcaaagttttaaactgtaaatagaaccacaaagcatcacagaatgggaaatgagagcccaggaaagtcacctgtgatctttctaccctacaagtggagtgyaatctttttatgtctcaggaagtggtgattgttgtttttgtggtagtggtagggggtggagggatggggtgttttcttgggtgtgcatttgtgtttgtttgaagaaggctgcatgttttaaaggctggagatcctctgctggaacactgcgggaggagctcctgtcctgggcgcccccacagcccccatcccccacatgaccatgaggcccagagccctccaactccgtactggtcgcagatgctctacgggattctgctgagtccagtgaagtgatgacttggtttataaaagtggact

SEQ ID NO: 21190 - DNA, 601 bp, Human
tctaaaattacttctgaataaaacaagagtccccttcctgtttcagctagtgtgatccagtttctgtttctcccaagaaatctggattcaaacagtcgcctgtaatagcaaatacaagtcagacacactaacgcctggtgcagccacatctcacccacaccagagtgttcagacactccaggaaacactttcaaggaatatggggattgaaaagacccctttgagccccaaatctcaaagaagtgttggaattacatggtgagggaagtgtgtggggctgtagagaacatagaggggccaygtgttgagggatggggcgggagggctcatgagacagactattctcacttttaatttttgagacaggcagggtctcactctattgcccaggctggagtgcagtgctgccatcaggactccctgaagcctccacatcctgggctcaagtggtccccacacctttgtctcctcagtagctgagaccacaggtgaatgccaccatgcccagccaattaaaaaaaaatttttttttgtagagacaaggtctaattatgttgcctaggctggtcttgaacttctgggctgaagtgatcctcccacc

SEQ ID NO: 21191 - DNA, 601 bp, Human
acttgaggtcaggagttcaagaccagcctggccaacatggtgaaacaccatctctactaaaaatacaaaaattagctgggcgtggtggctggtgcctgtaatcccagctactctggaggctgaggcacctgaacccgggaggtggagtttgcagtgagccgagatcatgccactgcaccccagactgggtgacagagcaccccagactgggtgacagagcaccccagactgggtgacagagcgagactctgtcaaaaaaaaaaaaaaaagcaggtgttcagccatagatctgttgcattaraagggaggaggaagggaagaaaaggtacgtgtgctaagcactttggggagatgtctgtccagtccacgttgtccctgtgtctgatgtcagccccacccatccaaaggcacggtcccagcaacaagatgaccccactctcctgtgcagagttataggaccaggggtgggcctgacctaggctggcctgtcacatgccttctctcctgggaatctggaaaggggtctcagaaatcgcagagttggtgggaggttctagacaacagggacacatgaacgggtctgaggctgccgctctggagt

SEQ ID NO: 21192 - DNA, 601 bp, Human
cagtgacgccgcattaccccagccgcagcctcctacagctcacgtttcccacagctcttgattgcaatattttctcttgtgcttgatcaagtgttattaaaaaagagtcaagaagcttaaaaaaaatttaaactttataaagtagaggccgagatatcatgattcttttccaatctcattcttgagtaggaaagaatttgacacgcatggtcctcaaaaacaaaacaaaacaaacaaaacctcacttctacctagcgcagcccttctggaagccagggtgcactggaaccacctgagggtrttaagagtctgactcagcagggatggggggccggagactccgccttgctcaccagttcccacgtgatgttgatgctgccggtccatgggccacacttcgagtcacaaggggcaagacacacatctatattcaacttcatgtatgtccactgcaggcatttcctacatccagacctaaatgtacctactggacaccctggaagatgatcattgccatcaaaacccaattcttcacttatacactttatgcccttggatcatgaaattccttaagtgaaaatgtagctttcaaaggtgttcg

SEQ ID NO: 21193 - DNA, 601 bp, Human
agcctggccaacatagtgaaaccccatctctactaaaaatacaaaaattagctgggagtggtggcacacgccataatcccagatacttgggaggctgaggcaggagaatcacttgaacctgggaggcagaggctgcagtgagccaagaccacaccattgcactccagcctgggcaacagagcaagactctgtctaaaagaaaaagaaaaaaaacttgctatcggtggaataatatgtataattcaaataaagtacattcttcagactttaatgaacaagcataaatctgatagcaaaaaaataagtaaaaagaagcacatactaaatagataagatgctacctttattgaaatactgagtgggagaaaagtttccttgttctcattcagctttgattttctcccgagtttggatcggcagagttacatttatgttttggtagctaaggtgtatgtgtgtgcccttgtgtacacataaaataatgtcagagaaatacagtacattaatcagagcaagtaaaaattaagggaggaaaacagaaagagatagttttatattcagtgtaagaggttgtgatgatacacaaagacccacaaatgct

SEQ ID NO: 21194 - DNA, 601 bp, Human
acctgttgccttcaatctcgatgatacgatgataccggtccagctcattcttcagggtttgctgggcgaccgccagctgccggcagtcgtaagaagacttctccaggacccgctctgtctcctcaatctccttgcgcagtgtctcaatctgctcgttataaagctgaatctcatcgtcataacactcatgggcacttttaatagcttgttccagagttgttgtctgtgggcaaggacacgctgtaagaaaatccatcccccttcttctctaagagacagacctcaccaggaaaaggaaccyggactcggtgaatgttttatgttgtttgtgtgtttctctgtccattcgagattagcaatgaatcactttggaatccttaagctaaaaagcaatgtgaaaactgagctcctgtgtccttacacaattttttttttttttttttttgatagaggatctcactttgtcaccaggctggaatgcaggagtgcaatctcggctcactgcatcctcgacctcccaggctaaaggcttccacctcagcctcctgagtagctgtgactacaggcaagcaccaacatgctgggcttttttttttttttt

SEQ ID NO: 21195 - DNA, 601 bp, Human
aataagtggcctggatggggagggcacacgctcacctgttgccttcaatctcgatgatacgatgataccggtccagctcattcttcagggtttgctgggcgaccgccagctgccggcagtcgtaagaagacttctccaggacccgctctgtctcctcaatctccttgcgcagtgtctcaatctgctcgttataaagctgaatctcatcgtcataacactcatgggcacttttaatagcttgttccagagttgttgtctgtgggcaaggacacgctgtaagaaaatccatcccccttcttcyctaagagacagacctcaccaggaaaaggaacccggactcggtgaatgttttatgttgtttgtgtgtttctctgtccattcgagattagcaatgaatcactttggaatccttaagctaaaaagcaatgtgaaaactgagctcctgtgtccttacacaattttttttttttttttttttgatagaggatctcactttgtcaccaggctggaatgcaggagtgcaatctcggctcactgcatcctcgacctcccaggctaaaggcttccacctcagcctcctgagtagctgtgactacaggca

SEQ ID NO: 21196 - DNA, 601 bp, Human
gttatccaacacccatggggtcaggaattgttctgtttccttccctgacacatgcccactgcctataactgtgcctggcacacaataggcactcaataaagagttgtggaaggaataagtggcctggatggggagggcacacgctcacctgttgccttcaatctcgatgatacgatgataccggtccagctcattcttcagggtttgctgggcgaccgccagctgccggcagtcgtaagaagacttctccaggacccgctctgtctcctcaatctccttgcgcagtgtctcaatctgctcrttataaagctgaatctcatcgtcataacactcatgggcacttttaatagcttgttccagagttgttgtctgtgggcaaggacacgctgtaagaaaatccatcccccttcttctctaagagacagacctcaccaggaaaaggaacccggactcggtgaatgttttatgttgtttgtgtgtttctctgtccattcgagattagcaatgaatcactttggaatccttaagctaaaaagcaatgtgaaaactgagctcctgtgtccttacacaattttttttttttttttttttgatagaggat

SEQ ID NO: 21197 - DNA, 601 bp, Human
gcaaggtgctaagaattgtgaggatggcagcaggagcatcaccaacacctctgagtgccctcaagtgccaggctccgtgccacgtagctcacctgcagcacctcattaaatactcctgggcatcccacctgctgggacacttatgtccccagaggcctatgagcaaaacacaggcttctcagtgaggccttttctgaccaccctacttaaaactgcaagcattcccccatcacccctattgccaccaccctcctccctgcgggaacttcctcctcagcactggtcgtaccttcatcctctrtctcccctactagttatccaacacccatggggtcaggaattgttctgtttccttccctgacacatgcccactgcctataactgtgcctggcacacaataggcactcaataaagagttgtggaaggaataagtggcctggatggggagggcacacgctcacctgttgccttcaatctcgatgatacgatgataccggtccagctcattcttcagggtttgctgggcgaccgccagctgccggcagtcgtaagaagacttctccaggacccgctctgtctcctcaatctccttgcgcagtgt

SEQ ID NO: 21198 - DNA, 601 bp, Human
cagctccagacttattcttgcagatgtgtgcatagtgttcactgtgacataaatataatgtggaatcatgccagatacaccgaccagcactggagaaagaaaaataaaatcctgcttctcctgccaagcattcgagtgctcacagccaagagagagcacccagcgcgaagggaagagctgctcctggtggggacctcagttgtggggggcttctcttttcattcagtcgaaacccaggaatttagcaagactgaagtgaagaatcacaaattaattcccaacccgttctctggaaatcacsgtagctatgaataccagcatagctggagagaaagagagaatttcccagctttcttaaagtgagtagggatcgactcacagctccattatggagaagaccagacagccacatagtcacagccacagactgactcagcaaggtgctaagaattgtgaggatggcagcaggagcatcaccaacacctctgagtgccctcaagtgccaggctccgtgccacgtagctcacctgcagcacctcattaaatactcctgggcatcccacctgctgggacacttatgtccccagaggcctatgagcaa

SEQ ID NO: 21199 - DNA, 601 bp, Human
gtatatgtatatatacgtatatatatacgtgtatatatatacgtatatatacatatacacacacatatatacatatatacatatatctactcatatatacgtatatacatatatacatatacatgtacacacacacatcatatataaatagagaaaaaatgataaagcaattgagataaaatataaacaactggtgaatctggagtattcaggagttccttgttctattcttgcaacatttctatcaatttaaaattagaccaaaatcagaacttatagataaataaaagaggtatccagkcacctttctgtgaagccctgtcccaaaacaaaaatgtttacaaagtcaccgaaatgccagctccagacttattcttgcagatgtgtgcatagtgttcactgtgacataaatataatgtggaatcatgccagatacaccgaccagcactggagaaagaaaaataaaatcctgcttctcctgccaagcattcgagtgctcacagccaagagagagcacccagcgcgaagggaagagctgctcctggtggggacctcagttgtggggggcttctcttttcattcagtcgaaacccaggaattt

SEQ ID NO: 21200 - DNA, 601 bp, Human
acagccatacacacatttacatactggatgaggacataaaggaagtgatcatttctttgagctcaagagtcataaactgtgaaacatacctataaaaaattgtaaagtggggattgcttataacctaaaaatgccacttctccatgagacagtgccttttttatttttttgccttttgtttttttgcctttttgatttttttagttagagtagtcaacccaggctgaagtatttagggcaaacagagtatgatatctccaacttaagatatatgtatatatacgtgtatgtatatatatayacacacacacacacacacacgtatatatacgtgtgtatatatatatacacgtatatatacgtatatatatacacacacgtatgtatatatgtgtgtatatatgtatatgtgtgtgtatatgtatatatacgtatatatatacgtgtatatatatacgtatatatacatatacacacacatatatacatatatacatatatctactcatatatacgtatatacatatatacatatacatgtacacacacacatcatatataaatagagaaaaaatgataaagcaattgagataaaatataa

SEQ ID NO: 21201 - DNA, 601 bp, Human
tagctgaaaggaaaaactaaaagttgaagaaaacacataaaattctcacctggtataatctatgaggcttcccggctccacccacatagtgaattttgaactttttcagcccaaaagtcatcccctgcatcccttcccactggtaaccacagggcaagaccgatcaagcaccggcatcaagcacggctgattcacaataaaaagagagccaggtgagccggcaacagcagacatgggtcacaaagccacaggtgcaagggatgcagagagggacagggcacaggaaaactgctgggaactrgtatgcgaggaggaggtgcttacaggactgcacagaatctcagggcccagtgccaaaaaaacccacaagaccccttgttccaaattattaagaacttcagaacagcattagcagagcattcagccaagctgggaccgttctgagagcaagcccctgcagggccgctcgtctgcagacctggccctgggcgtccagctgcaaggctgttccctttccaaccatgttgactctggaacaccatttccacaaagccctctgagctatctggaaataaggatttcaaggccctatatgcatgag

SEQ ID NO: 21202 - DNA, 601 bp, Human
ttacccctacagtggccccaaatacattttatcccatcaagcctgggcattttaagagctcttctctcctgatttcttcttgtctgactttgtctttccaatcatggtctccacgatcacagcggtttcttcatatgtctgaatgctctccgtggaaatcttctcgatagattccaccacttccactgtcttataggccaaagccttgggagggcctttttctggcaggcttctgctcctagtcccaagcacctcagctccatcctgatcagccgcaggctttggaggctcaggtatagayggttcctctgcaccgggtgtgaccatggcacagggtctcctggactcttcgtcccgctcctcaccctcacgtttctcttcagggccttccagctctgcaccatctggctcaatctccttgtctataggctgctggtcaattggttgtccatcttctttctcctgcagacccacctgcccattctctaaagggggcttgggtgactcaggagagggctccacctggccgtcataaagcacagagtcttccgcaacagaaacagccaccccacctttagctgtgatggaggagacatagaat

SEQ ID NO: 21203 - DNA, 601 bp, Human
gtcctcatgaagctgacccacctacattcccaaggtccctattaattagacaaaggatgtgcaagcaaagaaaacattttaatgaaggcttcgttggcaatgccagatgggtcaactatggtctaatccaaacaggaaccctcacccttttatcatttgctctaaaatatcaaagcattacccctacagtggccccaaatacattttatcccatcaagcctgggcattttaagagctcttctctcctgatttcttcttgtctgactttgtctttccaatcatggtctccacgatcacagcrgtttcttcatatgtctgaatgctctccgtggaaatcttctcgatagattccaccacttccactgtcttataggccaaagccttgggagggcctttttctggcaggcttctgctcctagtcccaagcacctcagctccatcctgatcagccgcaggctttggaggctcaggtatagatggttcctctgcaccgggtgtgaccatggcacagggtctcctggactcttcgtcccgctcctcaccctcacgtttctcttcagggccttccagctctgcaccatctggctcaatctccttgtct

SEQ ID NO: 21204 - DNA, 601 bp, Human
agatgctatctgagtctctaacgagacttatgaaccaggatgaagagcatgtctctttcctaaatgaggacggtatggtggccatttaacagagcatccctgtcctcatgaagctgacccacctacattcccaaggtccctattaattagacaaaggatgtgcaagcaaagaaaacattttaatgaaggcttcgttggcaatgccagatgggtcaactatggtctaatccaaacaggaaccctcacccttttatcatttgctctaaaatatcaaagcattacccctacagtggccccaaakacattttatcccatcaagcctgggcattttaagagctcttctctcctgatttcttcttgtctgactttgtctttccaatcatggtctccacgatcacagcggtttcttcatatgtctgaatgctctccgtggaaatcttctcgatagattccaccacttccactgtcttataggccaaagccttgggagggcctttttctggcaggcttctgctcctagtcccaagcacctcagctccatcctgatcagccgcaggctttggaggctcaggtatagatggttcctctgcaccgggtgtga

SEQ ID NO: 21205 - DNA, 601 bp, Human
tgctgaaggcgggggctccgggctcccctcccagaactccaccgcttttatctttataaagacggggtcttactatgttgcccaggtttgtctcaatcaaactcctggcttcaagcaatcctctcgcttctgcctcccaagtcactgggattatgtgcctaagccacctcgcccagctatgaagggaaatttaaatccagtgggttaaaaaatttttgaaacaccttacagtttacagtacttttatttgacctttattgatttatttgctcctcatagcaatggcattggttagacaagrtaagtattgtcttgcttttacagttgagagaattatatgaagtgcttatctaatgccccctttcttcttcttaaatctctttcgtgtttgtttggacagggctgcagtgcagtggcacaatcacagctcactgtagcctcgacctcctggcctcaaggaatcctcctgccttggcctcccaaagtgctgggacccacagcctatggctgttaaatggtcttaaacccaaagccccctcgcccttgcagttagccccaggcgcggtgtggaggggctgcaccacaagcggagtgcgaggaa

SEQ ID NO: 21206 - DNA, 601 bp, Human
acctgcggaggccgccagagcgcgaagccggaacagcagcggcaggtgggaagggacagtggcacccagagtggtcttttggacactgacaacaagcctggatcagggccgggggagctcctgcaatctcctctgtttatgtaactaacatcaaactcgagccactgcctcagccctccagccaccacgctgaaatccacaccgtccccacctttggaaaggacccccagtaggggcagcttgagaacctcctgggtgccgggtgctctccatgctcaggaactgcgacacagtcactaartgccaaggcattagacttcgcagatgccttcccagaggctgccaggacagcgtgaggcgcccagaggctgcagaattcggcaggagggaggggaggaggatgtgatgcagcgggtgggagagagcacccgtgtgctgtgatttttctctccccagaccatttaaagggaaggagagacaaggaagcatccagggagcgtcctgctgaaggcgggggctccgggctcccctcccagaactccaccgcttttatctttataaagacggggtcttactatgttgcccaggtttgtctcaatca

SEQ ID NO: 21207 - DNA, 601 bp, Human
ctcaaaaaaataataataataaggccaggcacggtggctcacatctgtaatcccagcactttgggaggcccagacgggcggatcacgaggtcaggagatcgagaccatcctggctaacacggtgaaaccccgtctttactaagatacaaaaaatgagccgggcgtggtggcgggcgcctgtagtcccagctactcgggaggctgaggcaggagaatggcctgaacccgggaggcggagcctgcagtgagcggagatcgtgccactgcactccagcctgggcgacacagagactcaatctcaaaaaaaaaaataaaaataaaaaatagaagtatctacacagaattaaagttatgatgggaaaaaaggctgaaccctataattgaaaagaaagtttcggagtgtttcgctgtgaccccagctctgtggccctgggcgggctgccgtactgctgcctccgcttcctcactccgaaggcaagaaaggggagtggcgacgtccaccctccctcactgagggggccggggagaggcgggcgggagggcaggcgcctcctccggcgagtcagggcgctgcgcgggtgacggtggtgttctacctgcg

SEQ ID NO: 21208 - DNA, 601 bp, Human
ctttgtaagagaaaggagagggagatttaagcagagacacacagagaggacgccatgtgaagacagaggcagccacaggagccaggagagcgccccagaaggaagcagccgggcaacatgggattccagcctttgggcctctagaaccgggaggggatccgcatctgttgtttaaagccactctcctgcttggaaccgcctacagcagccccaagaagctaacgcaggcagccgctgcccaaggacttctttttgacctgcgcttggtaaattggcatccagaatctggacacagagcggygctgccaccacagcaggtcaggttatcaaactcaagatcccacagaaaataaagactcgaggcggcagggagggagaggaaagaatggcacctgccagaggaggtctaggtgccgcaagtgaccgtgaagccaagcactgggcccactgagtggacagctgtgtggacaggctcctgtctggaccagtgcctcagggacaggctgggccggccctgcaggacaggagtgggctcggaagatggatgccatttaattccaagaatagggcttgtgctgtgccaatatggaatcatgccctt

SEQ ID NO: 21209 - DNA, 601 bp, Human
ctgcaatgagccatgatcacaccactgcactccaacctgggtgacaaagtgaaaccctgtctcaaaaaagaaaaaaaaaatgcttaaaataaggagcttggccgggcgcggtggctcacgcctgtaatcccagcactttgggaggccgaggcgggcggatcacgaagtcaggagtttgagaccagcctggccaacatgatgaaaccttgtctctactaaaaatacaaaaattagccgggcctggtggcgggcgtctgtagtcccagctacttgggaggctgaggcaggagaatcgcttgamcccgggaggtggaggttgcaatgagccgagatcgcgccattgcactccagcctgggggacgagagccagactccgtctcaaaacaaacaaacaaacaacaaaaataaataaataaataaataaaaataaggagcttgtgtattgctgcagccataaaaaagaataaaatcatgtcctctgcagcaacacggatggagctagaggccattaccctaagtgaactaactcagaaacagaaaatcaaatactgactgttctcacttataagtgggagctaaacaatgggtgcccatggacacg

SEQ ID NO: 21210 - DNA, 601 bp, Human
gtattgggcagatggaagattttcagtaactactgcggagtggtgaccacagctgggcacctgcctttggccaagcttggtttactttgggtgggtgtgtccttaatccgaatcccacagggagtggtggcactggctcctgctctacccagaggggctgggctcttggccggcagctctccagctccctgggcagcactggcagctgcagcttggccagcatctgtgccgccagagatggcagggactgttcttggggtactgactgtgtttgggggctgtattcttacaggcaaaggtragccctgcagctgggtgtgcccagaccagagaaagacctaaggtggaagagagaacaaaacacaaagaagggcagggacgctgagatctgcgcagattcacacaaaaagacctcctgggctgccagagaagggtgggagggaagatggaagtgtaggcagaaatttatttctattctctaagtccataatatttttcattagaaaaaccaaaaacttttagaggacagttcttacagggcaaattgtttttttgtttttgtttttgttttgagatggagtctcgctctgtcacccaggct

SEQ ID NO: 21211 - DNA, 601 bp, Human
agttgcagctggcccaaagagcctcacaggtcccagagagctgagggaccctgtgggctggagggccctgcaggaggtctcaacaggcagaggcaaggtctgcagccacagctttaagcagcactgcccgtagatggcagggagcgagccccgactctgcagaaagggattcctctgcagaggaatctgctggacctcctgaaacacgcggctggggagcttcccactaggtgagaaggccacaggctgttccggggaggcgagcgagtgtcatgcgggcatcatccgccatcctgtgctkgcacgctttcttcaagttcccctgcaggcttcagcaatctgagcccacctttcctggctgtgcttccaacaggcggagcctctttccgctcatctccttcacgggctcaggagggtattgggcagatggaagattttcagtaactactgcggagtggtgaccacagctgggcacctgcctttggccaagcttggtttactttgggtgggtgtgtccttaatccgaatcccacagggagtggtggcactggctcctgctctacccagaggggctgggctcttggccggcagctctccagct

SEQ ID NO: 21212 - DNA, 601 bp, Human
gacctgaggggaaaggggagtcaggaagccgggacttcagccaggccagaggcccctcctgcaaagagctccagttgcagctggcccaaagagcctcacaggtcccagagagctgagggaccctgtgggctggagggccctgcaggaggtctcaacaggcagaggcaaggtctgcagccacagctttaagcagcactgcccgtagatggcagggagcgagccccgactctgcagaaagggattcctctgcagaggaatctgctggacctcctgaaacacgcggctggggagcttcccactrggtgagaaggccacaggctgttccggggaggcgagcgagtgtcatgcgggcatcatccgccatcctgtgctggcacgctttcttcaagttcccctgcaggcttcagcaatctgagcccacctttcctggctgtgcttccaacaggcggagcctctttccgctcatctccttcacgggctcaggagggtattgggcagatggaagattttcagtaactactgcggagtggtgaccacagctgggcacctgcctttggccaagcttggtttactttgggtgggtgtgtccttaatccgaatc

SEQ ID NO: 21213 - DNA, 601 bp, Human
ctgttgtcagaacagctttggaggaagccaaacaccagtaggtttgtgatgcactcatccctgaggctggaaccgttgttgacctgaggggaaaggggagtcaggaagccgggacttcagccaggccagaggcccctcctgcaaagagctccagttgcagctggcccaaagagcctcacaggtcccagagagctgagggaccctgtgggctggagggccctgcaggaggtctcaacaggcagaggcaaggtctgcagccacagctttaagcagcactgcccgtagatggcagggagcgagscccgactctgcagaaagggattcctctgcagaggaatctgctggacctcctgaaacacgcggctggggagcttcccactaggtgagaaggccacaggctgttccggggaggcgagcgagtgtcatgcgggcatcatccgccatcctgtgctggcacgctttcttcaagttcccctgcaggcttcagcaatctgagcccacctttcctggctgtgcttccaacaggcggagcctctttccgctcatctccttcacgggctcaggagggtattgggcagatggaagattttcagtaactact

SEQ ID NO: 21214 - DNA, 601 bp, Human
aagtggtctgcaatctttgtatcagaatcacatttggaaaattggataaaaacaccattctatgttggtccagacaagggactcaagaccagtacatgagattctgtctcaacagaaaggaagaactttctaacagagtcacccaaaaatggtaggcagtgagttcagcagcactggagggaatcaagtagagaccagtcaagtgattaagtgataccagcgtacgtggcagctgaaactgcagaggcagagtgatcccgggggtcccttccagccctgaggctccctgaatgttactggygacagagaagcccagctttggggaaggaggtggggccggccgcctacctgcctctattcttcccaagcgggagtggctgctgcggttgccatcagtctgcagctcatcgtagccctcccactggggagccagcactggcagctcgtggcccagtgcgtccagctctctgcggaagctgttgtcagaacagctttggaggaagccaaacaccagtaggtttgtgatgcactcatccctgaggctggaaccgttgttgacctgaggggaaaggggagtcaggaagccgggacttcagccagg

SEQ ID NO: 21215 - DNA, 601 bp, Human
gagcttggaaggcctggaccagggtccggggatccctgcaggctttcagggcagggattctacctgcgtcagaatcctctgggcagtctcccgccctaaaacagcctgatgcaggcagctggagtagggcccaaggcctgcatttggaaaaggtttctcgtgtaattccaatgtgcacactactgaaagccagcgtcgcagggctggatctggaagtgggtgagcctccactcgcccccagcctccactcgggacagcccctgtccatagaagcagccccttggcaaaggggagtggagcyggaggctggaggagagtgcagggatcagcaacaggaaaggtgaacagtctggaaaccatggtgacctggagtcagtgccctacagtgggagggcggctgaggcccacctcaagaaggggcctggccccatgtcccagtggtaacatggccacaagctgtgtgatctggagctagtcatttaccctttgctggacctgggtttcctcacctggaaatgaggttccaaatacttctgtgttcttgtataggtaatcacggagcataatgtatgaaaggaaatatgtcaggtatagacagtgc

SEQ ID NO: 21216 - DNA, 601 bp, Human
atccacctgccttggcctcccaaagtgctgggattacaggcgtgaaccactgcacccagcctcactgtagcatttatagccgctgggcttttgcttaaaagatggccattccctcttcccagtttccaaggaaccaaacatacccaacccccaaggcccagctcaattggagctgcagccccaaagttttcctgattccctgcagagcagagcacccagctcctccagcacctcatcactcccccagcacagaatctgtgcctcgctcgttcccgaagcttatccaccttgcttcagttayggacacgtcctctctccctctggccaccagccgagtagcaacaggaatctttcctgatccgtctgtgtccagccgagtgaacggactcaccaaagaaaccccggcagccagagcctctaccttgcccctctttccaggctcgccagggactagattcacagtccctgtcacctgcaggctaagtgaactgccatgatcacttttgcaggtgccacttgagtcaaccccggtttctcagtctagaggcaaaggccggcatggagaagagcgagagaaaaacaccagggcagactggggcta

SEQ ID NO: 21217 - DNA, 601 bp, Human
ttgcaaatacaagcgttttgcctaccctctgccattgccgccaccctggtgggggtccccttagctctcatctgatgatgacagccccactccctgccgtccagtctactcggccaccttcacagcacagacctcagagcagggcagggttgggagaagtgacgtgctaaggagtgggcacgttcttagaagctgtgctctgggggtttcacggcctccctggagtctgtccatggaacatgcagtaaggctgccacatcacttctcttcaaaacctctcaagtgctcatctctgcttaartgacaagtcatgacccagcctgaaagtacgtctgacttaacttccacgcttcctaggcaaactcaactactcactgtagcttttttttttcttttttttttcaagacatagtctcactctgttccccaagctggagtgcagtggtacaatctcagctcactgcaacctccgcttcccgggttcaaacaattctctacctcagcctcccaagtagctgggattacaggcacccgccaccccgcctggctaatttttatatattttttttagtagagacggggtttcaccatcttggctagg

SEQ ID NO: 21218 - DNA, 601 bp, Human
ttattgtctgacgcccctgccagaaggtaagctccctaagggctgtgatttttttaatctgttttgtccactgacaaatacccagcacttaatacatggcactcagtaggtgctcaataaacaatggcagggaccaggtgtggtcatgcatgcctgtaatcccagtgctttgggaggctgaggacagaagattgcttaaggccaggagttagaggatgcagtgagccgtgattgcaccagcaacaaagcaaggccctgcctctacaagaaacttttttttttttttgagacggagtcttgytctgtcacccaggctggagtgcagtggcgcgatctcggctcactgcaaccttcgcctcctgggttcaagcaagtctcatgcttcagcctcctgagtagctgggattacaggcgcccgccaccacacccggctaatttttgtattttaagtagagacgggtttcaccatgttggtcaggctggtctcgaactcctgaccttgtgatcctcctgccttggcctcccaaagtgctgggattacaggtgtgagccactgtgccctgcctctacaaaaaacttttaaagggagccaggtgtaccg

SEQ ID NO: 21219 - DNA, 601 bp, Human
ctccgtttcttcctcagcacttgctgtgttattgtctgacgcccctgccagaaggtaagctccctaagggctgtgatttttttaatctgttttgtccactgacaaatacccagcacttaatacatggcactcagtaggtgctcaataaacaatggcagggaccaggtgtggtcatgcatgcctgtaatcccagtgctttgggaggctgaggacagaagattgcttaaggccaggagttagaggatgcagtgagccgtgattgcaccagcaacaaagcaaggccctgcctctacaagaaacttttttttttttttgagacggagtcttgttctgtcacccaggctggagtgcagtggcgcgatctcggctcactgcaaccttcgcctcctgggttcaagcaagtctcatgcttcagcctcctgagtagctgggattacaggcgcccgccaccacacccggctaatttttgtattttaagtagagacgggtttcaccatgttggtcaggctggtctcgaactcctgaccttgtgatcctcctgccttggcctcccaaagtgctgggattacaggtgtgagccactgtgccctgcctctacaaa

SEQ ID NO: 21220 - DNA, 601 bp, Human
gttctcactggcaccattattaaactccctacaaccaaaggaagcgtctgtttcttctgttggccaaacatgcttcgttcatcttttagaggcttttacccctaaactctttactctgatttaaggttcaggtttcctcgatgtcaaccagctgaaatctgcaaggcaatgaaccatgccctacgtccagttacttcgtcagagttctggacctgacagtcacgagttgagtggcctcacgggacagtgggctgcctggtgagaggcaggggacaggcccccttggctcacttgcccgccmacgcggtcctcaggccctcactcacctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgtgttcgggcaggggcggcagagacagagcagactcagaaaatgtccctgataccctctcccacaccaccctgccccgggaaaggacaggtccgcgatgggacaaggccagcccccactgggcacgtgctcca

SEQ ID NO: 21221 - DNA, 601 bp, Human
cacagtgccccggaccaatcttgtatccccaacagtgccaagcagatggtagagctcagaaagttgtgtggattccaaccaaggagctcagcagagcagcaggcaccactcccagggcttacggttctcactggcaccattattaaactccctacaaccaaaggaagcgtctgtttcttctgttggccaaacatgcttcgttcatcttttagaggcttttacccctaaactctttactctgatttaaggttcaggtttcctcgatgtcaaccagctgaaatctgcaaggcaatgaaccatrccctacgtccagttacttcgtcagagttctggacctgacagtcacgagttgagtggcctcacgggacagtgggctgcctggtgagaggcaggggacaggcccccttggctcacttgcccgcccacgcggtcctcaggccctcactcacctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgtgttcgggc

SEQ ID NO: 21222 - DNA, 601 bp, Human
tctggggacacagtgccccggaccaatcttgtatccccaacagtgccaagcagatggtagagctcagaaagttgtgtggattccaaccaaggagctcagcagagcagcaggcaccactcccagggcttacggttctcactggcaccattattaaactccctacaaccaaaggaagcgtctgtttcttctgttggccaaacatgcttcgttcatcttttagaggcttttacccctaaactctttactctgatttaaggttcaggtttcctcgatgtcaaccagctgaaatctgcaaggcaakgaaccatgccctacgtccagttacttcgtcagagttctggacctgacagtcacgagttgagtggcctcacgggacagtgggctgcctggtgagaggcaggggacaggcccccttggctcacttgcccgcccacgcggtcctcaggccctcactcacctcctccgaccggctggtgttcctgagctgcagggccaggccgttcaccaggcccggagggatgctacggtccatgctgtccccgacctgggcgaggtgcctggcaatattccggatgatgtcttcttgactttcagaatctgt

SEQ ID NO: 21223 - DNA, 601 bp, Human
cggcgtgtgactggccaccttcttggccagcagcagggccagcaccagcatggtcttctccttctccatgtctctagggtaggcctgcagcagctgctccagggcagtggccaggtccctgttccggtcctgcacagaggggcacacagaacctggtttactaatactcttccctctcaaaggaaagacagtccccagtatgaagaagcacttcaaagtacttattaagtatccagggctgctgggcggaaagaatgagaaacagttgagttctgagaggcaatggaaagggaagactgcratcactccctgcagggggctcggtaagcaaacgcatgtgtggtgagcccatgtgcccactgttagacggtgatgggatacaagaagcctgggtcatccctgcgcccaaggcacttcgagtccagaactagtgaccacctgcgacgccttaggcccattttattggtgcagacctagctgaatggacaggaggaagggggttcctgggggacactagacagactacaaggctggcaaggaccgtcaggcggtcggcgcacatgcagagttacatgggagtgcgccagccactcctgcgttc

SEQ ID NO: 21224 - DNA, 601 bp, Human
tgagcctttgccacccctctgaatggagcatgtctccaatagtaagctgctaaagctccaaaggactctgggtgctcttcgtcacctttacacacagctttctagctcacaacagcaaaaccaaacccgagcaggacagcctgtaacccttgtgctggcatcagaggcaggggccccgctgggcttctcaaccttccagagaaaagggcatgggcggcaggcagggaaggagctgacctcaagggttcttacatttctggctaagctcctcacgtaggtgcgtaggttctggttaataaarttcactgttgtgtgaaagacatcacggagcaaggacggcgtgtgactggccaccttcttggccagcagcagggccagcaccagcatggtcttctccttctccatgtctctagggtaggcctgcagcagctgctccagggcagtggccaggtccctgttccggtcctgcacagaggggcacacagaacctggtttactaatactcttccctctcaaaggaaagacagtccccagtatgaagaagcacttcaaagtacttattaagtatccagggctgctgggcggaaagaatgagaaacag

SEQ ID NO: 21225 - DNA, 601 bp, Human
taaagtgggttataagtttaacattgtctttaaaatagaagtcacagctatcttccagcctgtcttctctaggaacgctgttgacatgccagggctccgtctacactggaagcagctatacagctgtgaccacatcgagctttagccagtcacacttctggaactgtccgttcagtccatcccctagagcaagaaaggagaaaaagccagaatcagctaggctcattcacaaaccaggctccagagctctgtgccacagtagagcaaagctggggtttatgcaaaaacacgttctccagasccctgaagtcctatccgtgcatcctactttttgctacatgggggcaactgcaaaaacaggccgttcaggcggtgaggtgggtattcacatctccaaggcactgacggtgtcaggaggcccctgctgggtcagaggaatcacgattctgcctcagccctcagtctctggtaagctgtccatacagactgctgcacacgtcttgcccaccctttccccctttacatgggtgttggtaaaagctgtccaggaatggtctcaggcttacctccttccaacaattcagctgggtttaatgcctga

SEQ ID NO: 21226 - DNA, 601 bp, Human
gaaacctgctttccaatttaatttttaagtgggaacctgcacagtggaaataaaggcaccgtgtgtagatttacagatgtgcagattcatgtgtggatgatatgaaggccattcaaatacgtgtaaatggacattttcattcaagtatattaatgtagatattttaaagtgggttataagtttaacattgtctttaaaatagaagtcacagctatcttccagcctgtcttctctaggaacgctgttgacatgccagggctccgtctacactggaagcagctatacagctgtgaccacatcragctttagccagtcacacttctggaactgtccgttcagtccatcccctagagcaagaaaggagaaaaagccagaatcagctaggctcattcacaaaccaggctccagagctctgtgccacagtagagcaaagctggggtttatgcaaaaacacgttctccagagccctgaagtcctatccgtgcatcctactttttgctacatgggggcaactgcaaaaacaggccgttcaggcggtgaggtgggtattcacatctccaaggcactgacggtgtcaggaggcccctgctgggtcagagga

SEQ ID NO: 21227 - DNA, 601 bp, Human
gccacagttaagttttcaggtaaatggcatagatggatgtagtggtttcagccattatagacacctagatacaagatatattagtggtgaggctattgatgtaaaagatacagtgatgtgatttcattcgtagtattccatgttgcctgcattctccacaagggacgattttgcagagtctcctctgaaatcattgtggtattttcccttggtgttcactagttataggggttgatttttctgttcctatttcagctccctttccttctacataactcttgcacctgagagtgggagtttygtaggaacacaggaaggagaccaacaaacctttttccccaaaaaataggtgtttccagatctcattactgttatgcacacattcaaataaaacccaacagagtcaaaagctctctcccctagtggcattaggatacaataatgatgttaactaaaagcataggaaaatttggaaaagttaatagagttaaaattctgttggttcttttctttttcttttgcaaaacactaccctccttctccttcagcatctgttgtgtatattctgccctcacatctctgccatgatttcttagggaaa

SEQ ID NO: 21228 - DNA, 601 bp, Human
ttctttctgtgagggaaagatgactttttacaagttagcaagttgctaggcaaccccaaactcctcactcactaaaaggcagcgtgcagagtatcataagcagaaccattccatgagctcagtgagaaataggcagcctaacctatttcgtatggaagaacagatgtccttaaaacttattttggacacagaaattaaaatttggtttaaaataagtgtttcaaaaatctgaaacagaggtagaaagtgttctttatttttcctgacatgttttctcgtgagaaaacactttcctttttakcccatggactgctcccagtccctaatgttaaaagcagttctctttatagaactactaatacaactacgttggttaaacaaaaaaacactgtgctagtgatggctgttgtattggaagttggagtcagccgtgacccgcgcccactgcaggagcccacactgattctgaatcagaaacgagtatgggtcaggtgaaataggtaggcaccctatgtttacacatttcagagcgcaagtataaactagagtgcaccatagctccctgttttaaatatcagataaaatcatcagaaagcgttac

SEQ ID NO: 21229 - DNA, 601 bp, Human
ctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagarcacaaaacatataatttaaatttggtattttttcccccatgatattaggatgataatcatttcaaagcacatgtctagcttcagagtaggatttgttcactggccaaagcctgccatgaaactatggctttcagcatctgtctgctctactggctcttgacaaaactcttgaggtcttcaagaaaagtaatgtactcctggtgctccagggctgtgctgagctccaccagctcatctgcaaaagtgttgtccacccctcggtcggcaaggaaatccattaggtggtcatataaggcctgc

SEQ ID NO: 21230 - DNA, 601 bp, Human
agaacaatatttactagttaaaaaaaaatctgtaatgaacattaaaatgcttttttctccccttgaactaggacccttccttccaaggcccaaaaggttcccccaccttatcaagcactcacccagtccaaggaatctgtgttgagtgtataattagtatccttccattcagactcgccagtggactgaaagctaacttccctgatagagaagatgtcactctcagcctcgtcttcttgtccaacctgagaagaaacaatattgggaaactgaagggttctccaggacaagctagactcakgggaagaaagggggccactgacagcatgaaactcatcaggttttaaccctcttccctcactccccacctctctccccctgctgggctggtctaagctagaaaagtgtttaaatttctgctaaaatagggacaggaagttcccaagggacacactgttccccaggggtgccaagaggctagcactccatcctgcatacctcatcctctggataatgacagtccaacacaagggccttcttgccatcatcattctttataacttcaaccacgaaattgggagttgatgtcagttcaggctgg

SEQ ID NO: 21231 - DNA, 601 bp, Human
cctgagaggctggtgagatggaacagaagcccctttaagagactttccccgtcagaaaatttgccctgcaaggaaaggaagaagcgatggagggtgcctctgctaaacaccgagagcagccctggaacggggaagggaatgcctcacaaagaacaagggctgtagtagagactcatcccttagagtacttgtgggaagtttcataatcacaaagcaggccagacacaccaactagtgacaattttaaggtgcaagaatccacacctgacaaatcatgttccaaagtttgagtcaaaattcytgggacataaggtttagaaccaaaactgctgggctatgcaactctggcaggcaccattccacacaagagtacatgaaggctgggcgcagtggctcacgcctgtaatcccagcactttgggaggccgaggtgggcagatcacgaggtcaagagatcgagaccatcctggccaacacgatgaaactccatctctactaaaaaatacaaaaaaaaaaaaaaaaaaaaaattagctgggcgtggtggtacgcgcctgtaatcccagctactcaggaggctgaggcaggagaattgcttgaacct

SEQ ID NO: 21232 - DNA, 601 bp, Human
aaggaaaggaagaagcgatggagggtgcctctgctaaacaccgagagcagccctggaacggggaagggaatgcctcacaaagaacaagggctgtagtagagactcatcccttagagtacttgtgggaagtttcataatcacaaagcaggccagacacaccaactagtgacaattttaaggtgcaagaatccacacctgacaaatcatgttccaaagtttgagtcaaaattcttgggacataaggtttagaaccaaaactgctgggctatgcaactctggcaggcaccattccacacaagartacatgaaggctgggcgcagtggctcacgcctgtaatcccagcactttgggaggccgaggtgggcagatcacgaggtcaagagatcgagaccatcctggccaacacgatgaaactccatctctactaaaaaatacaaaaaaaaaaaaaaaaaaaaaattagctgggcgtggtggtacgcgcctgtaatcccagctactcaggaggctgaggcaggagaattgcttgaacctgggaggtggaggttgcagtgagccgagatcacgccactgctctccagcctggagacacagcaagactct

SEQ ID NO: 21233 - DNA, 601 bp, Human
ataattctgcgaggactaagaaccacttaatttaataaacttcaataaatgggtaaatcgtatgccatctcaattaaatctcataaaagctgtgatttaaaaaaattacatacacatcataaggtcaattatgaaggaaattcaatttatttatttattattgagatggcgtcttgctctgttgcccaggctggagcgcggtggcgcgatctcgactcactgcaacctccacctcccaggttcaagcgattcccctgcctcagcctcccgagtagctgggactacaggcacgtgccaccayacccggttaatttttactagagccagggttttagtgttagccaggattttctcctgacctcatgatctgcccgtcccaaagtgctgggattatgggtgtgagccaccgcgcccaggctcaatttaaaaacctggaagatgccaaatgtttatctgtgtaatgagattatggatgactataatgcagaaaagtgtaaacactttaacagtttaggagatgatgggggagctgacttaggtcacaaactccccacctctgatggcagcccttactacagtgtaaccccatcctgttacatag

SEQ ID NO: 21234 - DNA, 601 bp, Human
tacaggcgtgagccatcgcgcccggccaattgttgcttctttttcaacaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatyaagaaataataatccctcgagtttacaaaacacttccaagtctgttgtctcatctgattctcccagtagcccattacaggcccagtcattgttactgcctgcattttttttcttttttttttgagacggagtctggctctgtcacccaggctggaatgcagtggtgccatctcggctcactgcaacctctgcctcccaggttcaagtgattctcttgcctcagcctcctgagtagctgggattacaggcgcccgccaccacgtctggctaattttgtatttttagtagagacggggtttc

SEQ ID NO: 21235 - DNA, 601 bp, Human
cctgcatctgccaccttcaacaggcaaggcatctttcttctcagaaaacaaggaaagcaagcaagcatttgaaactgtatatcctttcctgtttcattaaggggttgggctttgttttcctgaaagcttttgttcttctgtcagcatattcaaaacaaccaaaaggcgttacctgctctgaaatccctgagatgcctatcctcagaggtgcttttggctgtcttatgcagcagaaggaagatttgcttcctagctgattctccagtcctcaggacgttcacaaatggcaaattataagccygtgttgcctctgctgactgcaacttgggcctgtcagcccagaataatatttgcatgatgatttggccaaatcaggcctggctgtctgtcatcctgggctcccttctctccctccaccagacgaacaaaccccgtggcccctcctcctcagatagctctggaatcccgctgcttttccccatccctgatctccccacccttcctttctaccccctaccacctctctcaggtcccaatagtctctgtgctccactcactcccctccatcaattcttggctcttccaccagaggggtccttct

SEQ ID NO: 21236 - DNA, 601 bp, Human
gttcaagggattctcctgcctcagcttcctgagtagctggggttacaggtgtgtgccaccatgcccagctaatttttttttgtatttttagtagacagggtttcaccatgttggtcaggctggtctcaaactcctggcctcaagtgatccgcctgactcagcctaccaaagtgctgattacaagtgtgagccaccgtgcccagccacactcactgattctttaatgccagccacacagcacaaagttcagagaaatgcctccatcatagcatgtcaatatgttcatactcttaggttcatratgttcttaacattaggttcataagcaaaataagaaaaaagaataataaataaaagaagtggcatgtcaggacctcacctgaaaagccaaacacagaatcatgaaggtgaatgcagaggtgacaccaacacaaaggtgtatatatggtttcctgtggggagtatgtacggaggcagcagtgagtgagactgcaaacgtcagaagggcacgggtcactgagagcctagtatcctagtaaagtgggctctctccctctctctccagcttgtcattgaaaaccagtccaccaagcttgttggt

SEQ ID NO: 21237 - DNA, 601 bp, Human
accaaagtgctgattacaagtgtgagccaccgtgcccagccacactcactgattctttaatgccagccacacagcacaaagttcagagaaatgcctccatcatagcatgtcaatatgttcatactcttaggttcatgatgttcttaacattaggttcataagcaaaataagaaaaaagaataataaataaaagaagtggcatgtcaggacctcacctgaaaagccaaacacagaatcatgaaggtgaatgcagaggtgacaccaacacaaaggtgtatatatggtttcctgtggggagtaygtacggaggcagcagtgagtgagactgcaaacgtcagaagggcacgggtcactgagagcctagtatcctagtaaagtgggctctctccctctctctccagcttgtcattgaaaaccagtccaccaagcttgttggttcgcacagcaagagtacatagagtttgaaataatacataggattttaagagggagacactgtctctaaaaaaaaaaacaacagcaacaacaaaaagcaacaaccattacaattttatgttccctcagcattctcagagctgaggaatgggagaggactatggga

SEQ ID NO: 21238 - DNA, 601 bp, Human
gaggcagcagtgagtgagactgcaaacgtcagaagggcacgggtcactgagagcctagtatcctagtaaagtgggctctctccctctctctccagcttgtcattgaaaaccagtccaccaagcttgttggttcgcacagcaagagtacatagagtttgaaataatacataggattttaagagggagacactgtctctaaaaaaaaaaacaacagcaacaacaaaaagcaacaaccattacaattttatgttccctcagcattctcagagctgaggaatgggagaggactatgggaacccccttcatgttccggccttcagccatggccctggatacatgcactcatctgtcttacaatgtcatcccccaggagggcccggaagaaaacagtgcctatgagcagttgctgtctcgcttggaagaaatcgctgaggaaggtcagtttgttggtctggccactaatctctgtggcctagttcataaagaatcaccctttggagcttcaggtctgaggctggagatgggctccctccagtgcaggagggattgaagcatgagccagcgctcatcttgataataaccatgaagctgacagacacag

SEQ ID NO: 21239 - DNA, 601 bp, Human
aaactcctgaccttgtgatccaccagcctcggcctcccaaagtgctgggattcattttttctttttaatttgctctgggcttaaacttgtggcccagcactttatgatggtacacagagttaagagtgtagactcagacggtctttcttctttccttctcttccttcctcccttccctcccaccttcccttctctccttcctttctttcttcctctcttgcttcctcaggcctcttccagttgctccaaagccctgtacttttttttgagttacgtcttatgggaagggcctgcacttagygaagaagtggtctcagagttgagttaccttggcttctgggaggtgaaactgtatccctataccctgaagctttaagggggtgcaatgtagatgagaccccaacatagatcctcttcacaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcaggtgggcctggggtgtgtgtgga

SEQ ID NO: 21240 - DNA, 601 bp, Human
atatgaggggtctctgactacaccgccctgtgcccagggtgtcatctggactgtgtttaaccagacagtgatgctgagtgctaagcaggtgggcctggggtgtgtgtggacacagtgggtgcgggggaaagaggatgtaagatgagatgagaaacaggagaagaaagaaatcaaggctgggctctgtggcttacgcctataatcccaccacgttgggaggctgaggtgggagaatggtttgagcccaggagttcaagacaaggcggggcaacatagtgtgaccccatctctaccaaaaaaaccccaacaaaaccaaaaatagccgggcatggtggtatgtgcctagtcccagctactcaaggaggctgaggtgggaagatcgcttgattccaggagtttgagactgcagtgagctatgatcccaccactgcctaccatctttaggatacatttatttatttataaaagaaatcaagaggctggatggggaatacaggagctggagggtggagccctgaggtgctggttgtgagctggcctgggacccttgtttcctgtcatgccatgaacccacccacactgtccactgacctccctagct

SEQ ID NO: 21241 - DNA, 601 bp, Human
tgtcatctggactgtgtttaaccagacagtgatgctgagtgctaagcaggtgggcctggggtgtgtgtggacacagtgggtgcgggggaaagaggatgtaagatgagatgagaaacaggagaagaaagaaatcaaggctgggctctgtggcttacgcctataatcccaccacgttgggaggctgaggtgggagaatggtttgagcccaggagttcaagacaaggcggggcaacatagtgtgaccccatctctaccaaaaaaaccccaacaaaaccaaaaatagccgggcatggtggtatgygcctagtcccagctactcaaggaggctgaggtgggaagatcgcttgattccaggagtttgagactgcagtgagctatgatcccaccactgcctaccatctttaggatacatttatttatttataaaagaaatcaagaggctggatggggaatacaggagctggagggtggagccctgaggtgctggttgtgagctggcctgggacccttgtttcctgtcatgccatgaacccacccacactgtccactgacctccctagctccacaccctctctgacaccctgtggggacctggtgactc

SEQ ID NO: 21242 - DNA, 601 bp, Human
gaggcagatcatggtggggattcccccattgtccccagaggctaattgattagaatgaagcttgagaaatctcccagcatccctctcgcaaaacaatccccccccctttttttaaagatagggtctcactctgttgcccaggctggggtgttgtggcacgatcatagctcactgcagcctcgaactcctaggctcaggcaatcctttcaccttagcttctcaaagcactgggactgtaggcatgagccactgtgcctggccccaaacggcccttttacttggcttttaggaagcaaaaacrgtgcttatcttaccccttctcgtgtatccaccctcatcccttggctggcctcttctggagactgaggcactaggggctgcctgagaactcggggcaggggtggtggagtgcactgaggcaggtgttgaggaactctgcagacccctcttccttcccaaagcagccctctctgctctccatcgcaggtgacatcctagccctggtttttggcctcctttttgctgtcaccagcgtcgcgttccttgtgcagatgagaaggcagcacaggtattacactgaccctttcttcaggcacaagct

SEQ ID NO: 21243 - DNA, 601 bp, Human
ggcagcacaggtattacactgaccctttcttcaggcacaagcttcccccacccttgtggagtcacttcatgcaaagcgcatgcaaatgagctgctcctgggccagttttctgattagcctttcctgttgtgtacacacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgcmaagaaattttttaaaataaatatttataataaaatatgtgttagtcacctttgttccccaaatcagaaggatggtatttgaatttcctattactgttattagcacgaatttagtggtaatgcatttattctattacagttcggaggtcagcagtcagatgtcagtagggcttgttcctccttccacacatcactccaatctcttgctcccattgtcacaactcctacctccacatttgacctccttgtctcctcaagaacccttgggattacactgggcctaactagataaccaaggata

SEQ ID NO: 21244 - DNA, 601 bp, Human
acttaatggtaaagatcctctcctccaaagaaaagcgcctaccactgtctgcgggttctgcacaggggcacagcaaacctttctctgtgcttaccccaatcagaatgccacagtcatgtctctactttctaaacgtggatcaggggaacgctgttttaaatcttggctttgcatctcctccctggttagcaagttcccaagccacatcttcagagctggcggtgcccgggagtacacgcaaacattttaacaccaaatctgcgccaagcgccactagaaagcaacgtgcttcccgacccarcctcagcaaaggaaaacggagcatcctttcttgagaatctactatttggtactacaccttccctgctccccgcagcaatgattttactttatcattgaagagccttcagcccaggggcggctgagcgctcaggagtgttaggaaagaagcaggcggaaactttaccgttcactggggccgggctggaaggctgttcctttaagatcaccagcaggagcacggccgccgcgtgcaggctgcgccggggcatcttcgcgggctcctgcggggcgggcgcgggctgtgccgggggctcccggt

SEQ ID NO: 21245 - DNA, 601 bp, Human
cgcggtggtgacataggactggggacttgttgaaaggcagcagcctccagagcaacattccctgccctcctctctgtgagtgagctggcttgggactccagactcggcactttgggtataaatggcagtgtctggaggggctcaggagctggagggctggggagaagcggcgttgtaagtgaggatggtgagtcaagggggttcatcgggtgaggatcagggccccagctcagctctgacctcaggaagtctctctaaaagtgtgtgtatgtgtgcgtgtgtgtgtgtgcacgcgcacgamagtgtgctttattcaggaattgcaccccctggttccccacttctagctgtaagaacagaaggcttaaaaggattaaactgattccacaagcgaggccaggccaaggcctcagtggcatcctgagggagcaggcccttcctggaggggaatagtttccttcccaaggaaggttatctgttccatctgggaaacctgggaggctcagcctgaaacctgttagaacctgcagacccagctggtactgggcagggaggttcccctggagggaatgcccagagaaaatggtatttaccaagatcc

SEQ ID NO: 21246 - DNA, 601 bp, Human
acccgggaggcggaggttgcagtgagctgagattgtgccattgcactccagaatgggtgacagagcgagactctgtctcaaaaaaaaaatttccctaagcttagacacataaagttttatatacaagtcatttcagaaggtccacagactcccctgaaaccagctatgggtgcattgagagttgagggtcccaagatcaacctcccttgaattagtaattagacattcagaaccacggggaaaccaaacttgtatgtgacccccaagtttactgctcacccctttgctgaaacaacaatgaaaaaaaataaagaaagcattgctttcaaaccaagctatagaagacataaaacctcttctggacattttcttcagtcttttgtgtgagaggttcattattaagatgtaatcccagaccttagagatataataagccagatcattacctcttagcaggcagaacagttggaggcccaggatgtaaaattccacaaataacagaggagttcacccttacttttcccctgaggaggcacaggccactccagtgatcctggaggccactagaaacacatctgctgcctgagcactgctgccttgc

SEQ ID NO: 21247 - DNA, 601 bp, Human
cctgagtagagaagcatcccactgtgtgtctcaggtgactcatccaatgaggggactgtgcaactcctaaatccctgcctcccaacttttcccagggtctccgtggttctcgacccacaagggtacagatggaaaagcgtacccttgtggggaagcacctcacatcccctttctctcgtgggaattagtttgcagtaaaacttaagtgacaagcaatctggtcacttatcactcctggcatttcctacttaaggaaattgtgttttttaaaagttaaaaagtgaacttggctttttttttwaaaaaaagccggtttaatctcatattttttgttattctgttccatttctttgcctcagtgtttgtaattaattttgtttttaattttccaatgtaattggtaatttttatcaaattacacttgcacgtggtttagaaagtcagatggttctacaaagctgtgtaacaaaaacctcagttccctgacattccctaaccatgtactgctccctagagcaaccactttggatctttttaaaatgattcttttgctattatctccatatctctatataacatgctaatattgttttaccttgat

SEQ ID NO: 21248 - DNA, 601 bp, Human
agcagtcaagccagagttcaaatccaggttggtctgactccaaagcctgggcaccccccgccaaactgtgtggttccttgaatcgtttatggtccagaattcactccagctgcacagccaatgaactacagtgctcaggccggtctcctgccccatcctgagagatgtgcttcttctgggaagtgcggccctggcaggatcctcagagcccagagcctccagcatcccctggagagagtgctcctggaatctctcaaagacacccccgccccgccccacccctcctcctggatgcttccayggaacacctccctgccagatggaaaaggacaggcctggcagctgagggagactcagacatacccctcaggtctccaaggcctctccctcacctgaatggccattgttggtcaggagaaactgcttgttggcagacagattgtagccttggaactcgaggggcgtgaggctggcgtcatactggaggatgtcactgtgcaggtctatgggggactgcagcaggcccccacacgacgggtacttcttggaccagctattctccccatcaggacctggacacagagatccatgctcaagattt

SEQ ID NO: 21249 - DNA, 601 bp, Human
acagcaacgataactgctatttatgaagcatttacttcactctgtatgccagaccccaacgtacataatctccagtcttcacggtatccatcaatatgtccatttccagatggaagctcaaggagactaaaattctcacctagattctcatggctcgtaagcagtcaagccagagttcaaatccaggttggtctgactccaaagcctgggcaccccccgccaaactgtgtggttccttgaatcgtttatggtccagaattcactccagctgcacagccaatgaactacagtgctcaggccrgtctcctgccccatcctgagagatgtgcttcttctgggaagtgcggccctggcaggatcctcagagcccagagcctccagcatcccctggagagagtgctcctggaatctctcaaagacacccccgccccgccccacccctcctcctggatgcttccacggaacacctccctgccagatggaaaaggacaggcctggcagctgagggagactcagacatacccctcaggtctccaaggcctctccctcacctgaatggccattgttggtcaggagaaactgcttgttggcagacagattg

SEQ ID NO: 21250 - DNA, 601 bp, Human
caacccatgcccagagagggaaagatagcatcaaaatgatgcaaacagcatgacatatgaagaaaggctgagaagtttgggggagcagtgagcccagtgtgagtcagcaggagatttttatctgcacagataggaaggcaatgtctaaaagaagggcatgtatgtcccactgggccaccctgggaatactgcctccccagcagcatcactcagtaaaagacacagggacaaacttagcatgttcaggagaagaaagggaccaggacagtgcagatgagctacaggctagtggagtggctgygccccttgtgccagggccagaggtggggcagagagcctgaaggcagcctgtcccatgctctggtgttatctgcacagcagccaggtcgagaaggtgccacaccacccactgcagagcagcctctgccagactggcagccctacttacctcggcggcgaagtgctgtccgctgacggtgtgctcagagccgtgcgggtcattcgggttcccccagtgcaggtgcagctgcgtggcactgtagcgagactggaggccctggatgtgcatgtccgagggcaggttcagcttcactgcggggag

SEQ ID NO: 21251 - DNA, 601 bp, Human
cttccaaggtccttccttagaggacccactttagggacaccctgatgccttttctctagtattggcatttatggtccatcttaaccagactcttggtctgatgctgtgacttaatagcagaaaatacaagaagtagaaatattttaaaacacataaaccctgccaatctacaccctaacctcctttgtgaaaggaaaataaatctcgagacccccaaatcactaagccaaagagaaaagtcaagctgggagctgcctcccattctattcctaaataagacggctacaaagataaaaaagcwacacacctcacattttgcccactaggaaattcactgtgggccgcaaggtctttaccctaaaacagttctgttgaatttcaccgtgacaatgtaaatggataacttatcttcatgggttcaggacaaaggatagaactcaaagtcatccctctgctcacctgagacaaatgcatttctaattgcttcctctgcccatgtctgttttattttgtaagaatgcagattcgctgagctagatgaatgcacaagtgactattcctctacccctctctcacatgtgaacggctgatcaaaaactca

SEQ ID NO: 21252 - DNA, 601 bp, Human
agctgattatcaacaggtatgcatggaacaaaaggtggaatcccaatctcatccctgcttcaaatttcacctaagaaccttttaaatatctcttacctcaatgagaacagccaggacagcgaggccttctgacttgttgctggcagtgctggcgtcaggataaaggtctgagttataatggacaatgtgcagctgcagtgggggagaagccacccattaggagataagcgactcatgggagcctgtcgcttctgcagaagacttgactccaactgtgaggacagaaccccagccccctcakccccccagactaggttaggtctctcagaccctccccttattttgccaaggataaggacatgtgcccaaggtggtcagggcatggcttgttttgatacattttagagacataatacatcaatcaatacgtacaagatacactggtttgatctggaagggcaggaaaactcaaattggaggcttccaggacataggtagatttaacttttttctgactggcaatcggttgagagttatcatcaatagaaaggaatgtctgggttccaataaggggttgtagagaccaagattttatcatgca

SEQ ID NO: 21253 - DNA, 601 bp, Human
ccacgtcagacaaatgagcatgttgggaaatgaggtacatacagcctcattaggaaaaaaaaacatgcaagccaatcagaagacattcctctatcttgggataaaaaaagaattcattccagggtacatatagagcaggggtgcccagcccccaggctgtggaccagtaccggtctgtggcctgttaggaactgggccgcacagcaggaggtgagcagcgggcaagcaagcattacagcctgagctccgccccctgtcaaatcagcagaggcctcccattctcataggagcacaagccctwttgtgaactgcgcatgcaagggatctaggctgtgtattccttacggaatctaactaatgcttgatgatctgaggtggaacagtttcatcccaaaaccatctccctccctggtccatggtccgtggaaaaattgtcttctatgaaactggtccctggtgccaaaaaggttggggaccactgatctagaggtcccttggatctagaggagcttggatggcaggagttgtatcaagagttcaggcatctgatggggcagatggagtttgatgatccctttccagcacaggtcctccccaactg

SEQ ID NO: 21254 - DNA, 601 bp, Human
tcagcttaaggagttgggcttgaatgtcctggggcatagggtaccgtgtgtgctcttgatgatccagatatgagcctgaaggctttgactaacatccatgtcacacagaacttaaggagctctgagttcacaaaagccacgtcagacaaatgagcatgttgggaaatgaggtacatacagcctcattaggaaaaaaaaacatgcaagccaatcagaagacattcctctatcttgggataaaaaaagaattcattccagggtacatatagagcaggggtgcccagcccccaggctgtggacsagtaccggtctgtggcctgttaggaactgggccgcacagcaggaggtgagcagcgggcaagcaagcattacagcctgagctccgccccctgtcaaatcagcagaggcctcccattctcataggagcacaagccctattgtgaactgcgcatgcaagggatctaggctgtgtattccttacggaatctaactaatgcttgatgatctgaggtggaacagtttcatcccaaaaccatctccctccctggtccatggtccgtggaaaaattgtcttctatgaaactggtccctggtgccaaaa

SEQ ID NO: 21255 - DNA, 601 bp, Human
gggttccatggcattttcatgcacctgcatagattatataaccctttcccaaggcagtttctgaggtaggatgttgctgcttccccacatgtttcatccatctcttggttcatcatgtcctcattcctgtccacccacctgctgccatttaccaggtgactcagagcagaagcttactgtaaagaggagcagctgtgaggctgccctggacgcatgaagctggcgtggggctgtgagccagggtgtagtgctggccccagccccgtctcctggggagccatttttcttctcatgaatttargctgtggaggacaggtatgagcagtgacatggaactcagatgacctaactttgggtctcagctttgtcactaacccgcgggtgatcccacagacttctactcttctctctcatctcctatcaaataagaagctttagaggtgatggctaaggattttgttccccagtttgcactagaccttgagcttcttgggggcagggaccctcacttagtcattgctgcaatcccatctcttaaatgatttcatctgatcctgtctttattctgccctgtaaaggaaccaggctctctcctgcctgg

SEQ ID NO: 21256 - DNA, 601 bp, Human
aagaggctagctctccgctcttgcacctgggagaagcctctggaaccagcttctgtggggccgggtgggagatattagaaagcagagggaaagccacagaactgcttccctccacagtgggtgagtgggagctgggcagcgctgggtttatcttcccagcacccgagacttcagggaaaggcagtgctgttagtttccaattatacctggaatctgccctgcgtggagggaaacctggggtgatggagtgctccttaacctccacagagactgagttcctctcatgaacttaaattagagsccagctctcaaccagagggtcgcagggcttgttctgatggtcatatcagaaggaataaaggagggagttaagagtttcacaggccatctgattgcgggttccatggcattttcatgcacctgcatagattatataaccctttcccaaggcagtttctgaggtaggatgttgctgcttccccacatgtttcatccatctcttggttcatcatgtcctcattcctgtccacccacctgctgccatttaccaggtgactcagagcagaagcttactgtaaagaggagcagctgtgaggctgcc

SEQ ID NO: 21257 - DNA, 601 bp, Human
aggcagaatgacctcctcacctgatcccctgggaagaggctagctctccgctcttgcacctgggagaagcctctggaaccagcttctgtggggccgggtgggagatattagaaagcagagggaaagccacagaactgcttccctccacagtgggtgagtgggagctgggcagcgctgggtttatcttcccagcacccgagacttcagggaaaggcagtgctgttagtttccaattatacctggaatctgccctgcgtggagggaaacctggggtgatggagtgctccttaacctccacagmgactgagttcctctcatgaacttaaattagaggccagctctcaaccagagggtcgcagggcttgttctgatggtcatatcagaaggaataaaggagggagttaagagtttcacaggccatctgattgcgggttccatggcattttcatgcacctgcatagattatataaccctttcccaaggcagtttctgaggtaggatgttgctgcttccccacatgtttcatccatctcttggttcatcatgtcctcattcctgtccacccacctgctgccatttaccaggtgactcagagcagaag

SEQ ID NO: 21258 - DNA, 601 bp, Human
caggcagaatgacctcctcacctgatcccctgggaagaggctagctctccgctcttgcacctgggagaagcctctggaaccagcttctgtggggccgggtgggagatattagaaagcagagggaaagccacagaactgcttccctccacagtgggtgagtgggagctgggcagcgctgggtttatcttcccagcacccgagacttcagggaaaggcagtgctgttagtttccaattatacctggaatctgccctgcgtggagggaaacctggggtgatggagtgctccttaacctccacakagactgagttcctctcatgaacttaaattagaggccagctctcaaccagagggtcgcagggcttgttctgatggtcatatcagaaggaataaaggagggagttaagagtttcacaggccatctgattgcgggttccatggcattttcatgcacctgcatagattatataaccctttcccaaggcagtttctgaggtaggatgttgctgcttccccacatgtttcatccatctcttggttcatcatgtcctcattcctgtccacccacctgctgccatttaccaggtgactcagagcagaa

SEQ ID NO: 21259 - DNA, 601 bp, Human
gtctcacaaggcgcctggttcccgtggcagccagggagctctcagccaacttcttgagggcatcagtgccagagctgcattcacagaagatcccaatgtcttggcaccacactcccgcaccccctccccccagcactgcctctcctcaccttgggagaaggaggtgtataccagcctctcatcgaacttctggacctgccggaagttgttgatcatttctctgggggaagggtcgtccatgtgtgtgcagtacagggctgtctccaaagccagcagctgagggcaagagcagaaatagccygcaggcagaatgacctcctcacctgatcccctgggaagaggctagctctccgctcttgcacctgggagaagcctctggaaccagcttctgtggggccgggtgggagatattagaaagcagagggaaagccacagaactgcttccctccacagtgggtgagtgggagctgggcagcgctgggtttatcttcccagcacccgagacttcagggaaaggcagtgctgttagtttccaattatacctggaatctgccctgcgtggagggaaacctggggtgatggagtgctccttaacctccac

SEQ ID NO: 21260 - DNA, 601 bp, Human
catttgtccccgagttgtaaggtgcagattaaaggttttgtcatagcagaaggaaatcagagggagatgccccgtctccagaggaaagaagttgagtttcccaagcaaaacctaagcagagagtgcacattcttgtctgaaagcttggagaagcagcagaatttccaggacacttgaaagcacgctctggcaaagccccggatgaaagtgttttccaaccattaatggcccaccagcatggcttggtttgtgattccagaattcagaccacttcacaatctcacacagttacagcaagcarctttgaattcctgctgcttggtctgagagtgcatcccatccatcgatcggatggctctggggtggccatggtcccaaggcaaggaggcacccagcagaggatccctgaggcctggcatgtttgcagattgagctacagagaacaccttgaggtgtcgcaagtgtccagagagccgaagtgtgtagggtccaaagcaaggtccttcctggatgtgcccgggagctccggggacctcaagcgtgggcctcagtctccatcttggtggctggcttgtaaatgactcccttgttatcacctttt

SEQ ID NO: 21261 - DNA, 601 bp, Human
gtggaacttgaacctgccattccctaaggtctgtgcagtgtctgtgatccagaggacaggactgtgaaagtgtccctaatatatcacaatgtatatctcttgttttctttttctctctacaacttgatccttcctgtccccatttgtccccgagttgtaaggtgcagattaaaggttttgtcatagcagaaggaaatcagagggagatgccccgtctccagaggaaagaagttgagtttcccaagcaaaacctaagcagagagtgcacattcttgtctgaaagcttggagaagcagcagamtttccaggacacttgaaagcacgctctggcaaagccccggatgaaagtgttttccaaccattaatggcccaccagcatggcttggtttgtgattccagaattcagaccacttcacaatctcacacagttacagcaagcagctttgaattcctgctgcttggtctgagagtgcatcccatccatcgatcggatggctctggggtggccatggtcccaaggcaaggaggcacccagcagaggatccctgaggcctggcatgtttgcagattgagctacagagaacaccttgaggtgtcgcaa

SEQ ID NO: 21262 - DNA, 601 bp, Human
agactctcccagatcatccatgtcttctcattctctttgtccctctagctctctctcccttctcatccccaccaagaagtggaacttgaacctgccattccctaaggtctgtgcagtgtctgtgatccagaggacaggactgtgaaagtgtccctaatatatcacaatgtatatctcttgttttctttttctctctacaacttgatccttcctgtccccatttgtccccgagttgtaaggtgcagattaaaggttttgtcatagcagaaggaaatcagagggagatgccccgtctccagargaaagaagttgagtttcccaagcaaaacctaagcagagagtgcacattcttgtctgaaagcttggagaagcagcagaatttccaggacacttgaaagcacgctctggcaaagccccggatgaaagtgttttccaaccattaatggcccaccagcatggcttggtttgtgattccagaattcagaccacttcacaatctcacacagttacagcaagcagctttgaattcctgctgcttggtctgagagtgcatcccatccatcgatcggatggctctggggtggccatggtcccaaggcaa

SEQ ID NO: 21263 - DNA, 601 bp, Human
acggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggcctygtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggtactttagacctctcaagtgtttgggaccctctggtggggtcccatcatctcctccccttcccttccagaccctgctcagtccagctagctgtgggcacagccctggctaggtg

SEQ ID NO: 21264 - DNA, 601 bp, Human
ccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggcctcgtttctcccattttacagtgaggtggtcgatctccaaggtccctgtagattggggamtggttgtgccctctgcgccaggggcctcctcaccatctctcctttgccggctcccgccctcttcactcttctgttttctttcagaatgaaaaaggcaggcattgacctccctctgaggcagtttccaggtactttagacctctcaagtgtttgggaccctctggtggggtcccatcatctcctccccttcccttccagaccctgctcagtccagctagctgtgggcacagccctggctaggtgatcttgtattttctttgtgggactgtaactcagctaaccttggcctgagggctggca

SEQ ID NO: 21265 - DNA, 601 bp, Human
agatgggctgggctgtgggaggctggcctgcttgcagtaacttgccttcccccattcctgctgctgggttcagtggggctgcccttctccccagtagcgcatttcccttcagagattcatgtgcggatgggaagggaactaaggccaagaaggctcctggagtcccctggcaaatatgtggcaccccctgggacctgagtcaggcctgcttcccaggctggaagcccccctctgccggccggtggagatagttcagcctcctgcctgccacgtcaccaccaggagcaggcgctaagctgcygcgggcctagcgggctgcctgaggaatcccaaaccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctggtggcctctgctgtggtctgagctccagcatcactggtctggatcagaggtggattttgagtagggtggccatatgcctattgtcctggcataataattagtagtgcccattttactcttata

SEQ ID NO: 21266 - DNA, 601 bp, Human
tggcaccccctgggacctgagtcaggcctgcttcccaggctggaagcccccctctgccggccggtggagatagttcagcctcctgcctgccacgtcaccaccaggagcaggcgctaagctgccgcgggcctagcgggctgcctgaggaatcccaaaccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctgktggcctctgctgtggtctgagctccagcatcactggtctggatcagaggtggattttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagat

SEQ ID NO: 21267 - DNA, 601 bp, Human
ctgccggccggtggagatagttcagcctcctgcctgccacgtcaccaccaggagcaggcgctaagctgccgcgggcctagcgggctgcctgaggaatcccaaaccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctggtggcctctgctgtggtctgagctccagcatcactggtctggatcagaggtggmttttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccaccttcctccccttggaccctttgcttat

SEQ ID NO: 21268 - DNA, 601 bp, Human
ccagttatttggagcttgcttgagaagcccctcccagtcctttgaggttctggctggtgggggtgggggctgtcaagatggtacctgccacgtggcatggctgggagtgggctcttcagctgcctcctcagggaaggaaggctggtggcctctgctgtggtctgagctccagcatcactggtctggatcagaggtggattttgagtagggtggccatatgcctattgtcctggcataataattagtagtgcccattttactcttataagtgtccttgtttgtgcaataaattatatggttrctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccaccttcctccccttggaccctttgcttatcttatactgcaccttcaaggctccgaggagggaggcagtcccgggagatggggagcctgtccaggtttttgggatggcagcagtagaatcttcccagaaatac

SEQ ID NO: 21269 - DNA, 601 bp, Human
atcactggtctggatcagaggtggattttgagtagggtggccatatgcctattgtcctggcataataattagtagtgcccattttactcttataagtgtccttgtttgtgcaataaattatatggttgctctgcctttgaggctccagttctggcagggaaggagccagagctgggagggaggtgtcttggggtttattctaggccccaagatatccccttcattttagggtgagactcagatctccccgctccttccagacatttttagatctctgggccttccctcctctccccacctycctccccttggaccctttgcttatcttatactgcaccttcaaggctccgaggagggaggcagtcccgggagatggggagcctgtccaggtttttgggatggcagcagtagaatcttcccagaaatacagtggtccccaggcagccagagtcctgagggtcttccaccaggatttcaaatgttcggtcttcttcaaggatgactacaagttgggatctaccagagcagtgggatcgcagcctccaccaggattccttctatccttccctttgccctgtcatctctcctgtgctgttgcatg

SEQ ID NO: 21270 - DNA, 601 bp, Human
ccttggaccctttgcttatcttatactgcaccttcaaggctccgaggagggaggcagtcccgggagatggggagcctgtccaggtttttgggatggcagcagtagaatcttcccagaaatacagtggtccccaggcagccagagtcctgagggtcttccaccaggatttcaaatgttcggtcttcttcaaggatgactacaagttgggatctaccagagcagtgggatcgcagcctccaccaggattccttctatccttccctttgccctgtcatctctcctgtgctgttgcatgatgtakaggaggataatggcccgaagggagagagggagtgtggaagtatcccaggaacagagactgtcccaattggaggccccagagagggaactggggcttgtccttggggccactgctactgctggggcttggggaggaggcctgagggcaaccctgaagccgtggagcagatggcctgtgtggcagtggctgtcagattggagggcagaatggaatctgatgtggctccagcttctttgaaggctgagtgcacatctggccagctgctggtgatggggaagggggtcactgctctattgagct

SEQ ID NO: 21271 - DNA, 601 bp, Human
aagcctcctccccagccccaccgagtcttcaaaggagttggtcccccaggagcttttgtcctggggatttcccatccgcactgggagcactgtgggtagatgggcattccaagttcctgcccagacagaagccatgggcatggagacctggacctttcagcttggaaaagggagactgaggctgagtggacacaggacacacacacactctcagggtcacccttggggcagcaaagtggagcatcttggctccccatttaatgagtgacccaactggtgactcattaacatcccagagcasaatgaaaggcatgggggcggggcagccctccggctctgtccctcatcccttgcccaggcatctgggtttcctgcagattctcagctcagctgctgctttttctcactggaaaagggctcccagggctatgtgagatcagggctgaccactctataaactgatgaggaccccaggtctggccaagtgaccctgttttaccttcgttcaggaagagctgaggcctactgtgtactaggcacgggagatatagtggcaaccagattggctagcttttctgtcctggaggccacagcctactta

SEQ ID NO: 21272 - DNA, 601 bp, Human
gaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctggggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactcsacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggtcctcctcctcctccca

SEQ ID NO: 21273 - DNA, 601 bp, Human
gagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgytagtcaacgccatgttcttcaagcgtgagtcgggggcgcgttcaggggtcctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgta

SEQ ID NO: 21274 - DNA, 601 bp, Human
gctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagcgtgagtcgggggcgcgttcaggggccctcctcctcctcccaggaccccctgcaagagttaggacgacattccgtgcgctccattcttcactgcctctcatttatgctgtgacaacccagggaggcaggactgtcactcagctttttgtacagactggaaactagattcagagacaggtagcagcgtgtaaaggaatggttcagggagcggaggccccagagggactccatggaatgtattccgaccgaatttcgtcaaagtgctcgtccttgtgtatcttggaatgaataacatttaataatccattctgcctcagtagtgagct

SEQ ID NO: 21275 - DNA, 601 bp, Human
ttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattattattwtttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtat

SEQ ID NO: 21276 - DNA, 601 bp, Human
aataccagcagctaaatataacggaacattcctgtatgctaggcgttcttctaagcactttatatgtattattattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacrtcaagtgatcctcctgcctcagcctcccaaagtgctgggattacaggtgtgagccaccgtgcccagcctttatacgtattaaactcttttaatcctcaaaacgactttattaggtaggactataagtttcatcttagagatgaggaaactgaggctcagaaaggttaagtaacctgtgcaaagtcacacagctagtaattcagacatcttgcaccagagctaaccctcggtcactgcactgcctctgaggtctgaagtgcccccagttatagattgtttaagctagaggattatctacca

SEQ ID NO: 21277 - DNA, 601 bp, Human
tattattttttttttgagatggagtctcactctgttgcccaggctggagtgcaatggtgccatctcgactcactgcaacctccacttcctgggttcaagcgattctcctgcctcagcctcccgagtagctgggattacaggcatgtgccaccacccccagctaatttttgtatttttaatagagacgggatttcaccatgttggccaggctggtctcaaactcctgacatcaagtgatcctcctgcctcagcctcccaaagtgctgggattacaggtgtgagccaccgtgcccagcctttatacgtattaaactcttttaatcctcaaaacgactttattaggtaggactataagtttcatcttagagatgaggaaactgaggctcagaaaggttaagtaacctgtgcaaagtcacacagctagtaattcagacatcttgcaccagagctaaccctcggtcactgcactgcctctgaggtctgaagtgcccccagttatagattgtttaagctagaggattatctaccatccaataatcagactggtagctatgggtcatctaggatggccagaaacttaacacacattctcaagattctc

SEQ ID NO: 21278 - DNA, 601 bp, Human
tgcaccagagctaaccctcggtcactgcactgcctctgaggtctgaagtgcccccagttatagattgtttaagctagaggattatctaccatccaataatcagactggtagctatgggtcatctaggatggccagaaacttaacacacattctcaagattctcccttgcaaccaccctgggtagtgggcagaggctcagagagaagcaatgactccctaaggttccccaggctcataagtggtggagttgcaattagacctcaaggtaaaaacataatagccgcctttttgtcaatcgagrgatatttttgacttacccaaaaaaggaaactttcgtgtcattctttccttggatgccacaaatggttctcacctgcagaatcgatccagacttgctgcccagagagcttggagagataaagctggagatgaagtggggcttaggctccaaaccagggacaagtggagctcgtactggtctgtgctgtagaccctgggagttcctggagaggggtcactgtctctctcctggtcctggccctgatccttccccagccccttctccagtggctgttgtcccacccccttctccccttgttcc

SEQ ID NO: 21279 - DNA, 601 bp, Human
cttgtttttctgagtctcagcttcctcatctgtgaagtggcaattagaagcccttgtagggttgcagtgagaattgagaaagctgtgatttgaagtgccagtgccatgcctggcatacagaaggtgaccagggggtggttctctcctctctgaggagcggtcagggtagtatggggtggagggtttgagggtggaggagcctggcagccatggcctcacctggcacacctccttgttcccacagaaacacctggctgggctgggcctgactgaggccattgacaagaacaaggccgacttrtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacaca

SEQ ID NO: 21280 - DNA, 601 bp, Human
cagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaarcagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaact

SEQ ID NO: 21281 - DNA, 601 bp, Human
cacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggmagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaagattggatcaggagattcttacaccattcttcccaggggacaaggtctcctgttaaggcagactcactactgatggctcatatcaggccctggaatgctggcag

SEQ ID NO: 21282 - DNA, 601 bp, Human
ttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgacattttgttggagcgtggaagaagattggatcaggagattcttacaccattcttcccaggggacaaggtctcctgttaaggcagactcactactgatggctcatatcaggccctggaatgctggcagatcgctggcagatcactgtgcagacagcgccaagtggcaggtgcattccgtgctgacccgggaaatggttctggctctggcagccctggagaagtagcagctgcaggacctgaatgagagcactggacctggagccagtcttca

SEQ ID NO: 21283 - DNA, 601 bp, Human
ctgcaaagaaacggtctccgctcgctttgggctttcgctttccttgaaagggcgcattcatagatgcccggaggcatttgctcgggaaaggaaatgaatcgctaaaacaggattagcgcgcgcttgcccttggtggacttgacaatttgtgtaatgcagagctttgataggctctggcaaaaaggaagcgagccttctcgttcccccacccccgcccggggagcttatgtttgttataaaatacgtgcgtgtggtcttaaaagcatcttccttaaggagaggggcggggatcaagagattrcttattctaactactactgaagaaaattacaggagggcgcagtggctcacgcctgtaatgccagcactttgggaggccgaggcaggagaaacgcttgaacctgggaggcagtgagccgagatcgcgccactgcactccagactgggagacagagcgagactccgtatgaaaaaaaaaaaaaagttactacggagaaataaacaggccggcttcacctccaacctagtggggaaaaaaagcctaagagggagtgaaatgaaggatgggggagcagaagtctccacccctccctttggccct

SEQ ID NO: 21284 - DNA, 601 bp, Human
cctgtaatcccagctactccagaggctgaggcaggagaatcacttgaacccaggaggtggaggttgcagtgagccgagatcgcgccactgcactccagcctgggtgacagaggaagaaaagaaagagaaagaaagaaagaaaagaaaagaaagaaagaaaggaaggaaggaaggaaggaaggaaggaaggaaggaaggaaggaaggaaagaaaatgcaaattctggagcccttactccagccctttgcaatcagaaactccaatggtgaggcccaggaagctgtgttttaacaggctctayaagtgattcggatgcagactaaagtttgagaatcaccgacctcgttcttaaaaattgttttaaaattaacttgtttttcctttagttgttaggagttaggatccactttgtcatgtgagtttcagggggaaaaatatgactttctttttgtttctttctctttttgaaaggtgatgatccaatgccctttgacattaaagctgagatgacactgaagacaaatttttttgccactagaaacatgtgcaacgagttactgccgataatgaaacctcatggtaagcccaacgtgtggacagt

SEQ ID NO: 21285 - DNA, 601 bp, Human
tgccctttgacattaaagctgagatgacactgaagacaaatttttttgccactagaaacatgtgcaacgagttactgccgataatgaaacctcatggtaagcccaacgtgtggacagtcgggttgcatccctcagtaagaagtgggctacaggcttcccggagcagggctaccctgcagaaatcactcaggggtgctatttctctgaagggggaaaaatagaaaattgcttcattttcccacagtgtttggcttctcactccaacattttagtttagtttagtttagtttagtttagtttwgttttgtttggcagtggggtgggtggtgggaagaaattttgctcttgttgtgcaggctgtagtgcaatggtgtgatcttggctcactgcaacctccacctcccggggtcaagcaattctcctgcctcagcctcccgagtagctgagattacaggcacccactaccacacccggctaattttttatatttttagtagagacgtggtttcaccatgttggccaggctagtcctgaactcctgaccttcaggtgatccacccaccttggcctcccaaagtgttagaattacaggcgtgagcca

SEQ ID NO: 21286 - DNA, 601 bp, Human
gacatatcacaatgcttttgggatccatgtcatgaactcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcrctctgtcatccaggctagagtacagtggcacaatttcggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcct

SEQ ID NO: 21287 - DNA, 601 bp, Human
tcaatcctagaatgatagaatgctgtgagtccccaaaggccgcttgcctctggtcaatctcatgagtcctccagccctccaaggtgatgggcccacatctagctcatctctggaccttggtatctgttttagcattacaacttttcctatattcctttcttcttataccatactttctcaagttgattcagaaaacccaaaagaaattttcttttctttttttttcttttctttttttttttttttttttgagacagagtctcgctctgtcatccaggctagagtacagtggcacaatttyggctcactgtagtctccgcctcccaggttcaagcgattctcctgtctcagcctctggagtagctgggattacaggtgtgcaccaccacgcccagctcattttgtatttttagtacagatgggatttcactatgttggccaggctggtctcaaactcctgacctcaagtgatccacccacctctgcctcccaaaatgctgggattacaggtgtgagccaccatgcccgaacgagaaattttctttattaggaaatgtcttgcctatacctgcaggtattcaataaatgttactattatact

SEQ ID NO: 21288 - DNA, 601 bp, Human
ctcctgacctcaagtgattcatctgcctcagcctcccaaagtgctgggattacaggtgtgagctactgcacctggccagaagtgtgcttttcttaatttaacatttcgaatatggattattggccgggtgtggtggctcatgcctgtaatctcagcactttgggaggttgaggcaggaggatcacttgagcccacgagtttaagaccaggctgaaaaatatggcaagaccctcatcactttaaacaaacaaacaaaattatctctggatgcaaaacctttttttttttttttttttttttttgagacagagtctccctccgtcgcccagactggagtgcagtggcatgagctcagctcgctgcaacctccgcctctcaggtacgagagattctccgccccagcctctcaagtagctgggtttacaggcgagcaccaccacgcccagctaatttttttgtatttctagtagagacagggtttcaccatgttggccagcttgatctcgaattcctgacctcaggtgatccacccgccttggcctcccaaaatgctaggattacaggcttgagccaccgcactcagacgcaaaaagttcttaac

SEQ ID NO: 21289 - DNA, 601 bp, Human
cttccagagcacctgcagttctccctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcrggaggctgaggcaggagaatggcatgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctg

SEQ ID NO: 21290 - DNA, 601 bp, Human
ctgcaggctttctctgatcccatcccactaaaaaactgagcaagtacaagagtacaagtgcaattctcaccattcacctttttaggttaagaagtttttgtggccgggcacagtggctcacacctgtaatcctagcactttgggaggccaaggcaggcagaccacgaggtcaggagatcgagaccatcctggctaacacggtgaaaccccatctctactaaaaatacaaaaaaattagccaggcatggtggtgggcacctgtagtcccagctagtcgggaggctgaggcaggagaatggcrtgaacccgggaggcggaacttgcagtgagcccagatcgcgccactgcactccagcctgggcgacagagccacactccatctcaaaaaaaaaaaaaaaaaaagaaagaaagaaagaaaagaaaatatcataagaatggacttaatcctgagcaacatatggagaccccagctctacacaaaaaatgaaaattaaaaattagctgggcatagtggcatgttccagcttctcgagagactgaggtgggaggatcgcttgggcccaggaggttgaggctgcagtgagctatgattgtgccactg

SEQ ID NO: 21291 - DNA, 601 bp, Human
agggaccatctatctgtatttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcraaggcacagcttctatgatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcatcatgagaacagaccaattcactttgagagaaatactacaaaataatggtctacagtcttcaaaaaagtcattgccaactaccttacattaaaatatatgaaagagatgtgacaattaaatgcaatccatgggccagg

SEQ ID NO: 21292 - DNA, 601 bp, Human
atttgacttgcttatttgttcaaggttctgagtcaataggacaagcaactactaagccactagagggcgcaacttgcctactctttctagagtaaggcagcaggtgtttcgggaccggtggggccacctggacctcagtggagggtggtgtgggtgcagcccttcccagggctgatgacgcatctggctgacgaggctgactgtcagcctctggcctctctcccagaggtgtgccctcagatcaaagaggacacctcctccccttaagaggatttatttcctcgaaggcacagcttctatkatctgtgtttttctttcttcctttcccattcacatttaattccttgtagccgccaagtttctgagaacaaagctgtttagaaagcaatgaagaacacaacatcactgatgtagtattcctggccaaaatattgatgtgactctcatcatgagaacagaccaattcactttgagagaaatactacaaaataatggtctacagtcttcaaaaaagtcattgccaactaccttacattaaaatatatgaaagagatgtgacaattaaatgcaatccatgggccaggtgcggtgactcacgcct

SEQ ID NO: 21293 - DNA, 601 bp, Human
acatacatacacttcatctttgaaagtgagagagagaaggaaggaaagaaatactgaatagtactaggtacctggggggatgagtgaggtgctagtttccaaggacagagtgagggtatctcttgtgggattggggtccacaagaatgtgcagctcccttgcaatgggaacttgtggggaatgccattcagaaaatgaaataaaatctacagatccggccaggtgcggtggctcatgcgtgcaaccccagcactttgggaggccgaggaaggcagagcacctgaggtcaggagtttgagaycagcctggccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtg

SEQ ID NO: 21294 - DNA, 601 bp, Human
gccaacatggtgaaaccccatctctcctaaaaatacaaaaattagctgggcatggtggcgcacacctgtaatcccagctacttgggaggctgaggcaggagaatcacttaaacccgagatagaggttgcagtgagctgagatcgcgccactgcactccagcctggacaacagagcaagactcatctcaaagaaaaaaaaaaagaccctattggacacagagaatatgcattcagaataatacataataaaagaactcactaaaattagtggggtttgatgctgatgaaatgtgtaaattawcacatttactggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttcta

SEQ ID NO: 21295 - DNA, 601 bp, Human
tggtttttggatttccaccagtacttcaaattgtaaaatttttggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatayaaaaattatttgagtgcagtggtgtgtgcctgtgggcccagttatttgtggggctgagacaggaggatcacttgagtctgggaagtggaggctacagtgagccgagatcatgccactgcactccagcttggctggcagagtgagattctgtctcaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtgg

SEQ ID NO: 21296 - DNA, 601 bp, Human
tggcctacatatttgtttctatgggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagytatttgtggggctgagacaggaggatcacttgagtctgggaagtggaggctacagtgagccgagatcatgccactgcactccagcttggctggcagagtgagattctgtctcaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattga

SEQ ID NO: 21297 - DNA, 601 bp, Human
ggcacaattgtctctttagtagctgtgaatcatgatcaacatgaatattaattcataatttaatgaatattaatattatcaaatagggactaaaaagtaatgaaatcaggccggatgcagtggctcacgcctataatcctagcactttgggaggccaaggcaggcagatctcctgagctcaggagtttgcgaccagcccggccaacatggagaaaccccgtttctacgaaaaatacaaaaattatttgagtgcagtggtgtgtgcctgtgggcccagttatttgtggggctgagacaggargatcacttgagtctgggaagtggaggctacagtgagccgagatcatgccactgcactccagcttggctggcagagtgagattctgtctcaaaaaaaaaaaaaaaaaaagtgatgagataaaaaccaggatggaaaaacagcccattccacacgtgaagtgtccataatgaaggacagacagagtcatccccagggattccttactgctggttgtggcactaaggaattggggtggctgcccactgtcctaggacattgggtgtgcctaggaaattgagagctttagtccttagggtgaga

SEQ ID NO: 21298 - DNA, 601 bp, Human
gactctgtctcacaaaacaaaataaaaaaattttaggccaggtgtagtggctcacgcctgtaattccagcactttgggaggccgaggtgggcagatcacttcaggtcaggagttcaataccagcctggccaacatggcaaaaccccatctctactaaaattacaaaaattagctgggcgtggtggtgggcacctgtagtcccagctacttgggaggctgatgcaggagaattgcttgaacccggaagtcggaggttgcagtgagccaagattgtgccactgcactccagcctgcgtgatasagcaagactgcgtcttaaaaaataaataaataaatttaagtaaaagtaaaaataaaactgcctggggaatctacaaatttactacctcacccatctctcagcgaatccctgagaaagggagccccccctgtcactgatggaggtgtgttcttccccttgggagaatagggccaaaaaaattaaatcccatgggtgcatagattttatgccttctatagtcacatttttaatctttttttaaatttgattattactttttgagaaagggtctcattcgtgtcacccaggctggagtgtagt

SEQ ID NO: 21299 - DNA, 601 bp, Human
tcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtgraatgaatgaatgaattgatgctgtggtttgattatttctgttctttttttttttgagacggagtctcgctcttgttgcccaggctggagtgcagtggcatgatctcagctcactgcaacctctgccacctgggttcaagctgttctcctgcctcagcctcctgagtagctgggattaccaggcatctgccatcatgcctggctaatttttgtaattttagtagagacggtatttcaccatgttggccaggctggtctcgaactcctgacctcaggtgatctgcccaacttggcctcccaa

SEQ ID NO: 21300 - DNA, 601 bp, Human
acgtagttgaattccgtccttaaattgtgggaccagcttaacagttgtatttgccaggaatttaatttgtttttaagataatcccgaatcatttataattcagaattttgaataaatttacccttggtcttttaactttattttcataattgagacattgtatttgaaaaattatatcttgtcattggaaaagtaatgagaatgtcagtgatgagaaacttataactttggatttttcttaataatgaagaatatattatacgtttatggcatttctcaggcaagtactgtagtggtaagwgattggaaaaaaaagtgcttatcatttcaggttttgagatcaccattgaacacccacacacagatgtggtgaaatgtacccagttagtaagaggtaggtgatccttgaaacttttaagataagtattaatgctttttattatctgtaattgatttgggtgctattttgtttttctagccttttgttaggtttcattaaaattagggagaaatgtcattttttaagcattactttttagtgttctacatctacttctatttgtgattctacctggtatgttagcttcctttaaacataggt

SEQ ID NO: 21301 - DNA, 601 bp, Human
tactgcttgtaaagtatctggtagtatctgatacagcattttctactcctaaatgaatcctatatatctgttgtatccctagaaatattttttacacagttgcatgttgttctgcttcttacttccactttcctgtttccatttcaagtgttaatgtattcatagcaaccacttgggacttgtaatgtgccattttctgttacttcctttttgaaaatagaattttgcagtttcattcatttactaccaagtttttttagatttatcctaaacaaaatgagtacgacttttgaaaatcttytgtttttagtatttacctaagtattctcacattttattcattctaaattgaattcattttatacctagtgatttattatgttagtggctacaattttttaaaaactgtctgatagtgtcattaggaagtagacatctgaaaatctaatttgtatttttttgtagtagcacacgttatcatttgtaagctagaacatatttaactgtggttcctgttcttcatggttatatcagcgtgttttatagcacattttcatctgaatattacagtatagcatagaattatatgcataactagttg

SEQ ID NO: 21302 - DNA, 601 bp, Human
attctaaattgaattcattttatacctagtgatttattatgttagtggctacaattttttaaaaactgtctgatagtgtcattaggaagtagacatctgaaaatctaatttgtatttttttgtagtagcacacgttatcatttgtaagctagaacatatttaactgtggttcctgttcttcatggttatatcagcgtgttttatagcacattttcatctgaatattacagtatagcatagaattatatgcataactagttgtagttgttgaattaaggaaaaagggttagttttttctaaraacttgaaaaaggttaagctaaactttgtaagcattgtagccatataatttgctttaaattaagagcctattgaagaaacattagttgaaggaagtactagtatatgtttaaaaatattacttgtgaatattaacttaggaaattggattttcaggttactgttgtgaaatttgagtcaactttaaattctttatcagagattaatattttttgtacaagttctcctacaactaaaaattctagagacatgaagtcagtttacttgaaaaatgaaatagtaacttttaaaacatttacaa

SEQ ID NO: 21303 - DNA, 601 bp, Human
gagtttatccagaggaaaggaagtcttcaatgagttgaaatgacatctaaaactcagtgagggcttatctgttctatagcttgaaaaatcaggttatctaggtcattgttttagtttaatagtcactagattaagattaggtaggcaaaatttttttttcggggggggggtgggggacagagtctcagtcgcccaggctatagagtgcggtggcgcaatctcggctcgctgcaccctccgcctcccgggttcaagcagttctctgcctcagcctcctgagtagctgggattacaggtgccygccaccacgcctggctaatttttgtatttttagtagagatagggttttcaccatgttggccaggctggtcttgaactcctgacctcatgatccacccaccttggcctcaaagtgttaggattacaggcgtgaaccaccacacccagccagtaggcataatcgtaataaaaatagtttatatacctggtgctgaagtaaaaagatcacagaaaagtaatctgccttttatcctgtctttaggtcagaggttaggttgtggtttatgtggggttttttgacacaggaggagctacctcattt

SEQ ID NO: 21304 - DNA, 601 bp, Human
tgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagayaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccact

SEQ ID NO: 21305 - DNA, 601 bp, Human
actagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaaragcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttca

SEQ ID NO: 21306 - DNA, 601 bp, Human
accatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgyacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaa

SEQ ID NO: 21307 - DNA, 601 bp, Human
tgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcracctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgt

SEQ ID NO: 21308 - DNA, 601 bp, Human
ctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctrtaatcccagcactttgggaggccaaggcgggcggatcacgaggtcaggagattgagaccatcctggctaacacagtgaaaccccatctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagta

SEQ ID NO: 21309 - DNA, 601 bp, Human
cttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggyggatcacgaggtcaggagattgagaccatcctggctaacacagtgaaaccccatctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatcc

SEQ ID NO: 21310 - DNA, 601 bp, Human
agtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacrgtgaaaccccatctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacatt

SEQ ID NO: 21311 - DNA, 601 bp, Human
aaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcytcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatccc

SEQ ID NO: 21312 - DNA, 601 bp, Human
caccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcgttacagctgccccagggaggaggagggcagcaccatccccatccaggaggattaccgaaaaccggagcctgcctgctccccctgagccagcacctgcggkagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatg

SEQ ID NO: 21313 - DNA, 601 bp, Human
tagtgtttatttttgtgtggatttttttggggggtagggtgggggaaatttgttgagatctttttgtggtctaataaataataaatgatcatgtattttcagagtgttcagtgtatgggtgttttaaaatgtgtattctgtttgttgcgtataaagttctctacatatctattaagttaagcttgttaattgtgttatttaaataatgtgtacccttatttacttttatcacctttatttctgagagatgtgttaaaatcttatctcccagtatacttgttcatctattagattttcattstgttctttctatttttgcttcatatatgtcaaagctatgttattaggtacataaatgttcatgaatgttatgtttttttggtgggttgggctttttatccacatgaatatacctctccattccttgtaatgccttttcccttaatttcacatttgtttggcattaatattgctattccttcctggaagaagtagcaaaggttaaaaagaaagaaaagtaataataatactgccatttcttctttctttttattagcatttatctggtgtatctttgaatttctaaaagtaatgactgcat

SEQ ID NO: 21314 - DNA, 601 bp, Human
aagtagcaaaggttaaaaagaaagaaaagtaataataatactgccatttcttctttctttttattagcatttatctggtgtatctttgaatttctaaaagtaatgactgcattttatgaaatgaaaattataaacatttattatttaaaattcaagcaatacaaagagtgtaaggaagaaaacaaacattgccctccccagccctccatctatagataactactattatcattagatggctgacacgcctctacctctctgtataaagatgggtaggttagtaaccagacagcctgtacayacttacaaagaaggaattttaagagaatggcaacatatttatggcattaaaatgataatatttaattttagtcaaaagtatcagaaaaagaaagcgaagtgaaacagaagaatgccaaacctcagtcagattaatgtatcttcagcaaaagatactgcaattcctttaaaaaaaaaaaccctctaaaattaagaaaggaggttatgaaaatcagtaagtggttaataatcatttcagaatctactatctcttgcagtaaaggcaaaatctgcttagtttgagttttggacagtagagaat

SEQ ID NO: 21315 - DNA, 601 bp, Human
cagcttctctgttcctgagtttttcactttgattcatcatttgagtgattggattacactgtcaggtggatttttcaagaagggctcgtctttgcaatattctctgttatttcatgtttgaggatgcttgtctgttgcctatatttttgttttcttttttttctttttgagacagagtctgactctgtcgcccaggctggagtgcagtggtgcaatctcggctcactacaacctctacctcctggattcgagcgattctcctgcctcctgagtagctgagattacagggatgcaccaccaygcctggctaatttttgtatttttagaagagatggggtttcatcatgttgcccaggctggtctcaaactcctgacctcaagtgatccagccgccttggcctcctaaagtgttgggattacaggtgtgagtcaccattcccggcccaatttcttatctttaaattttaagacagggtctcactttgttgtccaggctggccttaaactccagggcttaagtgttcctcctgcctcagcctcccgagtagctggggctgcacttgcatgttactgcacccaacttacaatttttttgtgtgtc

SEQ ID NO: 21316 - DNA, 601 bp, Human
actgcactccagcctgggcaacagagcaagaccctgtttcaaaaaaaaaaaatgataaaaagtatagtacagtaagtacgtaaaccagcaatatagctttctatgatcattatcaagtattacatactatccataattgcatgtgctatgcagcacttttatacaactggcagggcagtaggtttgtttataccaacatctccacaaacatgggagtaacgcacgtgctacgacattgccgtggctatgacatcactaggcaataggaatttttcagctccattataatctcttttattgttttttttgtttgagatggagtcctgctctgttgcccaggctggagtgcaatggcgcaatctcggctcactgcaacctgggttcaagcgattctcctgtcttagcctctcaagtagctgggattacaggcatgcgccaccatgcctggctaatttttgtattttttttaggagaggcgggatttcaccatgttggccaggctggttttgaactcctgacctcaggttatccgccctcctcggcctcccaaagtgctgggattacaggcgtgagccaccgcgcccggcttccattatgatct

SEQ ID NO: 21317 - DNA, 601 bp, Human
tgtgctatgcagcacttttatacaactggcagggcagtaggtttgtttataccaacatctccacaaacatgggagtaacgcacgtgctacgacattgccgtggctatgacatcactaggcaataggaatttttcagctccattataatctcttttattgttttttttgtttgagatggagtcctgctctgttgcccaggctggagtgcaatggcgcaatctcggctcactgcaacctgggttcaagcgattctcctgtcttagcctctcaagtagctgggattacaggcatgcgccaccakgcctggctaatttttgtattttttttaggagaggcgggatttcaccatgttggccaggctggttttgaactcctgacctcaggttatccgccctcctcggcctcccaaagtgctgggattacaggcgtgagccaccgcgcccggcttccattatgatcttgtgggaccatcatcatgtacgccatccattgttgactgaaatgttgctctgtggtgcgtgaaggtatcatttctaatgttttgttctgttttccctcttttctgcctccttgagtgttagtgctctttgcattcagagct

SEQ ID NO: 21318 - DNA, 601 bp, Human
ctccattataatctcttttattgttttttttgtttgagatggagtcctgctctgttgcccaggctggagtgcaatggcgcaatctcggctcactgcaacctgggttcaagcgattctcctgtcttagcctctcaagtagctgggattacaggcatgcgccaccatgcctggctaatttttgtattttttttaggagaggcgggatttcaccatgttggccaggctggttttgaactcctgacctcaggttatccgccctcctcggcctcccaaagtgctgggattacaggcgtgagccacygcgcccggcttccattatgatcttgtgggaccatcatcatgtacgccatccattgttgactgaaatgttgctctgtggtgcgtgaaggtatcatttctaatgttttgttctgttttccctcttttctgcctccttgagtgttagtgctctttgcattcagagctcctcttccttggcgctggttttcctctgatgtttggcgacttctagttctgtgcacatcatatctcatgatgccggtggtctgcgaatggggcttctgaaacccacctctgagggcaatggggctcaggtggggct

SEQ ID NO: 21319 - DNA, 601 bp, Human
gaatggggcttctgaaacccacctctgagggcaatggggctcaggtggggctgcaacagtctctttgcgggaagacgcgtggcctctggctctgtggcatgagtgatgaggagctatccagagcctttcccccttcttcagagagtcccccttggctgcattctgggctgtggtctccttcactctgatcttatctgtcctctgccttccgtatttcggggagttgtcttcgtttctgatctgccaagcttgccccttcttggtctccaggcctgttacacattaattattagttttaccagtgctatttttgttttgttttgttttgtttgagacggagtctcgctcttttgcccaggctggagtgaagtggggccatctcaactcactgcaacctccacttctcgggttcaagtgattttcctgtctcagcctccccagtagcttggattacaggtgtgcaccaccacacctggctaatttttgtatttttagtagagacagggtttcactatgttggccgggctggtctcaaactcctgacctcaggtgatctgcccacctcggcctcccaaagtgctgggattacaagtgtgaacca

SEQ ID NO: 21320 - DNA, 601 bp, Human
tccaggcctgttacacattaattattagttttaccagtgctatttttgttttgttttgttttgtttgagacggagtctcgctcttttgcccaggctggagtgaagtggggccatctcaactcactgcaacctccacttctcgggttcaagtgattttcctgtctcagcctccccagtagcttggattacaggtgtgcaccaccacacctggctaatttttgtatttttagtagagacagggtttcactatgttggccgggctggtctcaaactcctgacctcaggtgatctgcccacctcrgcctcccaaagtgctgggattacaagtgtgaaccaccactccccgcctagctgtactttttatgtctgttaaccaacctgtgatttcctgcttttcctgccagcagttgttattatctgtctttttgattcgagtcattctagtggttgtgaagtggtatctcactgtgattttgacttgcatttccctaatggctaacggtgtgggacatttttcatgtgtttattggccagctgtgtatcttctttagagaaatgtctattccagtcctttgtccattaaaaaaattaataaactatt

SEQ ID NO: 21321 - DNA, 601 bp, Human
tgtgcctgtaatcccagctactcaggaggctgaggcaggagaatcacttgaacccaggttgcagtgagccgagattgcgccattgcactccaacctgggtgacagagtgagactctgtcttaaaaaaaaaaaaattaataaactatttcttagagcagttttaggtttacaggaaaattgaacagaaaatacagagttcctatataccctcaacccccttcccaatctcccacagtttcccctattttttgtttgaaacagggtatcactcttttgcccaggctggagtgcagtggtgcartcacagctcactacagcctcaacctcctgggctcaagcgatcctcccgcctcagcctcccaagtagctgggactacaggcatgtgctaccatgcctggctaatttttgtattttttttttgtagagatgggatttcaccatgttgcccatgttttatagagatgggatttcactatgtcgccatatgagggcaaatgatcctcctgcctcggcctcccaaagtgctgggattaaaggcgtgagccactgcacccagcctcccctgtcacgaacaccttgcattagtgtggcacaattgtt

SEQ ID NO: 21322 - DNA, 601 bp, Human
gccatatgagggcaaatgatcctcctgcctcggcctcccaaagtgctgggattaaaggcgtgagccactgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgtyggttcacctctccctccccctgaacctctggcagctactgatctttttactgtctcgatagtttcatcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctc

SEQ ID NO: 21323 - DNA, 601 bp, Human
gagggcaaatgatcctcctgcctcggcctcccaaagtgctgggattaaaggcgtgagccactgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgtcggttcayctctccctccccctgaacctctggcagctactgatctttttactgtctcgatagtttcatcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagct

SEQ ID NO: 21324 - DNA, 601 bp, Human
agggcaaatgatcctcctgcctcggcctcccaaagtgctgggattaaaggcgtgagccactgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgtcggttcacmtctccctccccctgaacctctggcagctactgatctttttactgtctcgatagtttcatcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagcta

SEQ ID NO: 21325 - DNA, 601 bp, Human
actgcacccagcctcccctgtcacgaacaccttgcattagtgtggcacaattgttagcattgatgacctgataatgatgcattattattactaactgaagtccatagtttacagcagggttcactctttgtgttgcccattctagggctttagacaaacggatgatgaccacgtgcccaccatcaccgtggcatccagaatattttcactgccctaaatgtgtcctgagctcgtcggttcacctctccctccccctgaacctctggcagctactgatctttttactgtctcgatagtttcrtcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagctatctggagagacgccttccttctgttcccctctgtgacccctgtctgtgtcccttagac

SEQ ID NO: 21326 - DNA, 601 bp, Human
atcttttccagaaatgtcatgtagttggaatgacagtgtgtggccttttcagactggtgtctttcatttagcaatatgtatctaagtttcctccatgtcttttttttatttttttgcattttaaaaaattggtacattaatttaatttttaatccaattttagtggtcaccagggggttgagctgggaggcggaggctgcgttgcggactgcacctgccctctccccctcatctcaagagctatctggagagacgccttccttctgttcccctctgtgacccctgtctgtgtcccttagaygacctcgtggagaagacgccgtgtgcatggaactcctcccgtgtctgcgaatgtcgacccggcatgttctgttccacgtctgccgtcaactcctgtgcccgctgcttcttccattctgtctgtccggcagggatgattgtcaagttcccaggtcagtgtccccacccttaactcaggacagagatctatgctgttgctgctgcaccttccgcccaccccagtgcactgttgacttccgacctcccgcttcccggagactgttggacagatcatgtctcctttggcgatgggccagggatg

SEQ ID NO: 21327 - DNA, 601 bp, Human
ccactgaggagaaaagtgccacaaagtgcctgtggtccctcccccaaccaggtccttctctggagtcccatgccctgttgtgcaaacctggggattggcagtcacccccatcgctaccactgcctgccccttttatccttccctcgttccctcatccttcacagccagcccatcctcgagtcctgtagatttggcctccaattatcttccccaccttctcaccccgaataccttctcttatacagcccccatggcagacagccagaatgacccttgcaagaccaaatctgaatctgatcctctctctctctctctctctactcactcactctctctctgtctcacacacacacacacacacacacacacacggatatatacctgaaatgcttcagtatcttcctgttactctaaagataaggacacaaggccaggtgtggtggcttacgcctgtaatcccagcactttgggaggccaaggcaggcagatcacttgaggtcaggagttcaagaccagcctggccaacatggtgaaacctcatctctactaaaaatacaaaaattagccagccctggcagcaggtgccctgtaattccattta

SEQ ID NO: 21328 - DNA, 601 bp, Human
gcttcctgagggcaaagaccatgcccctggtgtccatcaacatctccccactgcctgatcaaatgctaggcatggcacctgctccccatagagattcattgaattaagatatggggacacctgacagggagctccgagctggtgggggggtggagttcaaatctggtcaaattccagggtcgggggagagcgctctgctaaggaatgatggaggcctccacccataagcaggggagagtgctggagtggactgggcagcagatacctaggattttgcaaagatttgcaactgtggggcatkttcccacccgcctctggacctcggtctccccatctctcaaatgaggaggtataactgaaggccttgggggcctctccaaaaaggccaaacttcccaaaagtttccagctcagaaacttctgcatctttgtgaaaaacatcttgagttcagttgttccagccaaggcttcctgctggagggactgtctgggcagtgttcctgagactgccacacagcggcgccagaggcctccctttgctgcccctggaccccagctgcccaatgcagtgcccctggcccgtggcacgtggccacgcactt

SEQ ID NO: 21329 - DNA, 601 bp, Human
gcccgtggcacgtggccacgcacttaaaatgcagctaggggccgggtgcggtggctcacacctgtaattccagcattttgggaggctgaggcaggcggatcacttgaagtcaggagtttgagaccagcctggccaatgtggtgaaacctcgtctctactaaaaatacaaaagttggccaggtgtggtggcgggtgcttgaaatctcaactacttgggaggctgaggcatgagaattgcttgaatccgggaggtggaggttgcagtgagctgagattgtgccactgcactccaacctgggcracagagttagactctgtttcaaaaaaaaaatccgataaaaaataaaaaaaatgcagatacgtctgcattgagaagtgctgtgtgtacaatatgcactggatttcgaaaacttagtataaacaagaatataattaattattttttatattgattgcctgcaaacatggtaatattttagatatactgggttaaataaatatactatgaaaattaattgcactgatttctttttaccttttaaagtgtggctcccagaatatttgagctggcctgtgtgactcgcatatctctgttggacag

SEQ ID NO: 21330 - DNA, 601 bp, Human
tggagcctcgatctgtcacccagactagagtgcaatggtgtgatctcagctcactgcaacctctgcctcccggattcaagtgattctcctgcctcagcctcctgagtagctgggattacaggtacctgccaccatgcccggctaattttttgtaattttagtagagatggggtttcactatgttgtccaggctggtctcgaactcctgacctcatgatccgcccacctcggcctcccaaagtgttgggattacaggtgtgagccaccgtgcctggcgacatacgggtcaccttctaagtgwtgggatgggagtccagatgggtgtaaggacatagcatttaccatatgtcatgcaatgtgatgggcacctcacgtgcactcttctgtttatcctgacgacagcctggtgaagagtgtatgattataatcatttgactgggctgggcacggcagcttatgcctgaaatcccagcactttgggaggctgaggagggtggatcacctgaggtcaggagttcgagaccagcctggccaacatggcgaaaccctgtctctactaaaaattagccgggcgtggttgcaggcacctgtaatcccagct

SEQ ID NO: 21331 - DNA, 601 bp, Human
acagcctggtgaagagtgtatgattataatcatttgactgggctgggcacggcagcttatgcctgaaatcccagcactttgggaggctgaggagggtggatcacctgaggtcaggagttcgagaccagcctggccaacatggcgaaaccctgtctctactaaaaattagccgggcgtggttgcaggcacctgtaatcccagctactcaggaggctgaggcaggagaattgcttgaacctgggaggcagaggttgcagtgagctgagattgcatcactgcactccagcctgggcgacagagyaagactctgtctcaaataaataaataaacaagtaaataaaatggactttcctggcacagttaggacatagcaggcaaactgaggggcactggctagacgatgtgtgtgttttcttctccactctgcttctgtccagcattcttcaggactccttggattgcatgtagcaaaatccccaattttttagcacatgtagcttaaaagtctggggatagctctgagaagcttcaggcatggctggatccagggctccatcttgccccatctctcacctctatttccctctctgttggttcatcg

SEQ ID NO: 21332 - DNA, 601 bp, Human
ttcttcaggactccttggattgcatgtagcaaaatccccaattttttagcacatgtagcttaaaagtctggggatagctctgagaagcttcaggcatggctggatccagggctccatcttgccccatctctcacctctatttccctctctgttggttcatcggcaagatacttacaagcagctctgcccagcgccagtgggaagacagcttccctttcttacatttttaatatccaaaaccaaaacctttaaatcccaaaccagaatctttaaattctacctcacaggcttgggtcacatrtccgtccctgaactggctcatcgtggccagaggaatgcaacggattgattggtccagcctggtctcatggccactcgggaaagggggttcagtcggtcccaacctctaaccacagatgctgagatcagagggagagtaattccccagggaaagataggctgctttactctgaaggggaacgggtgccaggcgggtgccacctccagatgactgctgtgttttccaagggccccatctccgactctggcctgtggtagtgaagggtgtattccgggagactttgggtccccaacactgatt

SEQ ID NO: 21333 - DNA, 601 bp, Human
gtgggccaagggcctgggaccccatctctgtggaaactgttactcgtgagcacaggcctcccttgccccattggcagaattatcagtcccatctctggcttcttccccagtggcaccatcccccaggccaagcccaccccggtgtccccagcaacctccagtgccagcaccatgcctgtaagagggggcacccgcctcgcccaggaagctgcttctaaactgacgagggctcccgactctccctcctctgtgggaaggcctagttcagatccaggtaatttccccatgaagctgtgggtcrtctccctggggtgctcgattggtggatggcccatgagtgggggtgtttggagcaggcgggcagtgatctgtggtcttttcctggtggggagagaagacggtggtaaggtatgatctagggctgaaagcattgaggggcagaggtagacaccagagggctcattcatttgccagcagtgcagagggcctgccttgtgccggacacccgtgccccatctctccctctatttccctctacgttggtttgtcagagggaaatgggtcccactctgctgttgtgacacttgcgactcagctggcc

SEQ ID NO: 21334 - DNA, 601 bp, Human
cccggtgtccccagcaacctccagtgccagcaccatgcctgtaagagggggcacccgcctcgcccaggaagctgcttctaaactgacgagggctcccgactctccctcctctgtgggaaggcctagttcagatccaggtaatttccccatgaagctgtgggtcgtctccctggggtgctcgattggtggatggcccatgagtgggggtgtttggagcaggcgggcagtgatctgtggtcttttcctggtggggagagaagacggtggtaaggtatgatctagggctgaaagcattgagggkcagaggtagacaccagagggctcattcatttgccagcagtgcagagggcctgccttgtgccggacacccgtgccccatctctccctctatttccctctacgttggtttgtcagagggaaatgggtcccactctgctgttgtgacacttgcgactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcg

SEQ ID NO: 21335 - DNA, 601 bp, Human
agctgcttctaaactgacgagggctcccgactctccctcctctgtgggaaggcctagttcagatccaggtaatttccccatgaagctgtgggtcgtctccctggggtgctcgattggtggatggcccatgagtgggggtgtttggagcaggcgggcagtgatctgtggtcttttcctggtggggagagaagacggtggtaaggtatgatctagggctgaaagcattgaggggcagaggtagacaccagagggctcattcatttgccagcagtgcagagggcctgccttgtgccggacaccsgtgccccatctctccctctatttccctctacgttggtttgtcagagggaaatgggtcccactctgctgttgtgacacttgcgactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcggctcactgccacctccacctcctgggttcaagcgattctcctgcctcagcctcctgagtagctgggatt

SEQ ID NO: 21336 - DNA, 601 bp, Human
aagctgtgggtcgtctccctggggtgctcgattggtggatggcccatgagtgggggtgtttggagcaggcgggcagtgatctgtggtcttttcctggtggggagagaagacggtggtaaggtatgatctagggctgaaagcattgaggggcagaggtagacaccagagggctcattcatttgccagcagtgcagagggcctgccttgtgccggacacccgtgccccatctctccctctatttccctctacgttggtttgtcagagggaaatgggtcccactctgctgttgtgacacttgcsactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcggctcactgccacctccacctcctgggttcaagcgattctcctgcctcagcctcctgagtagctgggattacaggtgcccaccaccacgcctggctaactttgtatttttagtagagatgggatttcaccatgttggtcaggctggtctcga

SEQ ID NO: 21337 - DNA, 601 bp, Human
acaccagagggctcattcatttgccagcagtgcagagggcctgccttgtgccggacacccgtgccccatctctccctctatttccctctacgttggtttgtcagagggaaatgggtcccactctgctgttgtgacacttgcgactcagctggccagcctctgcacgtgtccatctgatgccctcctggtctccatggcgaagggtcgaccctcagtcatttttctttttcttttttttgagacggagtttcgctcatgttgcccaggctggagtgcagtggcgcaatctcggctcactgcmacctccacctcctgggttcaagcgattctcctgcctcagcctcctgagtagctgggattacaggtgcccaccaccacgcctggctaactttgtatttttagtagagatgggatttcaccatgttggtcaggctggtctcgaactcccgacctcaggtgatccgcccacctcggcctcccaaagtgctgggaggattacaggcgtgagccaccgcgcccaacctagtcccattttattactgaatagccctccatggcgtagatatgccgagctctgtttatccagtttttgaatatttgg

SEQ ID NO: 21338 - DNA, 601 bp, Human
tattttcttgttggatgacccttggacaactgcttctctgtcttcctgggggctctctggaccccctgcccttgccatactgatctttctccgtgatcctcatctgtgtcccttagatgaccttgtggagaagacgccatgtgcatggaactcctcccgcacctgcgaatgtcgacctggcatgatctgtgccacatcagccaccaactcctgtgcccgctgtgtcccctacccaatctgtgcagcagagacggtcaccaagccccagggtaagcagttcccaccccaggcctcgaccacrgggtggagtctgtgcccccactgttgtgcctctccccaccaacagccaggggtggaggcaaatgacctacaccctcggctgttcattaggtcaggtttgggttctggttatcctttgagtagtcagactcagtgaatggaatgataaaatccagttttagcattttggcaagagattctgttgattaaaaaaaaattcttcctgaaattattgggctggtaaaatctttatatttttgagatggagtttcgctcatgttgcccaggctggagtacaatggctcaatctcggctcaccgca

SEQ ID NO: 21339 - DNA, 601 bp, Human
agtagagacggggtttcaccacattggtcaggctggtctcgaactcctgaccccaggtgatctgcctgcctcagcctcccaaagtgctgggattacaggcgtgagccaccgcacccggccaagcataacccttttaaaataaatatgaatgagcaaagatttgtaagaaaaaccagccctacaaaggagaataaaaagatacgaaaccagaaattcttaccacacatgaagctttgataaatccaggaatagaagagtacttagcaacattaaattcgtgtctgcagaaaaattcacgaastcgttacatccataaggtgggcacagaatgctatgaaaaggaacaatatgggatcagagggcaagaaaaggctttttagaaagtgtgcttgtgatcagcccatcatctctaggttctccattcacctttccatccctgccctgccatcaacgatggctccgcctttctcctctgtagggagcatgcagttaagccttgccagcagagggcgctagagggccatcgcaggaggaaggaggcttctggttgcatttgtttttttgtttgtttgtttgtttcttttctttttttgagacagag

SEQ ID NO: 21340 - DNA, 601 bp, Human
gacggggtttcaccacattggtcaggctggtctcgaactcctgaccccaggtgatctgcctgcctcagcctcccaaagtgctgggattacaggcgtgagccaccgcacccggccaagcataacccttttaaaataaatatgaatgagcaaagatttgtaagaaaaaccagccctacaaaggagaataaaaagatacgaaaccagaaattcttaccacacatgaagctttgataaatccaggaatagaagagtacttagcaacattaaattcgtgtctgcagaaaaattcacgaagtcgttrcatccataaggtgggcacagaatgctatgaaaaggaacaatatgggatcagagggcaagaaaaggctttttagaaagtgtgcttgtgatcagcccatcatctctaggttctccattcacctttccatccctgccctgccatcaacgatggctccgcctttctcctctgtagggagcatgcagttaagccttgccagcagagggcgctagagggccatcgcaggaggaaggaggcttctggttgcatttgtttttttgtttgtttgtttgtttcttttctttttttgagacagagtctcac

SEQ ID NO: 21341 - DNA, 601 bp, Human
tgcaaaagtgtcctgactccctgattccctctgtgcatcccccaccagccacaggtctttggcaccccaaagtgctccaggcgtctcccccacagtggcagcctcaatttctctgtgcacctgaccagaagcatagacttcaggtcaaaaggacctaccaagagcaaagcaggattaatggaaattacccacgctacatgtaatagatgcaccaccatgattttatctacctgccggttgatggcatttgggttgtttccagtttagggctattatgaatgaaaacagctgtgaatattctttttttttttttaacatgtatgaatttatcttatatcttttattattatttttattatttttagagacagggtctcactctgtgttccaggctggagtgcagtggcatgatcttggctcactgcagcattgaactcctgggctcgggcgatcctcccacctcagcctcccacagtgctgagattactggcatgagccaccatgactggccgattcttgtacaagtctttgggtggatgtatattttcatttttcatgggtaaatacctaggaggagtggctaggtcattgtgctggtcac

SEQ ID NO: 21342 - DNA, 601 bp, Human
actcagaaaataggtctttgttgattgatttcatgactttgactagttgttcgagcctttgagcctcagttgtctcatctatacaatggtaatggcagagaccgtgcagggttataagcagtgtagcattgtagacggcctctgtcagagttagctcttaggctggacgcggtggctcacgcctgtaatcccagcactttgggaggccaaggtgggtggatcacgaggtcaggagtttgagaccagcctggccaacacgatgaaaccacatctctactaaaaatacaaaaattagccaggsgtggtggcgcgcgcctgtaatcccagctactcaggaggctgaggcaggagaatcgcttgaacccgggaggcggaggttgcaaggttgcagtgagccgagattgcaccgctgcactccagcctgagcagcagaatgagaatcagtctcaaacaaaacaaaacaaaacaaaacaaaacaaaacaaaacaaaacaaaacaaacaaaacccccaagagttagctcttagggaaagatgccaggttactcattttaggacttgcagttctagtggctgacacgaggtggcagtagtgctccggcc

SEQ ID NO: 21343 - DNA, 601 bp, Human
cttaggctggacgcggtggctcacgcctgtaatcccagcactttgggaggccaaggtgggtggatcacgaggtcaggagtttgagaccagcctggccaacacgatgaaaccacatctctactaaaaatacaaaaattagccaggcgtggtggcgcgcgcctgtaatcccagctactcaggaggctgaggcaggagaatcgcttgaacccgggaggcggaggttgcaaggttgcagtgagccgagattgcaccgctgcactccagcctgagcagcagaatgagaatcagtctcaaacaaaaaaaaacaaaacaaaacaaaacaaaacaaaacaaaacaaaacaaacaaaacccccaagagttagctcttagggaaagatgccaggttactcattttaggacttgcagttctagtggctgacacgaggtggcagtagtgctccggccagagtttctgaaagtgcggtcccgtctggcagcattggcaccggctgggaacttgttaggaaagcaaattatgggccccatcccagacctagagaatcagaaactgcactttaacaagatctccagggcactcatgtgcacattaacgtttgagaa

SEQ ID NO: 21344 - DNA, 601 bp, Human
cggccagagtttctgaaagtgcggtcccgtctggcagcattggcaccggctgggaacttgttaggaaagcaaattatgggccccatcccagacctagagaatcagaaactgcactttaacaagatctccagggcactcatgtgcacattaacgtttgagaagcacttaactggcatatactactttttaaacatctaaacatggacttcaataaagtgcaatcactagctctatgatctctgtaagtgacaaaagggaaaaacgaagcgagtttagtaccgaggtgtgaagaagtagatcyagataggggttaagagcgtggccctgcagtccccccggcctggcctggcctgggctggggctctgccacttactctcagggtgaccttgggcaacttaacgaactttcgtgagcctcagctcccctcatttttaaactgaaggtagtgacggtgcctagggcatagggttggggatcattcattcagggaacgcttgtggggtgtgtttatgtgcagtggggactccatgcctgccctcatcaagcaggtctagagggttggccgggaggggactgggttcaacctcttccttcccctca

SEQ ID NO: 21345 - DNA, 601 bp, Human
gaaggtagtgacggtgcctagggcatagggttggggatcattcattcagggaacgcttgtggggtgtgtttatgtgcagtggggactccatgcctgccctcatcaagcaggtctagagggttggccgggaggggactgggttcaacctcttccttcccctcactgcttggccctccccaccctgactccggccacaccagcagtgctgccagatgccggtcacaccgggccctcgtccacagtccccaaattttggtctattggacctcaattcctttgttctggctcctagacgcctcartttctcactctctagacacagtttgcccttctctcagccttcaatagttgatcagcttcctggagccaggcgagggagggctggatgagataagagccttggcttggaaaggacctgttgttgttagccatgatggaagctgtgtcccaggagaaggaggaagtcgtctggggctggggctgtcttgtgtggttgcagcaaggcaaagagtgtggggcgtctctgtgttccagggccagtgctcttctgggtgatcctggtgttggttgtggtggtcggctccagcgccttcctcctgtg

SEQ ID NO: 21346 - DNA, 601 bp, Human
gtactgggtgtgacgactgtgtggcttgcccagagcagcacctggatggatgctggcatgaacgtttaaaagtctatcttgtctgtcactttttcctccagtacccccagggggcattcctgccagccttgccttcctctctacattctaccctccctttctccctctccctccttctctttctctttcccctctctccccctcttctaccacctggcaagtcagcccaggggcaggaggggaaaggagcacatggggcaagagggaccctggttctgccacttacaagctgtgtgacccygggtgagttactgaattgtcctgtgtctcagtttcctcatccggaaaatgcagatggtagaatctacttcagaggcttggcctgtggattcgtcgaggtcgggctgttaagcgcatcgtggagtacctgcctgcagtcggtggctgctgcctattgacaggctggcctgtgcctggggctttttccttcctggaagcttcaggccttcctgagtcctgggtgcttctgaccccctccctggtccctgcactctgatccctgcccagcctctgggccagctcttccaggcagcccttggga

SEQ ID NO: 21347 - DNA, 601 bp, Human
ctctctacattctaccctccctttctccctctccctccttctctttctctttcccctctctccccctcttctaccacctggcaagtcagcccaggggcaggaggggaaaggagcacatggggcaagagggaccctggttctgccacttacaagctgtgtgaccccgggtgagttactgaattgtcctgtgtctcagtttcctcatccggaaaatgcagatggtagaatctacttcagaggcttggcctgtggattcgtcgaggtcgggctgttaagcgcatcgtggagtacctgcctgcartcggtggctgctgcctattgacaggctggcctgtgcctggggctttttccttcctggaagcttcaggccttcctgagtcctgggtgcttctgaccccctccctggtccctgcactctgatccctgcccagcctctgggccagctcttccaggcagcccttgggagctggaaccctcctcacctgtccaggcagggtcgtctatacagcgtgtgtcttctagctctcacctggggcagggggctcccagctatcttgtgccaagcaccttctctctcctgggcagccccttcaaggcaggc

SEQ ID NO: 21348 - DNA, 601 bp, Human
agtcggtggctgctgcctattgacaggctggcctgtgcctggggctttttccttcctggaagcttcaggccttcctgagtcctgggtgcttctgaccccctccctggtccctgcactctgatccctgcccagcctctgggccagctcttccaggcagcccttgggagctggaaccctcctcacctgtccaggcagggtcgtctatacagcgtgtgtcttctagctctcacctggggcagggggctcccagctatcttgtgccaagcaccttctctctcctgggcagccccttcaaggcagrccagggtcttcctcagcactgcatggcatggattgggtgcctgctctgtgctgggctctgatgggggaatcgtctgagccttcgtttctgatttgcaaggtgggctcccatacaggcttcctgtactcccccagtgatgacctttgttctgcaaggaggaggcagggctcagcaaggtggacggctggcccagggccacacagcctggcagtggcacagccagcctcaggcactggtcctaggggttttggtttgtaaagggctcagccctgtcccctcttccttccccctgccagctct

SEQ ID NO: 21349 - DNA, 601 bp, Human
ttcctcagcactgcatggcatggattgggtgcctgctctgtgctgggctctgatgggggaatcgtctgagccttcgtttctgatttgcaaggtgggctcccatacaggcttcctgtactcccccagtgatgacctttgttctgcaaggaggaggcagggctcagcaaggtggacggctggcccagggccacacagcctggcagtggcacagccagcctcaggcactggtcctaggggttttggtttgtaaagggctcagccctgtcccctcttccttccccctgccagctctgtccaccaycgcaatgcctacccaagagccacgtgctcagcctaaggccaggccctggcccgtcccctgatctccccaggacccttgcagaggcccttgcataggctgactgttgacttgggcacaaaaacacagtccactgaggcatgttttgaatttgacgagtttcacaagcaagcactgtggtccctgtgcaaggggggtttttgtgttttgatagtttcaagcctgtttccatgacctgtcaggctgagtgtctcattgaaaccggcgtttgctttcttgacatttttctagtattagaatttc

SEQ ID NO: 21350 - DNA, 601 bp, Human
aaggggggtttttgtgttttgatagtttcaagcctgtttccatgacctgtcaggctgagtgtctcattgaaaccggcgtttgctttcttgacatttttctagtattagaatttccattgccgtcagtttattttttttcttcaaacctctgtgagagcagttttgttacagaagaaaaaaagaaagaaagaaagaaaacaccttcccctaagaagccaggtctacaaagaactgagccctgagactcaatggtggacatcttatctcaggtcgtttttgaccctctagcttctggtgggamcttggggtctgggttccgaggctcaagatggacagaaagtgaagccaagacaggcaagctcacagggcaccgggtgagaatggaccgagctggccggatgcccctttccctcctgagccgtgggtggtgaaggagggaaggagcactggtttattggcactggtttattggttcgttcattcatctattcacatggtcttcacggagcacttcctccttgcaggctctgtgccgggcccagaagctgttctagctccctccaagcttttagactaattccgactgcccgcagaggccaaa

SEQ ID NO: 21351 - DNA, 601 bp, Human
ttgaaaccggcgtttgctttcttgacatttttctagtattagaatttccattgccgtcagtttattttttttcttcaaacctctgtgagagcagttttgttacagaagaaaaaaagaaagaaagaaagaaaacaccttcccctaagaagccaggtctacaaagaactgagccctgagactcaatggtggacatcttatctcaggtcgtttttgaccctctagcttctggtgggaccttggggtctgggttccgaggctcaagatggacagaaagtgaagccaagacaggcaagctcacagrgcaccgggtgagaatggaccgagctggccggatgcccctttccctcctgagccgtgggtggtgaaggagggaaggagcactggtttattggcactggtttattggttcgttcattcatctattcacatggtcttcacggagcacttcctccttgcaggctctgtgccgggcccagaagctgttctagctccctccaagcttttagactaattccgactgcccgcagaggccaaaggcagacgggaggggagtgtgcgccccttggcctcccacatcccagacctggggcagagggtgctc

SEQ ID NO: 21352 - DNA, 601 bp, Human
tgcccctttccctcctgagccgtgggtggtgaaggagggaaggagcactggtttattggcactggtttattggttcgttcattcatctattcacatggtcttcacggagcacttcctccttgcaggctctgtgccgggcccagaagctgttctagctccctccaagcttttagactaattccgactgcccgcagaggccaaaggcagacgggaggggagtgtgcgccccttggcctcccacatcccagacctggggcagagggtgctcttggttcctttgagcagtgagcacatcagggayctgtggtccgtgcaggtgcgatgagaggcccaccaaccagccctcgagtggatcaaccttcccgtgtgtgtcctcggtgacaggcatttgcaaagcacacacgtgatctcatccactcctccggtggcctgtgaggtacttactgttatccccgttgcacagattagcagcctaaggcacaggatggtgaagtaattcgtttaaggccacgtgctgggtgagccgtaggacggggattttatcgtggttgttgagatgtttgtaaaaagatttttcacccttggcaccattgacatttgg

SEQ ID NO: 21353 - DNA, 601 bp, Human
ttggcactggtttattggttcgttcattcatctattcacatggtcttcacggagcacttcctccttgcaggctctgtgccgggcccagaagctgttctagctccctccaagcttttagactaattccgactgcccgcagaggccaaaggcagacgggaggggagtgtgcgccccttggcctcccacatcccagacctggggcagagggtgctcttggttcctttgagcagtgagcacatcagggatctgtggtccgtgcaggtgcgatgagaggcccaccaaccagccctcgagtggatcraccttcccgtgtgtgtcctcggtgacaggcatttgcaaagcacacacgtgatctcatccactcctccggtggcctgtgaggtacttactgttatccccgttgcacagattagcagcctaaggcacaggatggtgaagtaattcgtttaaggccacgtgctgggtgagccgtaggacggggattttatcgtggttgttgagatgtttgtaaaaagatttttcacccttggcaccattgacatttgggaatggatggttctttgctgtggagcgctatcctataggacgttgtacagcccct

SEQ ID NO: 21354 - DNA, 601 bp, Human
gcccgcagaggccaaaggcagacgggaggggagtgtgcgccccttggcctcccacatcccagacctggggcagagggtgctcttggttcctttgagcagtgagcacatcagggatctgtggtccgtgcaggtgcgatgagaggcccaccaaccagccctcgagtggatcaaccttcccgtgtgtgtcctcggtgacaggcatttgcaaagcacacacgtgatctcatccactcctccggtggcctgtgaggtacttactgttatccccgttgcacagattagcagcctaaggcacaggatrgtgaagtaattcgtttaaggccacgtgctgggtgagccgtaggacggggattttatcgtggttgttgagatgtttgtaaaaagatttttcacccttggcaccattgacatttgggaatggatggttctttgctgtggagcgctatcctataggacgttgtacagcccctctagatgccagtaaccttccctacttgggacaaccaaaaatgtctctagacattgccatgtggcccctggggaaaacctcctggttgagaaccactggtctaaaattctttttttttttttttttttttga

SEQ ID NO: 21355 - DNA, 601 bp, Human
gccccttggcctcccacatcccagacctggggcagagggtgctcttggttcctttgagcagtgagcacatcagggatctgtggtccgtgcaggtgcgatgagaggcccaccaaccagccctcgagtggatcaaccttcccgtgtgtgtcctcggtgacaggcatttgcaaagcacacacgtgatctcatccactcctccggtggcctgtgaggtacttactgttatccccgttgcacagattagcagcctaaggcacaggatggtgaagtaattcgtttaaggccacgtgctgggtgagcsgtaggacggggattttatcgtggttgttgagatgtttgtaaaaagatttttcacccttggcaccattgacatttgggaatggatggttctttgctgtggagcgctatcctataggacgttgtacagcccctctagatgccagtaaccttccctacttgggacaaccaaaaatgtctctagacattgccatgtggcccctggggaaaacctcctggttgagaaccactggtctaaaattctttttttttttttttttttttgagacagagtctcgctctgtcacccaggctggagtgcact

SEQ ID NO: 21356 - DNA, 601 bp, Human
ccaggctggagtgcactggtgccatctgggttcactgcaacctccgcctcacgggttcaagtgattctcctgcctcagcctcctgagtagctgggattacaggctcctgccaccatgcctggctaattttggtatttttagtagagacggggtttcaccgtgttggccaggctggtctcaaactcctgacctcatgatccgcctgcctcggcctcccaaagtgctgggtttgcaggcatgagccaccatgcctggccttaaaattcttttaatccttcatttttatgagcacttgagtcawtttctattattccagggagatttaggttgaaagaaattctttttttgttttgaaacagtttcaaacttatagaaatggtataagtatgaagaattcattttgacctgaaccatttgagagtaactgactgactggatgtctctcaccccgaaaacttcagtgtgtgtttcagacagacaagggtgtattttacacgatgtggtaaggatcgtcagaattggaattcacactgatacatgacccacaatgaattctcaggccctgttgaagtttctttatttgtcccaataatgtccttta

SEQ ID NO: 21357 - DNA, 601 bp, Human
tgaaagaaattctttttttgttttgaaacagtttcaaacttatagaaatggtataagtatgaagaattcattttgacctgaaccatttgagagtaactgactgactggatgtctctcaccccgaaaacttcagtgtgtgtttcagacagacaagggtgtattttacacgatgtggtaaggatcgtcagaattggaattcacactgatacatgacccacaatgaattctcaggccctgttgaagtttctttatttgtcccaataatgtcctttatagcagaggactccagctcagggccacrtgttacatttgcttgtctggtttctcgagtctccttctgtccggatccgttccccaggcgtttctttcacttactgggaagagcgcaggctggtgatttcatggatgctccttgctttgggtttgtctggtgttttctcccgagtggattcaggtcatgcatcttgggctggaaggtcccaggaatgatgctggcctcttctctctcagggcgtcctgccaggtttcgatgtctccctttcctggtgctgtgtactttgagcgctcgacggaggtgatgtcctgccgggcctctccactg

SEQ ID NO: 21358 - DNA, 601 bp, Human
atagaatcaacatttttaggggaagagcagttatgaaatctgacctctgtacttggcaagatttgttctgggtctttatcaaaatcctcatgggttgtaacacggctcttgtcaatgtcagagccttccagattccgcctttttacctctgtgattttacacttgtttgggagagtcggtattgaactctgactttccattcagtgtgacggagtgcagagccatgttacttaccatcctgggcttttcctgaacctgctgtgtgctcaacagcatcctggacaccttctttttaaaataktttaatttttaaaaattctaagtaggccaggtgtagtggctcacacctgtaatcccagcactttgggaggccaaggtgggtggatcacctgaggtcgagagttcaagaccagcctggccaacaagacaaaaccccatctctactaaaaataaaaaaattagccaggcatggtggcacacacctgtaatcccagctactcgggaggctgaggcaggagaatttcttgaacctgggaggtggaggttgcagtgagctgagattgcaccactgcactccaggctgagcaacagagcgagcctc

SEQ ID NO: 21359 - DNA, 601 bp, Human
agggttcccttgcattgcctaaggttccaggatcccatccaggagccacgtcacattcagtcatcatgtcgccttaggctactctggcctgtggccgtttctcagatcttgtttctcaagaccagtttccctgatggccttggcagtttttgagtattgatcaggtgttttgcgggacgcctgtctcctgggatctgtctgatgtcttccccatgattagactggagttatgcattgggggaagaagaccacagaggtgaaacgtcatgctcatcacatcaaatcttggctgggcgcagtrgctcatgcctgtaatcccagcactttgggaggccaagcctggcagatcacctgaggtcaggagtttgagaccagcctggccaacatggtgaaaccctgtctctaccgaaaatacaaaaattagccgggtgtcatgacacgcacctgtagtcccagctacttgggaggctgaggcaggaggatcgcttaaaccccagaggcagaggttgcattgagctgagaacgtgccactacactccagcctcggtgacagagcgagactccatctcaaaaaaaaaaaaaaaaaaaaaaaatcaacctg

SEQ ID NO: 21360 - DNA, 601 bp, Human
ttggcagtttttgagtattgatcaggtgttttgcgggacgcctgtctcctgggatctgtctgatgtcttccccatgattagactggagttatgcattgggggaagaagaccacagaggtgaaacgtcatgctcatcacatcaaatcttggctgggcgcagtggctcatgcctgtaatcccagcactttgggaggccaagcctggcagatcacctgaggtcaggagtttgagaccagcctggccaacatggtgaaaccctgtctctaccgaaaatacaaaaattagccgggtgtcatgacaygcacctgtagtcccagctacttgggaggctgaggcaggaggatcgcttaaaccccagaggcagaggttgcattgagctgagaacgtgccactacactccagcctcggtgacagagcgagactccatctcaaaaaaaaaaaaaaaaaaaaaaaatcaacctgatttaccactgggcaccttcacttttgatatctcttttaatcttctcaacaagccccaaagttgatgtgattcatcccattttccagctgggaggacagaggctcggagaagggaagtaatattgtgctgagtttcacc

SEQ ID NO: 21361 - DNA, 601 bp, Human
ccgaaaatacaaaaattagccgggtgtcatgacacgcacctgtagtcccagctacttgggaggctgaggcaggaggatcgcttaaaccccagaggcagaggttgcattgagctgagaacgtgccactacactccagcctcggtgacagagcgagactccatctcaaaaaaaaaaaaaaaaaaaaaaaatcaacctgatttaccactgggcaccttcacttttgatatctcttttaatcttctcaacaagccccaaagttgatgtgattcatcccattttccagctgggaggacagaggctyggagaagggaagtaatattgtgctgagtttcaccgccaaggaggcccctgctccagggtggctaagcggcctcattgtttttgacatttggctggttttcaatttgagggttattataaacccgctgctgtgctcggcctttttgttttctttcgggttatttcctgagggtgtgttccctcaagagggatgactgggtaaagagtgtgaggtttttgttgccagatggctctttagaaaaatggaaccagcctgcagggtatgggcagctctgcgatcccgttcacccacttccccttc

SEQ ID NO: 21362 - DNA, 601 bp, Human
tccagggtggctaagcggcctcattgtttttgacatttggctggttttcaatttgagggttattataaacccgctgctgtgctcggcctttttgttttctttcgggttatttcctgagggtgtgttccctcaagagggatgactgggtaaagagtgtgaggtttttgttgccagatggctctttagaaaaatggaaccagcctgcagggtatgggcagctctgcgatcccgttcacccacttccccttcaaggccgagttgtgtcatttttatttattttgttttgttactttgtcacactttttttttttttattctgttggccacccccagtgacttggtaccaaagaacagttggctgcttgtaaaactcaaaatcactctggagggaccatgatttagtttcactgacgtcattgaaaagaatgtgcctcggccgggtgcggtggctcacgcctgtaatcccagcactttgggaggccgaggcgggtggatcacgaggtcaagagatcgagaccagcctggccaacatggtgaaaccccgtctctactaaaaatacaaaaattagctgagcatggtggtgcgtgcctgtaatcccag

SEQ ID NO: 21363 - DNA, 601 bp, Human
gggtaaagagtgtgaggtttttgttgccagatggctctttagaaaaatggaaccagcctgcagggtatgggcagctctgcgatcccgttcacccacttccccttcaaggccgagttgtgtcatttttatttattttgttttgttactttgtcacactttttttttttttattctgttggccacccccagtgacttggtaccaaagaacagttggctgcttgtaaaactcaaaatcactctggagggaccatgatttagtttcactgacgtcattgaaaagaatgtgcctcggccgggtgcsgtggctcacgcctgtaatcccagcactttgggaggccgaggcgggtggatcacgaggtcaagagatcgagaccagcctggccaacatggtgaaaccccgtctctactaaaaatacaaaaattagctgagcatggtggtgcgtgcctgtaatcccagctactcgggaggctgaggcaggagaatcgcttgaacccaggaggcggaggttgcagtgagccgagatcgcgctgctgcacttcaccctggcgacagagttagactccatctcaaaaaaaaaaaaaaaaaaaaattacccctggc

SEQ ID NO: 21364 - DNA, 601 bp, Human
ccccgtctctactaaaaatacaaaaattagctgagcatggtggtgcgtgcctgtaatcccagctactcgggaggctgaggcaggagaatcgcttgaacccaggaggcggaggttgcagtgagccgagatcgcgctgctgcacttcaccctggcgacagagttagactccatctcaaaaaaaaaaaaaaaaaaaaattacccctggccgggcaaggtggctcatgcctgtaatcccagcacttcgagaggccgaggcgggcagatcacctgaggtcaggagttggagaccaacctggccaayatggtgaaaccttgtttctactaaaaatacaaaaattagccgggcgtggtggcacatgtcggtaatcccagctacttgtgagaattgcttaaacctgtgaggcagaggttgcagtgagccaagatcgtgccactgcactccagcctgggtgacagagtgagactctgtctcaaaaaaagaaaaaattacccctaagagtgtttcccaaactcacctagtgtccacacagcgtgttcaaatggtcagtcttgcgtatactttatcctacttgttgactgagcactggtgagcatatctgtg

SEQ ID NO: 21365 - DNA, 601 bp, Human
acagcgtgttcaaatggtcagtcttgcgtatactttatcctacttgttgactgagcactggtgagcatatctgtgaggactcagggctggtggctctccagagctgctgaagtcagagatgtgtgcaggaggcggcgtggctgacatacgggcatcttggtggcagatttgtctagccagggatgtgtgcctgacaacagcatattccagatctccgtaggtagcgttctcaggagtggttaaaagctgggcatccctggaggatggtctgctctgggaactgacttgctccaggatgagytagatgcccggatgccctctcacctttctcagatggccagtgagccaaggttaaatgttaaatgtcaatatgtgcttgggcgtgacctggcccctgtttaatatgggagaacaatgggagtggagggtagaggtttgagatgagaagatagaggttgtgcgttgagaatcattgtatcagcacctcctgagcctacaaaaggatgggattgaaggaaatgagatggcccgagagcagttgtcctcctcgaaggctgccacctgggtgctttcaggcacaagaaagagaaaatcgaagtcc

SEQ ID NO: 21366 - DNA, 601 bp, Human
ggcagatttgtctagccagggatgtgtgcctgacaacagcatattccagatctccgtaggtagcgttctcaggagtggttaaaagctgggcatccctggaggatggtctgctctgggaactgacttgctccaggatgagctagatgcccggatgccctctcacctttctcagatggccagtgagccaaggttaaatgttaaatgtcaatatgtgcttgggcgtgacctggcccctgtttaatatgggagaacaatgggagtggagggtagaggtttgagatgagaagatagaggttgtgcrttgagaatcattgtatcagcacctcctgagcctacaaaaggatgggattgaaggaaatgagatggcccgagagcagttgtcctcctcgaaggctgccacctgggtgctttcaggcacaagaaagagaaaatcgaagtccagctggagtcagaagggctccacagcagactggcttcgggcgtgtcccaggcagggtccaggtggcatctgcaggatccatcatcctgtctccatgacctgccttgaggtcctccatgtgggttttgcctggtattccagagaattcggggctctccacac

SEQ ID NO: 21367 - DNA, 601 bp, Human
taaggtgggcgcagcagccacagacgagcctctgacccagtggaagcctcctgggctctggttgggcctgtgcttctcgtgaaccaatccttgcatgtgcgcgggggtgggggttgggagagtggttcagtgtgttcattggtttagtcattaggaatgagagtggcagccaggtgtggtggctcacgcctgtaatcccagcactttgcaaggccaaggcgggcaggtcaggaggtcaggagtttgagaccggcctggccaacgtggtgaaaccccgtctctactgaaaatacaaaaaaawtagctggggttggtggcacgagcctataatcccagctattcgggaggctgaggcatgagaatcacttgaacccaggaggcggaggttacattgagccgagatcatgccactgcactctagcctgggcgacagagtgagactccatctcaaaaaaaaaaaaaaaaaaaaggaatgagagtggccaggggatagaggtggtcccctgtcctccatctgccactggagaagtgagcctccttgccttgagctggggtgggcactgactctgaaacccatcgagggctctccagactgaggacc

SEQ ID NO: 21368 - DNA, 601 bp, Human
cagtgtgttcattggtttagtcattaggaatgagagtggcagccaggtgtggtggctcacgcctgtaatcccagcactttgcaaggccaaggcgggcaggtcaggaggtcaggagtttgagaccggcctggccaacgtggtgaaaccccgtctctactgaaaatacaaaaaaaatagctggggttggtggcacgagcctataatcccagctattcgggaggctgaggcatgagaatcacttgaacccaggaggcggaggttacattgagccgagatcatgccactgcactctagcctgggygacagagtgagactccatctcaaaaaaaaaaaaaaaaaaaaggaatgagagtggccaggggatagaggtggtcccctgtcctccatctgccactggagaagtgagcctccttgccttgagctggggtgggcactgactctgaaacccatcgagggctctccagactgaggacctgacccctgggctgagttcagcaccacctgtgatccaggaggaccatttgccaatagttggggcgggtggggccgggggctgccagactccttggtgaagttgctgctcttgctttttgcagattcc

SEQ ID NO: 21369 - DNA, 601 bp, Human
acccaccacagggacctctgtgcacagaggcctcgcctggggcctcagccaggccttggctaaggatggagagccccaccctcatagcagcctccagctcctggctcagcctgccgggaatttccagaagggcctgcacacagtggatttggtttgggccacttttgggtaccaggtctggtcaggaggaagactgtgttcattttccccttttctttactcttccatgaatctcatcctccaagctggatgacagagcaggtggctatggtccattcctttttttttttttccccatctrtcagttcttccattactttcttttaattcaagcattcatacattaagaagggtttctatcctttcatttttcaatataatatacacaaccataatgctagttcagtttcaaattatgggggatcacattcgaatatgcttggatgtgacaagtggctgttacaatactgagaaatttcatgaaagaggtattcaacaatttgtaaggtaatcaaatatgtttttgctgcataggccaatgcattaatagtaacttgttttaaaatgcagtcttttggccggatatgatggctcacactta

SEQ ID NO: 21370 - DNA, 601 bp, Human
aggagtggtgcgtcggtgacagaacccgtcgcggaagagcgagggttaatgagccagccactgatggagacctgccacagcgtgggggcagcctacctggagagcctgccgctgcaggatgccagcccggccgggggcccctcgtcccccagggaccttcctgagccccgggtgtccacggagcacaccaataacaagattggtgagtcagcctgttttgggaggtcccctgcagcccaggggcagatgggagatgaatacggggccctgggccctggaagggacctggagaccctggagytgaaaggcccaggaaaggagaggcatagattcttcaccccaactgaagtttctgtaagtagggacagcgagggtacttacctcgtaggccattgtgcggattcatgagccagtgtgcatgagatgcctgctgttactcataaaaaacgaacaccaccccagcccccaacaccgagcacccgaggggacaggaggaagacgtgccagtggtcacaggacctgccacttgtctggcgcattccgggcactgtgtaggtgccatctcttcatctctgatggtctcaccaccttctttggatgg

SEQ ID NO: 21371 - DNA, 601 bp, Human
tccaccgctttgaatccagttaattccagatttcctggggactcctgcccatttccctgaggaatgtgaggggaccagcctgtccccagctgtggctccttctccctaatccagcacccccaccctcacttccctcccacctgaccccacccgcctctcatcttctctgcccatccccctctgggccttctctcccctcctggggtctcctctctcaccacccccggcccccatcttttgcccagccctctatagggctcctagggctgggagcccacaagcctgatggaggtgtggggastgctgaggccctgctctgttttggggtctgtgggggcgcccagcccatagcctgtcccgcactctgggccttctcctcttgctgccgtttggcgcacttctctctttcctgggggtgttcaaaaccagaatagaagaaccagcgtcatgcaatagggttgagggtgtgggggactcgagaacctttttggggttcctgaatccgaggggtataactgcattacccagaaaggcaggggtccctgcacccccaccccaccccagctctcaagttccctcttgagcttccccattctggcct

SEQ ID NO: 21372 - DNA, 601 bp, Human
acacagataggagcagaaagggccaccaggcggagtgggtggtttttttttgggggatttctcctaactacgtggcgaccttgggcaggtcatttaacctctccaggcttcagattcttacctgtaaatgggaatcttgatggggtccgccttgcaggagggctggggacccaggagtgggggtgtggaaactgctcagctctgctgtttctgctcgtgctctggttacccacggctttgcctgtttttgtccacagtttgctttctgtcccaccctgtcctcttcttccctacccatccscagagatgtgctgagaaaatcctaagtacaagtgggctggttcttaactcctcaaggcccagctcctagctgttctatttcctctgagcccccaggatgcctgtaaggtacatcagagaggctgtgccatcagcctgaagccacccggcaggtgtaccagcactgggcctcggcccttctctgcctctttgctcccatcctggctggtgctctggcctccctcgctcacccatccttttgccttgcagagaaaatctacatcatgaaggctgacaccgtgatcgtggggaccgtgaaggc

SEQ ID NO: 21373 - DNA, 601 bp, Human
accacctggttccggctctgcacgctttggggtgtggatgtcgagaggcaccacggcctcacccaggcatctgctttactctggaccataggaaacaagaccgtttggaggtttcatcaggattttgggtttttcacatttcacgctaaggagtagtggccctgacttccggtcggctggccagctgactccctagggccttcagacgtgtatgcaaatgagtgatggataaggatgagtcttggagttgcgggcagcctggagactcgtggacttaccgcctggaggcaggcccgggaargctgctgtttactcatcgggcagccacgtgctctctggaggaagtgatagtttctgaaaccgctcagatgttttggggaaagttggagaagccgtggccttgcgagaggtggttacaccagaacctggacattggccagaagaagcttaagtgggcagacactgtttgcccagtgtttgtgcaaggatggagtgggtgtctctgcatcacccacagccgcagctgtaaggcacgctggaaggcacacgcctgccaggcagggcagtctggcgcccatgatgggagggattgacatgtttc

SEQ ID NO: 21374 - DNA, 601 bp, Human
cgccccgctatacccggcgccgcctcccggcgtctgagctgacacctccttagcgctggccgcgggccgcctctgcggcagcgctagtcgccttctccgaatcggctccgcacaggtaagatcaggggacccggcgcctgagctgccgaggaaggagtcgggggtgctgcgtgagactgagagttgggaggcaaagaaacaaaatcggatttcctcagagggccagaggaagagactgaaacacggtagccccaaatccttgggcggctgggaggtggtccctgtcatgcccacgacgggkgggcgcgtctttaccgacagcctgcatggatccgcagatgtgctgggcgcttagatgcctgcggctatgcagagacgcagtccagagaggtgaccccagatcctggtgggggctggatcccagggccccgacatccctttgcaatttccagccagcagctaaagactcccttcccggggctttagagaggctccaggctcgcgatccatgaacacacaaaaaccttccttgctcatgttctgaaaaaaagccccgcctcagctttgtgaatgttaataatagggggaagatttgttctct

SEQ ID NO: 21375 - DNA, 601 bp, Human
gtagccccaaatccttgggcggctgggaggtggtccctgtcatgcccacgacgggtgggcgcgtctttaccgacagcctgcatggatccgcagatgtgctgggcgcttagatgcctgcggctatgcagagacgcagtccagagaggtgaccccagatcctggtgggggctggatcccagggccccgacatccctttgcaatttccagccagcagctaaagactcccttcccggggctttagagaggctccaggctcgcgatccatgaacacacaaaaaccttccttgctcatgttctgaaraaaagccccgcctcagctttgtgaatgttaataatagggggaagatttgttctctcttgggtgtgtgtacaggtggaacaatctgcagaaaaagaccttttttcggaaaaccttttcagtttgaagtttcagcaaatccatttttcatttccttgcatttggggagatgacatgaaatttaagctccagctttggggctgtctctgaagttctggggttcggcttacctttcccgggatgaggttttgatttggaggaagtaaaatgggttttgtcttaacctgggctcgttctttaaac

SEQ ID NO: 21376 - DNA, 601 bp, Human
cacacaaaacaaggactaacatgcatgtttcacttaaatggtttttccggtttgtataatccattaatttggcccttgtggtttcccttagctagctgtgtgtaacgtttgctttagaatactgtattgttgattttgtgatcaattgtacagtacttggatctttcctgtattcccatccaaatgttgctggcacagtgcctacaacacccccacccctcactgtgagtcagtgttgttatggttgatactgcaggcacaagtgcaggattttctcacactggaaggcacacacacacasacacacacacacacacacacacacacacacacacacacacttctaagcttgccccgcctgcctctagagcactttttggagttgctcatgtggaagcccagaaggctctggcttctccaagctcaggtaggtaccttgcaattaccatgtttgtccagccctaatgacagcacagctctaggctgcatttcctaaatgagtaagacctggtctcatccattttgctttgtaataagcttttctgcaaggacaagagtttgcttaaggtaatcatagctttttacttgaaaactgctgaaa

SEQ ID NO: 21377 - DNA, 601 bp, Human
acatgccctgttattcttctgggaaaatggcttacagaaataatggaggggtaaagcataggttataatgatctaggaataatgttctggaataagacaggatctatccaattgctgttcaattgatcttcctataatgatgaaaatgttatatggctgcactgtccaatatagtagccactagcccacatgtggttattgaacactggaaatgtggctagtaagattgagagactgcatttttttattttaattaatttacatttagatagccaattgattagatatatattggaattcratgaatctagtgatctttctattagtgttcatcatatttcaaccatttggttgtcatttatgttgatgtcccaatagttttaccaagactattattattatttttttagagacaaggtctcactctgtcaccaggctggagtatagcggcacagctcactgcagccttgagctcctgggatcaaaggatcctccaacttcaacctcctgagtagcttgggctacaggtgtgcaccacatgtacagttgatttttttcattttttgtagagacggggtctcactatgtggctcaggctggc

SEQ ID NO: 21378 - DNA, 601 bp, Human
aaccatttggttgtcatttatgttgatgtcccaatagttttaccaagactattattattatttttttagagacaaggtctcactctgtcaccaggctggagtatagcggcacagctcactgcagccttgagctcctgggatcaaaggatcctccaacttcaacctcctgagtagcttgggctacaggtgtgcaccacatgtacagttgatttttttcattttttgtagagacggggtctcactatgtggctcaggctggcatctaacgcctggcctcaagcatcttcccatctcagcctcycaaagctgggattacaggcataagccactatacccagcccaagattattatttagtcagtattttcattgaatgtctttttatctttttaaaaaattaggtataacttctattcagtgaaatggatagatcttaagtcgtgcccctaagttgggtgttcttgccttctaaaagtatgtttttagaatagtaagggcaatttataagtttataatgtttttttaaaaggaaattatacctaagacactgatttgctttcattttcaagttttctccaaaggactttgaaaggtttgatgag

SEQ ID NO: 21379 - DNA, 601 bp, Human
gatcaaaggatcctccaacttcaacctcctgagtagcttgggctacaggtgtgcaccacatgtacagttgatttttttcattttttgtagagacggggtctcactatgtggctcaggctggcatctaacgcctggcctcaagcatcttcccatctcagcctcccaaagctgggattacaggcataagccactatacccagcccaagattattatttagtcagtattttcattgaatgtctttttatctttttaaaaaattaggtataacttctattcagtgaaatggatagatcttaagtygtgcccctaagttgggtgttcttgccttctaaaagtatgtttttagaatagtaagggcaatttataagtttataatgtttttttaaaaggaaattatacctaagacactgatttgctttcattttcaagttttctccaaaggactttgaaaggtttgatgagttttgacaaatgcacacatccatatactccacactctgtatagcgcattgccattaccccaagaaagtgcccacatattccttctcagtgaatccctgccccaacttctgccccctggcaatcactattctgattcct

SEQ ID NO: 21380 - DNA, 601 bp, Human
gaatctccagctatggaaataacccccaagatgtccccagagcctttgaggagtgtatgcaaaaagtcaaggggcaggttccatcccacctccacggatccacccccattcacctgggagccacggctgggatgcgcttgctgaggtaaaggctaagtggcacaaaggagcccatttgaccaaaataaccaagaatatgttgaatcttgccaagaatgtaactctatttctgggaacaaccctcgccccccaaaaagaagcccacattctgccataaatttgggctttaaaggttgggaarcttttagtttttattttaatacccagaaagaaacagttctaaaattgtttccctctcccttggtgattttactgagaactttgaaaaagagagaggtcatatgaaatctgctcatgggatataactctagttctttgaaaagtagttgttttgacagttggcatttgacacctgtgaacaaccagctaagtttggtagtaagtacaacccatagctatgtagcttccgcttgtgtacaaaataccactgaaatctgctttaaaacaatggcatgtctgcacctcaaatcagtcaaagctt

SEQ ID NO: 21381 - DNA, 601 bp, Human
tcccctccgtctccctctcatgttgcccacttccagtaaatttgagtaagaagtctagggaagttccagagcttcagttgttttgtaaatgactcaagacctggaatccctttatggacacaaactgttttaaaccaggagctaaataagcctgagaattttgagactcccctgggtgtagacaaaataatattagtggtcacaagagaaatgtgtgctgaagggggagagggcagagcccttcccaggctcagcctccttttagatgggtctatattaggcagacttgatacccttatayggcagaactttagagcaaccacattccatcatgttgatcagtaattcatttgataagtgttccagggcccagaaggctaattcaggcatcagctagaaagctattgctaatattaaactcaacattatgcagtgtgtgttcatgagggcactaactccacaggtgagaccccagacccaaacaccagtgctcaggggacatcaatcttagccatggctgggtggctgagaggatgggccttgactgcctagaggggtatgaggaaatcagaagccacagatcctggcttcttatgggact

SEQ ID NO: 21382 - DNA, 601 bp, Human
ggatcttgtttcctcatctgtaatataaggaactacgtagtgtggtgagaatgatagctggatatgtactttgcaagttactttcttatcaataagtctccagtcaccttagagctgaagtctcactctgacaacatgttagatattaggaatgtgcattcactttctatctttccctttttaagtaagaaatttttcttctgtttttaatgtaatatatgttcagtgaaaaacatttaggagatgcacaccaaaaactataaaggatttatttaaaaacagaattaaccactattaacayactattgcattttcttccattttttaaatgtatgaatgtgtaaaaacttggcttcatatggtatatataattttatatttaccttttattttacctaaccatatattatgatcattttcctgtgttgttaatgtccttttaaaatacgattttttatgagagcataatattccaagtgccataacttaaaaagaaaaaaaattgaccattcgattatgaaagaaagtacattcttattgtaaaaatttaaaaccatagaaagagtgttaaagtcaaaatgaaagatcctccttccaatcc

SEQ ID NO: 21383 - DNA, 601 bp, Human
gactatactagaaaagaaaaaaagtacaaatcagatttggaagtagatactaaatagccaattgattagtttgatttttttttcttttttctttttttctttttttttttggagatggagtcttgctctgtcacccaggctggagtgcagtggtgtgatcttggctcactgcaagctctgcctctcgggttcacgccattctcctacctcagcctcccgagtagctgggactacaggtgcccgccaccatgcccagctaattttttctatttttttttagtagagatggggtttcactgtgttagccaggatggcctcgatctcctgacctcgtgatccgcccgccttggcctcccaaagtgctggaattacacgtgtgagccaccacgccccgcatattttttctttcaaccaatatttcagccatagggtgacccaagtatgatatgctatagattatatgtaacaatttttgaaaatcatagatttttttcataccatagaggcagaaaggggcctgtttgcctccttctcagtcatatgaagatttttctggaaaacactcatttgggttatatttgatgaatattaagcttttata

SEQ ID NO: 21384 - DNA, 601 bp, Human
ggaagtagatactaaatagccaattgattagtttgatttttttttcttttttctttttttctttttttttttggagatggagtcttgctctgtcacccaggctggagtgcagtggtgtgatcttggctcactgcaagctctgcctctcgggttcacgccattctcctacctcagcctcccgagtagctgggactacaggtgcccgccaccatgcccagctaattttttctatttttttttagtagagatggggtttcactgtgttagccaggatggcctcgatctcctgacctcgtgatcygcccgccttggcctcccaaagtgctggaattacacgtgtgagccaccacgccccgcatattttttctttcaaccaatatttcagccatagggtgacccaagtatgatatgctatagattatatgtaacaatttttgaaaatcatagatttttttcataccatagaggcagaaaggggcctgtttgcctccttctcagtcatatgaagatttttctggaaaacactcatttgggttatatttgatgaatattaagcttttataggatttttgcagaatcttgtcactgacctttgttaaat

SEQ ID NO: 21385 - DNA, 601 bp, Human
ttttttctttttttttttggagatggagtcttgctctgtcacccaggctggagtgcagtggtgtgatcttggctcactgcaagctctgcctctcgggttcacgccattctcctacctcagcctcccgagtagctgggactacaggtgcccgccaccatgcccagctaattttttctatttttttttagtagagatggggtttcactgtgttagccaggatggcctcgatctcctgacctcgtgatccgcccgccttggcctcccaaagtgctggaattacacgtgtgagccaccacgcccsgcatattttttctttcaaccaatatttcagccatagggtgacccaagtatgatatgctatagattatatgtaacaatttttgaaaatcatagatttttttcataccatagaggcagaaaggggcctgtttgcctccttctcagtcatatgaagatttttctggaaaacactcatttgggttatatttgatgaatattaagcttttataggatttttgcagaatcttgtcactgacctttgttaaataattgcattacttgaatatgtacctcagtttcctcatcagtaaaatgaaagggt

SEQ ID NO: 21386 - DNA, 601 bp, Human
cctcagcctcctaaagtgctgggattacagatgtgagccatcacacccagccaaaagaaaagattttactgtaggggaagcagtatgccttagtggcttaagttgaacatagttcaaatccaattccttagaaaagagagttcataaattgaatcaacaacattcaggactttagcataaaatagagtattttgcaccagtagattaaagattgaatagtcatatggaaaaagtaaagccaagtctctgagtctttaaatcaaataaatttcaatggataaaagatttatatgtgacaagkatatttgtttgtaatggcaaaatgattgggaaccacctcaatgttcatctagatgatattccttaaataaagtatggtttatttgtacagtggaatactatgcagctactaaaaaaataggccactgtataagtacaatgaatggaaagatctcaaagatatataattttaagtgagaaaagcaacgggtagaatggggtatataaagtgctaccatttatggctttaaaaaaagaaaagcatgggagaaaatatatatatttgcatgtgcatgccagatctttggaaggatacacaaaa

SEQ ID NO: 21387 - DNA, 601 bp, Human
actaaaaaaataggccactgtataagtacaatgaatggaaagatctcaaagatatataattttaagtgagaaaagcaacgggtagaatggggtatataaagtgctaccatttatggctttaaaaaaagaaaagcatgggagaaaatatatatatttgcatgtgcatgccagatctttggaaggatacacaaaaactggcaatagtgattgtttccagaaaaaggcctgatggctgcaagtggatgagaaggagacttcactttcatatgtttatttgtaccttttggattattttgctagrtggatgggtgatattctacttaaaatgatacattatatatatccattttctcaccaagtgaagttcataaaacctggttcatagggctatcataagagctggatcagataatgtgagagagagcctagcgctatgcctggtacgaggtaattgtcacacacacacacacacacacacacacccttttcccacccctacttgaattatctagacaacctgtgatcaaagacatgctgacacagaatggtattttttgtttctctcttggcattggagggtagtgatagaatttgcaaaagg

SEQ ID NO: 21388 - DNA, 601 bp, Human
gaaggatacacaaaaactggcaatagtgattgtttccagaaaaaggcctgatggctgcaagtggatgagaaggagacttcactttcatatgtttatttgtaccttttggattattttgctagatggatgggtgatattctacttaaaatgatacattatatatatccattttctcaccaagtgaagttcataaaacctggttcatagggctatcataagagctggatcagataatgtgagagagagcctagcgctatgcctggtacgaggtaattgtcacacacacacacacacacacacacacccttttcccacccctacttgaattatctagacaacctgtgatcaaagacatgctgacacagaatggtattttttgtttctctcttggcattggagggtagtgatagaatttgcaaaagggaaatacttggctctccacaaaaaaagtggtttctaataccttactctttttttttttttttacttagagattttattattattattattattatactttaagttttagggtacatgtgcacaatgtgcaggttagttacatatgtatacatgtaccatgctggtgtgctgcacccat

SEQ ID NO: 21389 - DNA, 601 bp, Human
aggatacacaaaaactggcaatagtgattgtttccagaaaaaggcctgatggctgcaagtggatgagaaggagacttcactttcatatgtttatttgtaccttttggattattttgctagatggatgggtgatattctacttaaaatgatacattatatatatccattttctcaccaagtgaagttcataaaacctggttcatagggctatcataagagctggatcagataatgtgagagagagcctagcgctatgcctggtacgaggtaattgtcacacacacacacacacacacacacacccttttcccacccctacttgaattatctagacaacctgtgatcaaagacatgctgacacagaatggtattttttgtttctctcttggcattggagggtagtgatagaatttgcaaaagggaaatacttggctctccacaaaaaaagtggtttctaataccttactctttttttttttttttacttagagattttattattattattattattatactttaagttttagggtacatgtgcacaatgtgcaggttagttacatatgtatacatgtaccatgctggtgtgctgcacccatta

SEQ ID NO: 21390 - DNA, 601 bp, Human
ggattattttgctagatggatgggtgatattctacttaaaatgatacattatatatatccattttctcaccaagtgaagttcataaaacctggttcatagggctatcataagagctggatcagataatgtgagagagagcctagcgctatgcctggtacgaggtaattgtcacacacacacacacacacacacacacccttttcccacccctacttgaattatctagacaacctgtgatcaaagacatgctgacacagaatggtattttttgtttctctcttggcattggagggtagtgagagaatttgcaaaagggaaatacttggctctccacaaaaaaagtggtttctaataccttactctttttttttttttttacttagagattttattattattattattattatactttaagttttagggtacatgtgcacaatgtgcaggttagttacatatgtatacatgtaccatgctggtgtgctgcacccattaactcgtcatttagcattaggtatatctcctaatgctatccttcccccctccccccaccccacaacagtccccagagtgtgatgttccccttcctgtgtccatgtg

SEQ ID NO: 21391 - DNA, 601 bp, Human
atcccttgtgagtttcccagaagaggtcatggagaatttagaagagttgctcatgggtatacattctcctggaaaagactggaagccaagggccaatggactaggcggtcctggagggcagagacctgtcttggtatcttcatattcccagcactctgcacaaggaatagagcctagaaggtacttagtaaatgttggttgaattcataaataaatatgttaaggatatgagacttttcatcctgaaaagaagctttaaatgtaacagttttttaaagaggatagtaactaattcttctcyattttattcagatatcagagtaagatacaggccttagggcctgatggatttgcattagcattaaataaatattttctctttgaatgaacctgaagtcattatatttactgacaaagatttgggggatggggaagatattcttagctcagggtttaatatatttaaaaatatgtatatttatagatatctataaatacatacatatatatatatgatggtcaagtgaccagaatggtccaaagctggaatcacagctgtcacctggtgacaggtgaaaggacctccataccttgtttttag

SEQ ID NO: 21392 - DNA, 601 bp, Human
tctaagttaaaagttccctttttttaattataaagaattttgtgtccagccaaattagtatttaaatgtgaagatgtaggctgggcacggtggctcacacctgtaatcccagcgctttgggaggccgaggcaggcggatcacctgaggtcaggagtttgagaccagcctgaccaacatggagaaaccctgtctctactaaaaatacgaaattagctgggcatgttggtgcatgcctgtaatcccagctactcagaggctgaggcaggagaatcacttgcacctgggaggtgaaggttgccrtgagccgagatcacgccattgcactccagcctgggcaacaacagcaaaactccatctcaaaaaataaaaataaaaataaataaataaaaatgtgaaggtgtaaaaagacttgagaagatttgctgcacagaagacttacaatgaaaatatttttggtggaagtaataaaataagaagagaaataaatccaggagatgttacaaaaacactggaagtaagaataaatgatgttgtggcttaaaatttacattaaaaaagccgggtgctgtggctcatgcctgtaattccagcactttggga

SEQ ID NO: 21393 - DNA, 601 bp, Human
caggcggatcacctgaggtcaggagtttgagaccagcctgaccaacatggagaaaccctgtctctactaaaaatacgaaattagctgggcatgttggtgcatgcctgtaatcccagctactcagaggctgaggcaggagaatcacttgcacctgggaggtgaaggttgccgtgagccgagatcacgccattgcactccagcctgggcaacaacagcaaaactccatctcaaaaaataaaaataaaaataaataaataaaaatgtgaaggtgtaaaaagacttgagaagatttgctgcacaraagacttacaatgaaaatatttttggtggaagtaataaaataagaagagaaataaatccaggagatgttacaaaaacactggaagtaagaataaatgatgttgtggcttaaaatttacattaaaaaagccgggtgctgtggctcatgcctgtaattccagcactttgggaggccgaggcaggtgaatcatttgaggtcaggagttcgagaccagcctggccaacatggcaaaaccatgtctctactaaacatacaaaaaattagctgggtatggtggcatgtgcctgtactcccagccac

SEQ ID NO: 21394 - DNA, 601 bp, Human
ggcaggagaatcacttgcacctgggaggtgaaggttgccgtgagccgagatcacgccattgcactccagcctgggcaacaacagcaaaactccatctcaaaaaataaaaataaaaataaataaataaaaatgtgaaggtgtaaaaagacttgagaagatttgctgcacagaagacttacaatgaaaatatttttggtggaagtaataaaataagaagagaaataaatccaggagatgttacaaaaacactggaagtaagaataaatgatgttgtggcttaaaatttacattaaaaaagccrggtgctgtggctcatgcctgtaattccagcactttgggaggccgaggcaggtgaatcatttgaggtcaggagttcgagaccagcctggccaacatggcaaaaccatgtctctactaaacatacaaaaaattagctgggtatggtggcatgtgcctgtactcccagccactcaggaggctgaggcaggagaattgcttgaaactgggaggtggaggttgcagtgagccgagatctcaccatttcactttagcctgggcgaaagagcaagactctgtctcaaaaaaaaaaaaaaaattatat

SEQ ID NO: 21395 - DNA, 601 bp, Human
agcctttgtggctacagtgtggtgtcttaacttgggcaagtcctttgacctctttgggccacaatttcccatgggagctttgtgaggttgatagcagtatgactccggtatgtgattgcagccttgagccttgccctgagcgctgagccatctcctctactccacaggtggggaatagcagcatagcctggtctcttggctacatgctcagcctgaccaaccagatcccagctgaaagccctctgatccgtctgcccatagaaccacctgtctttgtgggcaccctcgctttcttcacagyggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttctt

SEQ ID NO: 21396 - DNA, 601 bp, Human
tctactccacaggtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtrgcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacgaaggtcaggctctttatattaagttccccagaggaagagtaagttgagaaggtatcagtttaatgttgaagaattgacctcagggctcagtttccat

SEQ ID NO: 21397 - DNA, 601 bp, Human
tcagtccatctccttctataaactttccctgactacgacagtcttaaatgcctccaaattctatagcacctagggtttgggccaagcttagtcaaaacccacagcccatgggccgcatgtagcccaggatggttttgaatgcagcccaacacaaatttgtaaactttcttaaaatattatgagatctttttttgtgatttttttttaagctcatcagccatcattagtgttagtatattttatgtgtgacccaagacaattcttcttcttccaatgtagcccaaggaagccaaaagattgracacccctggtctacaccatctctcctttatcaatccctgcttggtactgtttactgttaagtgtttgtgtatgggtgacaataaggttgtatattctcagagatcaacatccaggtcagagctttatacatctgactgtaaacaatttgagggcaagggccttctcttgttccttactgtacccatgaagttatcagacaggctgttatacagttggtattcattaaatgtttcttaaatgaatgaacatttgacagatccatgacataaaaatgcagacaagtgggcctaaaacttag

SEQ ID NO: 21398 - DNA, 601 bp, Human
tcttctgatttttcaaggtaagctgaaagcacagatttctttgtaaaatctgctgatttttaaatgatgacaactaattccatttaaaaacccccaaaaacctaccattcaggccaaacgaaacacattctatgagccaagtccagccctcaagtcacaagctggggcctctagtctgcaggataaaagacaaactccctgtctgacattctaagtcattcacaatgagttcccagcctacctttttagagtgttttgcctacttgttccatacaataaccctctgctctagtctagtggktctgaaactttagcacgcatcagaaccacctggagggcatagactgctgggcctcattgccagtatttctgaatcagtaggtctcaggtggggcctgtgaaactgtagttctaataagttaccaggtgaagctgatgttaccggtctgtggaccacactttaggaaccaatgctagagttaaactactccctattttaagcatactctgaattgtgctcacattgttctaacttcccagaggaacttccctctcctttcagtccatctccttctataaactttccctgactacgacagtc

SEQ ID NO: 21399 - DNA, 601 bp, Human
tatttgtttctgggaggagatgctaaagtgtggatttacagactctactaagggtcccagttgcacttacctggcattttctgcacaaaggtgtaaacatgaattcgagttccagtgctccctgcatcaaacataattccatacaaggtgctggcgctgacattgatggggcacatggaagacaggaagataccctcaaaccaagtctgctggttcctgtgggagacagcgctgcaaacacaggataccaccagcatgaaaaagactgtgccccaagaagtggccattcttttcccaagawgtggctgggtggaggcttttgttgcagaagcaatcctgctcgcacacctgcagaggcttataggacaaagacacacaagttagaccaactagcttttttagttacacctgtaaaagaagaaacactcactcctgggcccaaggtgttccttccctattctaataacctgtacaacaagctaaaccagggtgatgtgggctcttagcaccttttccgaagggtatctagttccaaaaggaaattggaattgaagatatattttcccatgctttggtttttaaaaatacagagtaattgtac

SEQ ID NO: 21400 - DNA, 601 bp, Human
ttcctagcctcatgtccaaggatggcagtgaaattctcatgtgatccttctcccaaaaccactccccatattctgaatattatggatccctggagtatcccatgtttaaagaggaagaacaaattataactattctttttgaacacatgggtttcagactacagacagcccagctctcttctaatttcacattgaattaaaccatgtgttctggccaagcatggtgacttacacctataatcccagtactttgggaggctgaggtgggaggatcaattgagcctaggagtttgaggccagyctgagcaggtctctataaaaaaatttaaaaatgagctgggcatggtggcacaagcctgtagtctcaacaactcagggggctgaggtggaaggactgcttgagcccaggaggtcaaggttgcagtgatgtgtcatcatgccactgcactacagaccgggcaacaaagcaagaccttgtctcaaaaaaaaagttaaaaaataaaaacaaaacaaataaataaaaataaataaataaaccacatgttcaattgtagtccaaagttctctgaagaaagacatccactaggtgtgagattctgta

SEQ ID NO: 21401 - DNA, 601 bp, Human
tgatctcaatctcattagtgaatagcatgaaatatttaacagcagtggtgtggtcaagttatcaaggcattgagaatctaaacatcaaatcataagaaactcacctgcttaggttgatctacaaaagcagaaagtcctggcttcacagaatcaaaaacttccccttctagaattggaagctgtcctattttgtccatggaacaaaacagaagagagagctggttaccaaaagttaggctgcttcagatgctgggctctgtctctgtaagttttcctatgacttccctgaagttatcccaaatgatcctagttgtgaggaatgtcttgcaggagtactggaaagaaggactagagcaacctctgagggtccatttctgctaccatttctctggtggacacctaactcctccacctttccccaggctccataagtgacctgaggaaaaaacactgacaattcagaaaaagttaatcttcagggattcctagcctcatgtccaaggatggcagtgaaattctcatgtgatccttctcccaaaaccactccccatattctgaatattatggatccctggagtatcccatgtttaaagaggaagaa

SEQ ID NO: 21402 - DNA, 601 bp, Human
cacacatgatctcaatctcattagtgaatagcatgaaatatttaacagcagtggtgtggtcaagttatcaaggcattgagaatctaaacatcaaatcataagaaactcacctgcttaggttgatctacaaaagcagaaagtcctggcttcacagaatcaaaaacttccccttctagaattggaagctgtcctattttgtccatggaacaaaacagaagagagagctggttaccaaaagttaggctgcttcagatgctgggctctgtctctgtaagttttcctatgacttccctgaagttaycccaaatgatcctagttgtgaggaatgtcttgcaggagtactggaaagaaggactagagcaacctctgagggtccatttctgctaccatttctctggtggacacctaactcctccacctttccccaggctccataagtgacctgaggaaaaaacactgacaattcagaaaaagttaatcttcagggattcctagcctcatgtccaaggatggcagtgaaattctcatgtgatccttctcccaaaaccactccccatattctgaatattatggatccctggagtatcccatgtttaaagag

SEQ ID NO: 21403 - DNA, 601 bp, Human
tggttttgatttgcatttctctgatggccagtgatgatgagcattttttcatgtgtccgttggctgcataaatgtcttcttttgagaagtgtctgttcatatcctttgcccactttttgatggggttgtttgattttttcttgtaaatttgttaagttctttgcagattctggatattagccctttgtcaggtgggtagattgtaaaaattttctcccgttctgtaggttgcctgtttactctgatggtagtttcttttgaacagctccaaatttttctagtagatttgctatccatgtgytactgaactaagaaaatatatcctctcggggccaggtgcagtggctcacacctgtaatcccagcactttgagaggctgacatgggcggatcacaaggtcaggagttcaagaccagcctggccatcatagtgaaaccccgtctctactaaaaatacaaaaattagccgggcatggtggcacatgcctgtagtcccagctactcgggaggctgaggcagaagaattgcttgaacccgcgaggcagaggttgtagtaagccgagatcaggccactgcactccagcctgggtaacagagtgata

SEQ ID NO: 21404 - DNA, 601 bp, Human
gttagcaactacaacacgatcaccttttctaaatgccaagtcagtttctaataatatagttgctttcaacagctcctaatttttcttttttaattatttatttttaattaattaatttatttatttactattcaaatatacccctgaccctggtatttttttttaatactttaagttctagggtacatgtgcacaatgtgcaggtttgtttgttacatatgcatacatgtgccacgttggtgggctgcacccattaactcatcatttacattaggtatatctcctaatgctttccctcccygctcccgccaccccacgacaggccccggtgtgtgatgttccccaccctgtgtcctcattgttcaattcccacctatgagtgagaacatgcggtgtttggttttctgttcttgcgacagtttgctcagaatgatggtttccagcttcatacatgtccttacaaaggacatgaactcatcctttttttatggctacatagtattccatggtgtatatgtgccacattttcttaatctagtctatcattgatggacatttgggttcgttccaagtctttgatattgtgaatgatgcctcaata

SEQ ID NO: 21405 - DNA, 601 bp, Human
ttgtgatcttggctcactgcaacctccacctcccaggttcaagcgatgcttgtgcctcagtcacccaagtagctgggattacaggcatatgccaccacacccagataatttttgtatttttagtagagacagggtgtcaccatcttggccaggctggtctcgaatacctgacctcaagtgatccacccacctcacccctcccaaagtgctgggattacaagcatgagccaccgtgcctggccaaattattcttttatattgtgatcattttagttgattatctttttcttttttttaagayggaattttgctcttgttacccaggctggagtgcaacggcacaatctcggctcactgcaacctctgcctcccgggttcaagcgattctcctgcctcagcctcctgagtagctgggattacaggcatgcgccacagcacctggctgattatttcatgtttcttatatataaatcagctttaggatggtagagtgaagaaaacaggagttagagtcagaagacttgcttgctagccctgtggcctaacttaggtcacttggccttgttgggacttggtttcctcaagtgtgggatggtagata

SEQ ID NO: 21406 - DNA, 601 bp, Human
gatccaagatgcagttttaaaacttacctcaaagagcagagccttggctttgtgttctggcagtaagcgtagtcctgctgttgcctttaggaccactggggtctttttccagtgacttcgggggattgagtctttggccacctctaagagcccttgaacggtctcagcacccttcaaaagagataacccgttcatctgatgaacgatccatttagtggctggcactggtctattctgtcaacatactttgtgggagcaagaagagggaggtggcatagggctccaacctctctctgctctrtagcaggagaaacctagagaagtgggccgctttgaaggagaatccaggccaggcgcagtggtgtctcacacctgtaatcccagaactttgggaggccaaggtgggtggatcatttgaggtcaggagtttgagatcagcctgaccaacatggtgaaaccccatctccactaaaaaatacaaaaataagccaggcatggtggcacacacctgtagtctcagctactcgggaggctgaggcaagagcattgcttgaacctgggaggcagaggttgcagtgagtcaagcctatgccactgcact

SEQ ID NO: 21407 - DNA, 601 bp, Human
aaaacaaaacgccaaaaaacaaaaaaccttccagtggcttccttcttatagaaaaagccaaagtgcgggcggatcacctgaagtcaggagtttgagaccagcctgaccaacatggtgaaaacccatctatactaaaaatagaatattagccgggcatgatggcgcatgcctgtaatcctagctacttgggtggctgaggcagaagaatcacttgaacccaggaggtggaggttgcagtgaacagagatagcgccattgcactccgtcctgggcaacaagagcaaaattcagtctcaaaaaraaaaaagaaaaagaaaaagccaaagtgattacactggcatttgagatcctacatgataaacaccccttaaccctgcctctctgaggttaccgcctccttacctctcatatcgctctttcctctccagctatgctgacctcctggatgctgttcctaacataccaagcacatacctgcctctggcctttgcacctgctgtttctttagcctggaatattcttcccacaaatgtcttgtgtaacttgcttcttcatccccctaagatctctgatcaactgaattttatcaaagacttcttcc

SEQ ID NO: 21408 - DNA, 601 bp, Human
tgaggtcaggagttcgagaccggcctggccaacatgatgaaaccccatctctactaaaaatacaaaaaaattagcatggtggtgggcacctgtaatcccagctacctgggaggctgaggtaggagaatcgcttgaacccaggaggtggaggttgcagtgagccgagatcgcgccattgcactctagcctgggtaacaagagtgagactctgtctcaaacaaaacaaaacaaaacaaaacgccaaaaaacaaaaaaccttccagtggcttccttcttatagaaaaagccaaagtgcgggcgsatcacctgaagtcaggagtttgagaccagcctgaccaacatggtgaaaacccatctatactaaaaatagaatattagccgggcatgatggcgcatgcctgtaatcctagctacttgggtggctgaggcagaagaatcacttgaacccaggaggtggaggttgcagtgaacagagatagcgccattgcactccgtcctgggcaacaagagcaaaattcagtctcaaaaagaaaaaagaaaaagaaaaagccaaagtgattacactggcatttgagatcctacatgataaacaccccttaac

SEQ ID NO: 21409 - DNA, 601 bp, Human
cgggcatggtggctcatacctctcatcccagcacttttggaggccgaggcaggtggatcacctgaggtcaggagttcgagaccggcctggccaacatgatgaaaccccatctctactaaaaatacaaaaaaattagcatggtggtgggcacctgtaatcccagctacctgggaggctgaggtaggagaatcgcttgaacccaggaggtggaggttgcagtgagccgagatcgcgccattgcactctagcctgggtaacaagagtgagactctgtctcaaacaaaacaaaacaaaacaaaaagccaaaaaacaaaaaaccttccagtggcttccttcttatagaaaaagccaaagtgcgggcggatcacctgaagtcaggagtttgagaccagcctgaccaacatggtgaaaacccatctatactaaaaatagaatattagccgggcatgatggcgcatgcctgtaatcctagctacttgggtggctgaggcagaagaatcacttgaacccaggaggtggaggttgcagtgaacagagatagcgccattgcactccgtcctgggcaacaagagcaaaattcagtctcaaaaagaaaaaagaa

SEQ ID NO: 21410 - DNA, 601 bp, Human
gtataggtgaactggacctatggaaaggcatatatttaaccctgccagctcaaatcaggatcctgtaactttttaaacctgataaactctacctggacatacactggaaactaggaggagccttcccactccattccttagatgagctgacatgaacctgctgtggtgaagttcacacctaagggctgaggtactctgctaccagctcctgtcagattctggcacatggctagggtctctagagcatggggagactccagatctagacttaaggaatcctgtttcaggagatgggaatgamgatcttgcaaaaacatcttgcctctccataatacagaccattgatatgggtgttaatgtcttatgtttatataattatcaagggaaagaaaaaagaattctccaaataggataggaagaacgctagtctgtttgctgttctcatttctgatggatgaaacataccacataatgacctctggatcctgtttcaaccaggaaaaaccagttaagttatatataaacaaacttttaaagacagataagtgaacaggatgaagcacagcaagagagcttctgctcttgccttctccacttttct

SEQ ID NO: 21411 - DNA, 601 bp, Human
ggtggaggctccccctaggtccaaggtccccacagtctcctgtctgtggccatgcagctgacctgtcaaatgagagccagctctaaatagcctcgacatcctgggcagcccaacacttgtctctcttgctcttatcatacactgaaggtattccatacatactccactgctccccagccccaaggctgcaggtgaatgtcaactcggaaggactcttgttgcagcagaggccttcaaggcaggtgttttttttttttttggaaggcctttttggagacagagtcttgctctatcatccagsctggagtgcagtggcgcaatctcggctctcagctcactgcaacctctgcctcctgggttcaagtgattctccagcctcctgagtagctgggactacaggtacacaccaccatgcccagctatttttgtatttttggtagagacggagtttcgccatgttggccaggctggtcttgaactcctggcctcaagtgatctgcccaactcagcctcccaaagcgctggaattaacaggcatgaactgccacacccagcctcttttccttttttaaagaagaagaaacaatacagaatgaaagaa

SEQ ID NO: 21412 - DNA, 601 bp, Human
caataacagatttgagaatgctttggaaagttaggagaatcatacaacatgaaatattcttcttccctgtccccgtcctcacctatgtgtatagagcttataagtgctgttaaacatctcaaaggaagtgaggtagcccctaggagtttgttccagagttttctgcaaatcagaaaaagcaaaaagactattcaggatctgtaattacctgaagatgttcacaccaccacccgtccctcccagcaaaaaatcagagatgaagacagattaaggggctaatctcactaggcttgaggaaacraagggattctgaacagtgagatggcaagggaacattcacctagttattaattgacttgactctgcctaagcgtggtagagctgctggctgaaaatggggcgcctctttcttggcaccatgatacgcctgccaagtgcacttctaaccagatcttcattaaatgactcacctcaaactggggcaggaacgtgatttgggtggaggctccccctaggtccaaggtccccacagtctcctgtctgtggccatgcagctgacctgtcaaatgagagccagctctaaatagcctcgacatcctgg

SEQ ID NO: 21413 - DNA, 601 bp, Human
agggttcaaatgattctcctgcctcagcctcctgaatagctaggattacaggtgtgcgctgtcatatccagctaatttttgtattttagtagagacggggtttcaccatgtttgccaggctggtctcaaacgcctgacctcaggtgacccacccacctcggcctcccaaagtgcagggattacaggcatgaagccactgcacccagccgaaaacttttgactcttaagtcatatattaatgcttttgaggccaagaatggagaagcctcttaggctcctccggctttgtaagtggaccggstttcagttgataggccttagggaattggcacagactttgtttttgctaatcagatacaataacagatttgagaatgctttggaaagttaggagaatcatacaacatgaaatattcttcttccctgtccccgtcctcacctatgtgtatagagcttataagtgctgttaaacatctcaaaggaagtgaggtagcccctaggagtttgttccagagttttctgcaaatcagaaaaagcaaaaagactattcaggatctgtaattacctgaagatgttcacaccaccacccgtccctcccagc

SEQ ID NO: 21414 - DNA, 601 bp, Human
cccagaaaagctctctttagcttagctcctagccccaactgggatcacattccaggctggattctgaacctctgaaggccagctcaaaggagctggcaaggagctttgcctgagccttcttgaagtgtcctctccctacagaaagcttttgattctttttttttttttttttttgagactgagtcttgctctgtcgctccggctgaagtgcagtggtgtgatctcggctcactgcaatctccgcctccagggttcaaatgattctcctgcctcagcctcctgaatagctaggattacaggwgtgcgctgtcatatccagctaatttttgtattttagtagagacggggtttcaccatgtttgccaggctggtctcaaacgcctgacctcaggtgacccacccacctcggcctcccaaagtgcagggattacaggcatgaagccactgcacccagccgaaaacttttgactcttaagtcatatattaatgcttttgaggccaagaatggagaagcctcttaggctcctccggctttgtaagtggaccgggtttcagttgataggccttagggaattggcacagactttgtttttgctaatca

SEQ ID NO: 21415 - DNA, 601 bp, Human
tgcacagtttggatcaaggctatgcagtaagaattccccacagttatcattcaaaggccagagacagtgacaattcctagggtcccacactaggaaccattcccagaaaagctctctttagcttagctcctagccccaactgggatcacattccaggctggattctgaacctctgaaggccagctcaaaggagctggcaaggagctttgcctgagccttcttgaagtgtcctctccctacagaaagcttttgattctttttttttttttttttttgagactgagtcttgctctgtcgctcyggctgaagtgcagtggtgtgatctcggctcactgcaatctccgcctccagggttcaaatgattctcctgcctcagcctcctgaatagctaggattacaggtgtgcgctgtcatatccagctaatttttgtattttagtagagacggggtttcaccatgtttgccaggctggtctcaaacgcctgacctcaggtgacccacccacctcggcctcccaaagtgcagggattacaggcatgaagccactgcacccagccgaaaacttttgactcttaagtcatatattaatgcttttgaggcc

SEQ ID NO: 21416 - DNA, 601 bp, Human
gaaccccctgaaaccagaagcaaattttcatgcatatgtgcttttgtcagaggggtccatggctttcatcacatctcaaagagatccaaaaccttcaatacagcaactttccacctttataaaaacaggaaagaaatgctatgctaccttcctcactggttgctgagaggcttcaattaaatatacttgaagatgttttgtatactctgaaatgcaaaatagatgtcatcccaataacagattactgtacaaagtgccttaaatgcaaattctcatttaatgtgaggaaaggggcacagayaggttacttgcctcatatcacaacactgggactgaacccagttctgcctgacctgtgaagagatcaatggagttactctgttgttccacctgcatgtagaacagactctgcttcctgtgcctccaatgtaaagctcagggcttgagcaagctcctgctgaatgtattcgtaaagcctgggatttctgcagacacttcagctgcctagacataggctgttacccctgaacaagtagacctcattctaaaaatggctaataatatacatcaaaacttctgaacttataaactagaaaaggag

SEQ ID NO: 21417 - DNA, 601 bp, Human
ctaaccattaactaaacaggctttcacactgctgcattagacctaggcttagaatatgcttcttaattaatttgtaagaggtagggtctccctgttgcccaggctggagtgcagtggcattgcgcactatagccttgaactcatgggctcaagtgatcctcttgcctcaacctttggagtagctaggacaatagatgtgcaccacagcacttggctaagggcaggtatctaatgggtccatgacacttggctgatgcagaatgacagctgctttgttcactgtcacttcacattagtcctyggaggcatgccaagatctttggaataagtccctgcaacaagataagcttctcttgagttctggaaaaagtttcccatgggacttttccagagcttccattgtaaacgtaactttaaccagtgaaaaaacatcacttgccttcttggttgccaccatactggtatttcacacccccaaagatccactctgcttccaaccatctcggtaaacaggcactccggaaagtgtgcccatcagtccctgaaagaatccagggcacaaggtaagaggtaagtaagtgagagagagggaggaaggcaa

SEQ ID NO: 21418 - DNA, 601 bp, Human
gacaagaggcgtcaaaacaaagatgagcaaacgtctgcagcctcaccagtctgtttctccatggccgctctcctgcctaatctgtattcaccagatcatggccaaccttgtgctgctgcctagcattacattccatagcatttgtaagcaagtagctaaagggctcgcctgcttccttcactgggaattcaggttcattccttgatattcaggtatataccttttataagaagatgaatcattcttgtcttggttttaagttttactataatttaaatagctaaccattaactaaacaggstttcacactgctgcattagacctaggcttagaatatgcttcttaattaatttgtaagaggtagggtctccctgttgcccaggctggagtgcagtggcattgcgcactatagccttgaactcatgggctcaagtgatcctcttgcctcaacctttggagtagctaggacaatagatgtgcaccacagcacttggctaagggcaggtatctaatgggtccatgacacttggctgatgcagaatgacagctgctttgttcactgtcacttcacattagtccttggaggcatgccaagatcttt

SEQ ID NO: 21419 - DNA, 601 bp, Human
ttaggcaaaaacactgcttttgtgataagaagaaaagttataaagagacaggaggaaactttttgtggtgaatatgtttattatcttcaatgtgctgatggattcatgggtgtatacatgacaaaacttaaattgtatactttaaatgtgcacttattgtatgccaattatacctcaataaacatgttaaaaaaaaaaagacctcatatagttgttttggtcatctctcacctccaaaagactctaagtcatttccacccttttgttcgagtgactagaaaagaggtgggtaatcaccccracaaagcacctcaagtgctctttctccttgaccttccccaccacagccctatccaccttcctctctggactgacacctggggtgaactcaccaatcatgtctgtgtcaacagctcggtcataatagtaagagaaagcatagaaggaacctctctggacctcctctggctggtgaagttttcctcgtaccaccctcagcacttcggcatagcagggctcaaagcccacctcccctgccaggcaaaggtgcacaggggtaaggtgagaacgacgctgggggaaggggacactctctgaggca

SEQ ID NO: 21420 - DNA, 601 bp, Human
aacaaaaaaccaaaacaacaacaacaacaaaacccccacaataataggaaattaattcatctctctcaggccatgacagatcaggtacatatactttcacagttaggcaaaaacactgcttttgtgataagaagaaaagttataaagagacaggaggaaactttttgtggtgaatatgtttattatcttcaatgtgctgatggattcatgggtgtatacatgacaaaacttaaattgtatactttaaatgtgcacttattgtatgccaattatacctcaataaacatgttaaaaaaaaaaagacctcatatagttgttttggtcatctctcacctccaaaagactctaagtcatttccacccttttgttcgagtgactagaaaagaggtgggtaatcaccccgacaaagcacctcaagtgctctttctccttgaccttccccaccacagccctatccaccttcctctctggactgacacctggggtgaactcaccaatcatgtctgtgtcaacagctcggtcataatagtaagagaaagcatagaaggaacctctctggacctcctctggctggtgaagttttcctcgtaccaccctcagc

SEQ ID NO: 21421 - DNA, 601 bp, Human
atttttttttttagagacaaggtctcatgctgtcacccagggtggagtgcagtggcatgatcacagctccctgcagcctcaagctcctgggttcacacgatcctcctgcctcagcctcccaagtagctgagactacaggtcgaaccactgtgcctagctctcttggtagttttgatcctctcaaggaagcctctgtggctatttaccatgtcttttgatgcttagtgtttcattaacactgataacactatttcaatttaaaaaagaaagcaagaaatgtagaaggaaaaaaaaggtcttyaccatttccctaaagccctaaagcctctttgtttttttttttttgaggtggagtctcactctgttgctcaggctggagtgcagtggcacaaccttggctcactacaacctctgcctcccaggttcaagcgattctcctacctcagcctcccgagtagctgggattacaggcgcctgccaccttccttggctaatttttgtatttttagtagagatggggtttcaccatgttggccaggctgtcttgaactcctgacctcaggtgatccgcccaccttggcctcccaaaatgctgggatta

SEQ ID NO: 21422 - DNA, 601 bp, Human
caatggtatgatctctcctcattggaacctctgcctcccaggttcaagtgattctcctgcctcagcctcccaagtagctgggattacaggcacctgccaccacgcccggctaatttttgtatttttagtagagacggggtttcaccatgttggctaggctggtctcgaactcctgacctcaggtgatccgcccgcctcagcctcccaaagtgttaggattacaggcgtgagccatcaggcccggctgtattactgatattctacataagtttttgttggataaagatgctaccaccaccaraaaagtctataaaccagttgattgttctgtgttgacctgatgtaatagagcctagacactgtgcccaaaactggggataaataacttactacagataaagtagagcctgcaggtactgaaacagatggagagagacaggaggacaaagaaagacctaagattcaagaggcattaaatatacgaggcacacatgaaatatatatgacacattacatatgcatgaggcattcagtgttcatgaggccttaaataagccactcactggtgacaccctcttggtctctcatgtcctctgccaaa

SEQ ID NO: 21423 - DNA, 601 bp, Human
cccaatctctgcttcaaccagaatagttccacttttaccagttttatattactgatactctttttttttttttttgagacggagtttcgctctttgttgccaaggctggagtgcaatggtatgatctctcctcattggaacctctgcctcccaggttcaagtgattctcctgcctcagcctcccaagtagctgggattacaggcacctgccaccacgcccggctaatttttgtatttttagtagagacggggtttcaccatgttggctaggctggtctcgaactcctgacctcaggtgatycgcccgcctcagcctcccaaagtgttaggattacaggcgtgagccatcaggcccggctgtattactgatattctacataagtttttgttggataaagatgctaccaccaccaaaaaagtctataaaccagttgattgttctgtgttgacctgatgtaatagagcctagacactgtgcccaaaactggggataaataacttactacagataaagtagagcctgcaggtactgaaacagatggagagagacaggaggacaaagaaagacctaagattcaagaggcattaaatatacgaggca

SEQ ID NO: 21424 - DNA, 601 bp, Human
aacatggcaaaaccccgtctctacaaaaaaattagacaagagtggtggcacacacctgtaatcccagctactcagagggctgaggtgggagggtcacttgaacccgggaggcagaggttgcagtgaactgagatcatgccactgcactccagcatgggtgacagagcaagaccctgtctcaaaaaaaaaaaaaaaaaagaaaaaaaaagaaacgaacaaaaaaggccaggagtggtggctcatgcctataattctagcactttgggaggctgaggcgggtggatcacctgagatcagaagwttgagaatagcctggccaacatggtgaaaccccgtgtctactaaaaatacaaaattagccaggcatggtggcgcatgcctgtaatcccagctacttcggaggctgaggcaggagaatcagttgaacccgggaggtggaggttgcagtgagctgagattgcaccattgcactccagcctgggcaacaagagcgaaacttggtctcaaaagaaaaagaaaagaaaaaaataatcaaacagggaacttaagacattctaagccagtacatatctcaattagcttagtgaccttgggcaaaact

SEQ ID NO: 21425 - DNA, 601 bp, Human
cagaaactaagtgctctctcctccccttaaaaaggtgttggcaaatgcaggtctccaaggaagtacgtggcctcaatgggagatgcccagagactgcaacaggtgaaaggtggcccccaaggcccagcccgtctctatgttgttcactttctttgtgagctgttgagaagaaaaaaagtcttcaccttttcatccagtttccaactctagcaagcacagctcttgggcagaaaatattggcaaagaatatccacatgggcaaaccaaggcaaaacggacagaagccagtctttgcaggctycccactactctgtaacaatttccttccggccatggcccattggccattgcccctacacccaccattctcatatctgaactgaatgcttctggcccaggttgtggcccatcaggccttctagagagatagtttagacagacagtattctgaactttccctaacgttgaaactacacaaagtatcccctgctttattttctgattcactaatttcagataaggcaacttgtaatgataatagatgtggcagaaagagcatggtcaggaggtgagaatagatctaggggtaggaaagaacaaa

SEQ ID NO: 21426 - DNA, 601 bp, Human
tgatattgatgggtcttgggattgcaataagtcagtttaccatttaagaggaaaatttaaatattcagtggaatgaggcactcaaagggttgaaatgcgatttttctttggtttccagggacctgtccctgggctctcactccaaggttaagttccaaaactatactttttggctcacagggctctctgtgatgctctggtgccagctgtgtactcttgagtggttaggcagcagttcacattagatgtgtaaaattaattaaacctaaatctctaggctcaagtccaggatgtccccagwctagttcagaaactaagtgctctctcctccccttaaaaaggtgttggcaaatgcaggtctccaaggaagtacgtggcctcaatgggagatgcccagagactgcaacaggtgaaaggtggcccccaaggcccagcccgtctctatgttgttcactttctttgtgagctgttgagaagaaaaaaagtcttcaccttttcatccagtttccaactctagcaagcacagctcttgggcagaaaatattggcaaagaatatccacatgggcaaaccaaggcaaaacggacagaagccagtctttg

SEQ ID NO: 21427 - DNA, 601 bp, Human
catttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccrgctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccccccccagcaggagagcagcaaaatttatgcaaatctttgacggggttttccttgtcctgccaggattaaaagccatgagtttcttgtcacat

SEQ ID NO: 21428 - DNA, 601 bp, Human
ctggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactragccaagatcgcgccactgcactccagcctgggcgacagagccagactgtctcaaataaataaatatgagataatgcagtcgggagaagggagggagagaattttattaaatgtgacgaactgcccccccccccccccagcaggagagcagcaaaatttatgcaaatctttgacggggttttccttgtcctgccaggattaaaagccatgagtttcttgtcacatgcctttctatgccttccatggctgggtctcagggagccggaagcagctgctgaggagggatgaaaatgtcagtgt

SEQ ID NO: 21429 - DNA, 601 bp, Human
ggctgggtgggagagtgtgggccctgccctccgaggccgggcatgggcgagaagcctgggggtcctggctgaactgggctgggtgaagggggccccctgacccccttggggtccgggctgggctgggtgaggggcggtttccgacccccagccaggttcccaggcaggatgagctggggttggggtggctaggccgtgggccttgggagctgggcagtctgggctgggctgggctgggcagggcgccacatggaagctggaggagcaacgggagcgctgggcgtggggtgcaaattgcccrgtgccttctgtttcccaggcagctctgtggccatggatatgttccagaaggtagagaagatcggagagggcacctatggggtggtgtacaaggccaagaacagggagacagggcagctggtggccctgaagaagatcagactggatttgtgagtgctgggacggcccctgagttacccaccctgggccatcacaacctgggcgctccctgatccgttccctctttcctggagtccacgtttaactcctctgggtgctgcccagcagcccttacctgtcctctccccagttcactgccttc

SEQ ID NO: 21430 - DNA, 601 bp, Human
ctttcgtatgctggggacacccagcgaagacacatggcccggggtcacccagctgcctgactataagggcagcttccctaagtggaccaggaagggactggaagagattgtgcccaatctggagccagagggcagggacctgctcatggtaggtgcatgtgggctccagctgctgctccgactacagtttcccctcatcagccagcctcttacataaccctggcactttctgagtccaaggccagggtctctttcctgacctttgtacacaactggcttgggtatactgattgttcaaccyggaagcctcccccaggataagtgcagtatttatcttccctgtgaaagtggcgctcattgagttagctctgtctttatgctgtgctacacgccctttttccctagttgtcttgtgtgtttggttattctactttgtggacattactgctccatctaagctgtatgcctccccaggctggggccataccttcttttcttttcttttttttgagatggagttttgctcttgttgcccgggctggagtgcaatggcgtgatctcagctcactgcaacttctgcctcctgggttcaagtcattct

SEQ ID NO: 21431 - DNA, 601 bp, Human
tccaatgcaggggatgaatacgctacaggcactgtgtgggggaagggtaggagctggggaataaggatgaaatgggacttggtgccagcacagcaggcttcctggaagcagtggctttgtgggaggggaaggcccaagatagcctgtgtcacagatggccctggctttcaggctggcacctttagtgacctgcagtgaggtccttcatccatgagggactctggcccacctttctctgcctcctggtgagagtgcctctaacttgtaacccacccggaatggcagtcctgtgctccctcgscatgtcccccaagctggggcacaatatcacaatggaccaggaaatccttcctcgcctctaattctgtttctcctgctgcaaacaatgtgggcatcactcatccaagcagctactgggcaactgtactagcggctcccaggggctgttagtcaaagccttcactgaaccaggaccttttaaagtttcttattttgagaattttcacatataccaaagagtatagcaaaataaacatccatatactcctcactccagtttagcaaacgtgactatttcgaagtcattggaagcacagaagaa

SEQ ID NO: 21432 - DNA, 601 bp, Human
gcccttcctcctgggtggggttgccctgccctgggaccagcccagctggtccctcctctcctggccagccctggcccaacctgttcttgagtgtgttgagcatgccgtagagcgtcacatcattccactcccaggtgtcgatgtgatcgttgcttatattggcaaagctgtagatgatgtgggtacagaggaagcggtcaagggcatctgggaagcagctcccatcgccttcccggtactgggaccagctggtgtagtagcagaccagtttgtatgcagagcctgaaggagaagtctgggrtggggcccgggccaggattcggcaagagacctcaggctgagcccagagctgagcaccaatggggtgtggggttgggtagggaggagtggggtgcagattgtgagcaaagtcagaattcttaaatgaaaggagctggttcaggtccccctgcctctggggagttccctgactggtgaaaataaggcctattctgaaaatgcttagaaaagatccaatgcaggggatgaatacgctacaggcactgtgtgggggaagggtaggagctggggaataaggatgaaatgggacttggtgccagca

SEQ ID NO: 21433 - DNA, 601 bp, Human
tggaatgacattgtcatgacactgggtggccccatgtctgagaggccatagaaggtttcctgctttgggtgagaggctgggttaggccgctgatgtcctcccataggacatcatgggaatcccatagagattcatagtggtggatctctgaggggtcacaggcttcatgggagttactctgaggtctgctgcccatttttgttttccccagtggagaagacagagtatggcaaagtagagtcttgctcattttccatgctccctggagagcacgttaggggcaggagagggttcccctctyccagaggggctcagctgcgcttccgtctacagtctctcatcaccccaaatattgcccagcacctacagtcatcccctccacccatttaagccaagcccctctaactctccaaacataggtgagcagggtggggcctcgcccttcctcctgggtggggttgccctgccctgggaccagcccagctggtccctcctctcctggccagccctggcccaacctgttcttgagtgtgttgagcatgccgtagagcgtcacatcattccactcccaggtgtcgatgtgatcgttgcttatattggc

SEQ ID NO: 21434 - DNA, 601 bp, Human
tccaaagactcctcccagggtctccccacttctcaatgtccccattggtttccatctctctctttccagccctaatggtggtagccccagaagtcccatattttcgggcctgtgaggtagtaaatagagcattggcagggaattgggagatccactgttaacttgctgtgtgactcttggcaagtcctgctctctctctgggctctgctttctttgctacacatcaggcaggcccttgacaaacaggtaggccttgtacctatctagtctggagcccctggaacatccatacagtggatgsgggagacccaagctcctcactcctatgccatcatcctctgccgtcctgcccctggggagaggctcctacctttgagacccaaagttccatcctccgacagacaagagagtcttcaggttggggttcctgtggagcacagggaggtggggagggcaggagtggaatgacattgtcatgacactgggtggccccatgtctgagaggccatagaaggtttcctgctttgggtgagaggctgggttaggccgctgatgtcctcccataggacatcatgggaatcccatagagattcatagtggt

SEQ ID NO: 21435 - DNA, 601 bp, Human
cagaaagagtacccagcacatgggtgccaacgatggccataaccacccccatttcaagccctgctccaaccccacctaatccaaagactcctcccagggtctccccacttctcaatgtccccattggtttccatctctctctttccagccctaatggtggtagccccagaagtcccatattttcgggcctgtgaggtagtaaatagagcattggcagggaattgggagatccactgttaacttgctgtgtgactcttggcaagtcctgctctctctctgggctctgctttctttgctacayatcaggcaggcccttgacaaacaggtaggccttgtacctatctagtctggagcccctggaacatccatacagtggatgcgggagacccaagctcctcactcctatgccatcatcctctgccgtcctgcccctggggagaggctcctacctttgagacccaaagttccatcctccgacagacaagagagtcttcaggttggggttcctgtggagcacagggaggtggggagggcaggagtggaatgacattgtcatgacactgggtggccccatgtctgagaggccatagaaggtttcctg

SEQ ID NO: 21436 - DNA, 601 bp, Human
caatgcactaagtgggtagttataagtgggtgctctgctcagtcacaaccttccacctcttagaaccccattcccacctcccaccatggtcacaagaagccttccttgctatgtgagatcttcagggcacagggtcccaggacactgccctgaggctgaagtccctctttacctgtcctcaggaggacagcagctgacgccggcttctagcccaccccattccctcatgcctgcccacctccctccctgtccctgacctgaccagcaccttgattagggtggtaaaatgctgtttgtctcyccgtccagggtagagccaggcaaggtccagcccatcaaagccatgggtgcgcagaaatggcggtactgacttgatgaaagtccggcgactctgggtgttggaggctatcttggaaaatctaggaccaaaatcagccctgtagcatgctcagcactgatatgctaggtgccttgggcctctggtggggtttccaggacctgcagagctgggatcctgaggccacacagctctgggagggcatgattgggacaggggtcgcctccaggcatgcatgtgccttagagccaggcattccaggtt

SEQ ID NO: 21437 - DNA, 601 bp, Human
tggcatgagaggtagactcatcgagggcggactaggtctctgcgcaacccatttgctgtactccccaacctgcctggggcctagtggaagtgataaagtggctcatcagtggtcccatcctcaagtcacccatccttttcctaaaaaactgactaatcttctccccaaacccatgcacacccatcagcactcaattactccctgtcctggagggagcatcggacagtgggtgacccctattggcccacagatgactttgggagacatttgcctttcggtctgtgctttgttctagctggtrcatgaaatcccaaagttaaagtgattgctgctggtattgtgaacaatttgtttagactctccttctgcccctggtaactggagatacttaggctgcccccaggcagagctgagagctgctggacacagtgcatgctgggtatgggtggcatcagtatgggattgaagggtgggcaatgggcaatgcactaagtgggtagttataagtgggtgctctgctcagtcacaaccttccacctcttagaaccccattcccacctcccaccatggtcacaagaagccttccttgctatgtgagatc

SEQ ID NO: 21438 - DNA, 601 bp, Human
ctctccagggcccagcactctgctctgcctggtgtggagaaaatactctgcaatagctggagggtttgaatagctttttccacttccctttccaaaatactttcatagcagctctctcaactgctcagccaacagcccaggtgaaaaaggaaaggcaaggattgttatgcctcatttgacagatggggaaactgaggcacagggcagggaagtgacttgctcaaggtcacacatcaaggctttggaagaactgggactggaagcccagtgtcctcagtctacatggagtgctagggctggsggtggcggggaaacaggagtgttggcagaggttctggggaggctgcctggggcaggagactcactgggatatcttggcaatgtcatagctgctgtcaatggtgaccttccccgcagacagtgctgcgctgagcaggagctgctttttccctggctgggcttcctttataaattcggccttcatttcctagatgggagacaggcaggtgagagaaagggtcccaagtggcatgagaggtagactcatcgagggcggactaggtctctgcgcaacccatttgctgtactccccaacctgcct

SEQ ID NO: 21439 - DNA, 601 bp, Human
attagccaggcatggtggcaggcacctgtaatcccagctactcgggaggctgaggcaggagaatcgcttgaacccaggcggcagaggttgtgccactgcactccggcctgggcaacagagtgagattttgtctcaaaaaaaagtaagaaagaaaagcttttgggctcctatttaaggctccagcaggatgtgaacgagggaagcagacagcagccagacaggccactagcccgaaccccagcagtccccagtgacctcggtccccattgctggcacacctccctgtgccactccagggcasgggctcagggtcccacaagggcacttcagtcaagaatgggtcttctgttatgcccagcacacatttgggagctggcctacagcccaccttacccccaccacttctgccaggcttatcttagtgaaagcagattaaaagtagcatcaacagacagcctggcggggaaagagcaggaccaaaggatgacctgaacctaagatgactggggtgggaggaggttttgcacacccgcaccggtgagcccactgggggtggattgcatgaatacgggtatgtggggcaaatggttgacatccacct

SEQ ID NO: 21440 - DNA, 601 bp, Human
atgaggtgaggagttcaagaccagcctggccaagatggtgaaaccccgtctctactctaactacgaaaattagccaggcatggtggcaggcacctgtaatcccagctactcgggaggctgaggcaggagaatcgcttgaacccaggcggcagaggttgtgccactgcactccggcctgggcaacagagtgagattttgtctcaaaaaaaagtaagaaagaaaagcttttgggctcctatttaaggctccagcaggatgtgaacgagggaagcagacagcagccagacaggccactagccckaaccccagcagtccccagtgacctcggtccccattgctggcacacctccctgtgccactccagggcacgggctcagggtcccacaagggcacttcagtcaagaatgggtcttctgttatgcccagcacacatttgggagctggcctacagcccaccttacccccaccacttctgccaggcttatcttagtgaaagcagattaaaagtagcatcaacagacagcctggcggggaaagagcaggaccaaaggatgacctgaacctaagatgactggggtgggaggaggttttgcacacccgc

SEQ ID NO: 21441 - DNA, 601 bp, Human
ggaacggatcatgtcactttaaagtgaattttacagtttcattcttgaaaaaaatcctttgaggcataggaaggggctattactatttgacagatgcagaaatcaggtggttggctctgagggcacaatgactcctacctcctcggctcccagcctctccccattcggccccctgccctcactccatttaccctgcagatcaccttcccagagcaacgcagcatgcccagactttgggcctcagtttccttatctgtggaatgggcctcatgacccccctcttgcaggactgtactgaggrctagagagattggtgtgtgagcactggcagatggcaggtcttgcggccccctcctggccctccctccttctgggaactcacagtgttgctgaatctgtcaggacttgcatcctcctgacctcggaacaggggactgtgatggcctgtggtcccacgccaggctccatgaaaatcgtaggtcatgatgctaatgaaatccaggtgtctgaggaggaaggggatggagggtgaggcaggaaattattaatagaaaagctttaggccgggcgtggtggctcatacctggaatcccagcacttt

SEQ ID NO: 21442 - DNA, 601 bp, Human
ggtgcactggggattcccctgtccctccgggaacggatcatgtcactttaaagtgaattttacagtttcattcttgaaaaaaatcctttgaggcataggaaggggctattactatttgacagatgcagaaatcaggtggttggctctgagggcacaatgactcctacctcctcggctcccagcctctccccattcggccccctgccctcactccatttaccctgcagatcaccttcccagagcaacgcagcatgcccagactttgggcctcagtttccttatctgtggaatgggcctcatracccccctcttgcaggactgtactgagggctagagagattggtgtgtgagcactggcagatggcaggtcttgcggccccctcctggccctccctccttctgggaactcacagtgttgctgaatctgtcaggacttgcatcctcctgacctcggaacaggggactgtgatggcctgtggtcccacgccaggctccatgaaaatcgtaggtcatgatgctaatgaaatccaggtgtctgaggaggaaggggatggagggtgaggcaggaaattattaatagaaaagctttaggccgggcgtg

SEQ ID NO: 21443 - DNA, 601 bp, Human
gcatagtcctgggtggggtagggtgggaacaacgtgagcagttagtgcacaggtgcggaaggttgagcaattaatactgctgccttagcaggggttattggtgtatggtgcactggggattcccctgtccctccgggaacggatcatgtcactttaaagtgaattttacagtttcattcttgaaaaaaatcctttgaggcataggaaggggctattactatttgacagatgcagaaatcaggtggttggctctgagggcacaatgactcctacctcctcggctcccagcctctccccattyggccccctgccctcactccatttaccctgcagatcaccttcccagagcaacgcagcatgcccagactttgggcctcagtttccttatctgtggaatgggcctcatgacccccctcttgcaggactgtactgagggctagagagattggtgtgtgagcactggcagatggcaggtcttgcggccccctcctggccctccctccttctgggaactcacagtgttgctgaatctgtcaggacttgcatcctcctgacctcggaacaggggactgtgatggcctgtggtcccacgccaggctcc

SEQ ID NO: 21444 - DNA, 601 bp, Human
tcgtcgtatcctacccactggttgcccttggtggcataggggacctgctggccgaggattctatggactgtggctccgcggaggaagtcacagatctgagcagataacagggaaaaggcagtgtggggagtcgtgccgagaccttgcaggtcaccaggagacgccactctccaaatctcttttagctcctgctccatcctgcagcctcactctctgcagggtctgcaggctgcatgcatcacacaagtttatacaaaccagaggcaaatgacccagagatggtggctgccttggccctgcktagcttcttccatttaaacagagatgtgaggcctgctggttgacactgaggacaggcccaaggccacacagagtagcagaggctagagtgaaacaaaaaatctgcctcttgacctctgctctttcctgggctggaaggaagacctcagccccatagccagagggctatcccaggtgcctagtggtgcaggcccatgtgcctgtacctgctggagattttcagcaacaaatgtcctaacctctcccttccacttcctcaggcatgctggggcaaccggacattttctttattcccaaagga

SEQ ID NO: 21445 - DNA, 601 bp, Human
tctttgtcctgaggtgtggccttggggaaacctaccttgcttttgacgctttcctggtcgtcgtatcctacccactggttgcccttggtggcataggggacctgctggccgaggattctatggactgtggctccgcggaggaagtcacagatctgagcagataacagggaaaaggcagtgtggggagtcgtgccgagaccttgcaggtcaccaggagacgccactctccaaatctcttttagctcctgctccatcctgcagcctcactctctgcagggtctgcaggctgcatgcatcacayaagtttatacaaaccagaggcaaatgacccagagatggtggctgccttggccctgcttagcttcttccatttaaacagagatgtgaggcctgctggttgacactgaggacaggcccaaggccacacagagtagcagaggctagagtgaaacaaaaaatctgcctcttgacctctgctctttcctgggctggaaggaagacctcagccccatagccagagggctatcccaggtgcctagtggtgcaggcccatgtgcctgtacctgctggagattttcagcaacaaatgtcctaacctctc

SEQ ID NO: 21446 - DNA, 601 bp, Human
actgttaagctcttgtactttattgagcagctgtggaattaggaaggggaagtaggataggggacacgattacgttcctaagtgaaggtttcaagctgggctttgcagggggtataattagtatggtcactgtgtcttgtaggatgtttggctccttggtgatagagcttgccaaaatggtgtcctttgataaggagggctggggggcagggagttgaagaaattcccttgccaggcttggggatctgtaaacatttccattaatcaacaagtgtgtactaatcccgagtcttacattgcratgcctcactatccccacagccccatccctacctctctgcccaccagggctgagctcaaatctgtgtgttgtggacctctgcataggccccaagggagggagactgaggctcagcctgggactcagcagggcaggtgatcaggctcccggccagctggagccagagggggacggggcatccttggcccccgtgctgtgtgcagaacagagggctacgttgcagcgagtgcatccttgatggcattggtgagagggaagcgcagatcctggccgcagaaggagccctggaagtcatccagg

SEQ ID NO: 21447 - DNA, 601 bp, Human
caagaccaccaaattcaagtgttactccttttggaagcagttatgtcctctctttagcagtttttgattatttagataatagtacctttcatactctattgaaatagttaatattacgtgagctccttaaagtcaggcagtgtattgttacctctttatttccagggcttagccagtgtctcaataggagatacttaataaatatttgaatgaaggaagaaggtatgggtacaatatatggaagatataatatatgttattaataagcctgctaatatttaaagcagttaaaaaaaatttyttttttttggaacggagttttgctcttattgcccaggcgagagtgcagtgaaacaatctcggctcactgcaacctccgcctcccgggttcgagtgattctcctacctcagcctgttgagtagctgggattataggcatgtgccaccttgcctggctaattttttgtatttgtagtagatacggggtttcactgtgttagccaggatggtcccaatctcctggcctcaggtgatcctcccgcctcggcttcccaaagtgctgggattacaggcgtaagccaccgcgcccggccctagttta

SEQ ID NO: 21448 - DNA, 601 bp, Human
aatacctgatgatgctattgtctttgcattattactgaatatttgattagaaatgaatttggcacctctcacctttataataaaagattactggaatgacatttctgctttataatttggttaactttggccagtttttcactatgagcactgagctttgtaaagtcccactttgtgaaaagaagggtttagtgactttacaaactaatttagcttcccagagagccatttgaattaagaccctattaatttttttctgaccttattctacccaaggtattaatcttattttgctgctcartttctcttttggggaactggagggagatataggagaggagggactttgacaacctatatttggtagaaactaggttatgttaaatctggatatatagtcctgtgcagggaggccttctccgaaatgcagtgacatcacactctggtcgagggcaagtaagagtgattatgtgctttgactctggcagctttgttgtttaacagtggccttaggccataccgtaaatcctcagaacagccgttacttgtctggtttgatctggtagaaaggtagtgtgagttcaaattccatcatggcttt

SEQ ID NO: 21449 - DNA, 601 bp, Human
atattagattttttttttctttagctctattttgtttactttttctgtaacttctttttttttttttttttttgagacggagtctcactctttcgcccaggctggagtgcagtggcgcgatctcggctcactgcaagctctgcctcctgggttcacaccattctcctgtctcagcttcccgagtagctgggactacaggcgcccgccacacgcctggctaattttttgtatttttagtagagacagggtttcaccgtgttagccaggatggtctcgatctcctgaccttgtgatccgcccrcctcccaaagtgctgggattacaggcgtgagccaccgcgaccggctgtaacttctaatgaagacgtcagtttttgccatcctgtattttggagactctggctatgtccatatctagcatgtgattaagtgtatctctcattatatgaggtgagaactcattatatgagagatacactgaatcatatatatatgtgatttttttttgaggtgaaattcacgtaccataaaattaaccaggttaaggcatacagttcagtggcatttagtacactgacagtgttgtgcaacaatcatgtctt

SEQ ID NO: 21450 - DNA, 601 bp, Human
tggtgcttaggtcttttctcctagatccatatttactattgtttgccaaatacattatgtcatattgacctgataataatgagcaggtgccagcatgtcttgtcctgaagttggtgataagtattattagtgatggtgataaggaaaaagatactcattttgagtacagaaggaatattattaaaaaatatatgtatatttatatatttttttccccttgagacaaggtctctgtcgctgaggctggagtgcagtggtgagatcatagctccctgtagccttgatctcctaagctcaagcsatccacacacctcagcctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggct

SEQ ID NO: 21451 - DNA, 601 bp, Human
ctcccaagtagctgagactacaggtacatgccaccatgcctgagccaccgcgcctggcccaaattcctatttatttatttatttatttgagatggacttttgctctgttgcccaggctggagtgcagtggcgtgatctcggcttactgcagcttccgcctcccaggtccaagcgattctcctgcctcagcctcccaagtagctgggattaaaggcacgtgccaccatgcccagctaaattttgtatttttagcagagacaggatttcaccatgttggcgaggctggtcttgaactcctgayctcaagtgatccacccggcagcctcacaaagtgctgggattacaggcgtgagctactgtgcctggccccaaaattttaatatatttaaagaagtctggtacattggacaaagtcttatagtttctcaaatcagaaaaagtagtcttattatttagtaaaaatgtgaccagactgtgccgtttttgttagtagagccatttgtcatctggattacttcttctggaaattgggatggaagagttaaggttgaggttgagatccacgttcttttgtttcaacaccagtttgattctcgtgtct

SEQ ID NO: 21452 - DNA, 601 bp, Human
aatacagatatgtatgtaaaaggtaaaaatgaaagttctcccttcctgttcctattcccaagggaacttggtgtatatcctcaagtctttttctctgcatatgagtgcatatattaatacatatgatttaaaatttttttatctttaatgaaaaagcaatcttgcaaaacaatgaatagaaatgagttattttcatatccgtccatatacatctaccatgttcttcgtctagatgtatatttaaaacggaatctctagagccatctatggtttttaggtcatagacggaattacttgaggsactttgcacttattactctcatcatctttgttatcagtaatataatgcttgtttttacctatgagtttgggtctaggaacaaaggattcttcttgggaaagtccaacccttcatcttttgtaaaattgttcctaaataaaatagatcatttctagaaatgtggagggtcttcccatcaaagacaaacattttagcccatctcagcttattgtgcctgtagcttagcttgctttatttgttgcttaggatcagaattctgtgcttttgtgttcaggagtccttacatttaccaaagtattc

SEQ ID NO: 21453 - DNA, 601 bp, Human
attcttcttgggaaagtccaacccttcatcttttgtaaaattgttcctaaataaaatagatcatttctagaaatgtggagggtcttcccatcaaagacaaacattttagcccatctcagcttattgtgcctgtagcttagcttgctttatttgttgcttaggatcagaattctgtgcttttgtgttcaggagtccttacatttaccaaagtattccagacatggcgccaactaccattcttctttttctcttgttgcagtgagttgcttaattatgtcagtttgttgtctgtagctttcartcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaaaatttaaaaattagccctgtatggtggtgcacacctgtagtcc

SEQ ID NO: 21454 - DNA, 601 bp, Human
ctcttgttgcagtgagttgcttaattatgtcagtttgttgtctgtagctttcaatcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctytatgaaaaaaaatttaaaaattagccctgtatggtggtgcacacctgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaat

SEQ ID NO: 21455 - DNA, 601 bp, Human
gttgcttaattatgtcagtttgttgtctgtagctttcaatcttggcaacacatcagaattgctcagccagggaactttgaaataatactgatgcctgggtctcaacctcagcctgatttcagttgtcctggatatggtctgggtgtgaggattttaaaggttctccaggtggccaggcatggtggcttatgcctgtaatcccagcacattgggaggctgagacaggaggattgtttgagtgcaggagtttgagaccagcctgggcaacatggtaagaccctatctctatgaaaaaaaattwaaaaattagccctgtatggtggtgcacacctgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaatttaataaagttgtag

SEQ ID NO: 21456 - DNA, 601 bp, Human
tgtagtcccagctatttgggaggctgaggtgggaggatcacttgagtgcaggaggttgaggctgcagtgagtcgtgattgtgccgctgtaccccagcctaggcaacagagagagaccctgtctcaaaagaaaaaaattaaaaagaaagctccccagattattttaatgtgcagccatgattgagaactactgctagctgctaacagtgcttggtagatttgattggggggaggaggagggagaaaatataggaatttaataaagttgtagaatatatgactttgcctcttttagtaccccyctttggtcctgcccaactttttcctccttatttttattacttacacctcacaaaagccattagccacttgtcattcagtctcagctttttctgattttcttttggaaatatgtttatttcttcttctgttagcattttgtgtgctttgacgaacaaaatgtctataattatataaagggatacaattacaattaaatagttataattttaaaactctcctaattcttcaaacctactcttgaaaagtgtcctggtgacctttttttaattcaggcatttgtaaaagtttgagactgcaga

SEQ ID NO: 21457 - DNA, 601 bp, Human
tgaaaggaacgacaggaacagtcttgaaggtggaggaaagtcttttgaggcagtatggtagatgagctggaggatgtagatggaaagttgagatgggagtagtcaacctctttttcatggacttagtgttttttttccgtttcttttaaacaatattagggttgttactttcttttttattttggttccggcttcttgcagataggtgagcctggagaccaggccttaaaatagtggttacagtccctgacagtttacagtgcggagcctaagcagtcattcaagattgtacctttggaartgactccattgtgtaccattcttggtttcaagattattcttgtttgattgaatagcaagggccttaaagcccactgatttattaaagtactgattaaagtagtgattctcaacattgggtgtgcgttagagtcacttggtggagctcttaaaggtataaatatgagttctctttgacattatgatttatttggcccagagtggagcctgtactttgctatatttagtatttctcaggtaatattagtgtgtggccagggctgagaacctttgcattcaagagtcaggagacacagtgcta

SEQ ID NO: 21458 - DNA, 601 bp, Human
ctaagaatgggtttgtcccactaaaaacatcattaggaagtgcagttgcctttgtattaatgctctactttttgtttgtttgtttgttatggggtgtgtgtgtgtttgtgttagaacagtgaaacgagtttgatttcattgcattcagatctagcataacacctcctgagagctggcacagttacaaatctttttgctgaggtcgttttagaagatgataaaaatacactgagaagcataagttcacatgatctttaactggctcaagccactgccctcaactttacaactgtacattcarttgctgaattcaagatgaaaatcaatgttaaccaaatccatgtagtcttattttttatttctgtaattaagaccatttggaaataagtaaggactatatgcaggcccctaaggattatcctaagaccctttcggggggtccgtgaggtcaaagctgttttcataataatacttagatgttacttgcctttttcactatttggatgtttacagtgatggtgcaaagcagtggtgggtaaaactgctggtgcctcagcatgaatgaaggcagtggtgccaaccataatggtagtcattgtat

SEQ ID NO: 21459 - DNA, 601 bp, Human
tagcataacacctcctgagagctggcacagttacaaatctttttgctgaggtcgttttagaagatgataaaaatacactgagaagcataagttcacatgatctttaactggctcaagccactgccctcaactttacaactgtacattcaattgctgaattcaagatgaaaatcaatgttaaccaaatccatgtagtcttattttttatttctgtaattaagaccatttggaaataagtaaggactatatgcaggcccctaaggattatcctaagaccctttcggggggtccgtgaggtcaragctgttttcataataatacttagatgttacttgcctttttcactatttggatgtttacagtgatggtgcaaagcagtggtgggtaaaactgctggtgcctcagcatgaatgaaggcagtggtgccaaccataatggtagtcattgtattccttaacaccatgtgctaaaaaagagcagtttcacttaggaatgtccttcatgagcagtaaaaatttgttttattaaaacttgaacctttttaatattgtgtttgatgaaatagggattacccataaatctcttctgctgcgtagcagtg

SEQ ID NO: 21460 - DNA, 601 bp, Human
cagtttcacttaggaatgtccttcatgagcagtaaaaatttgttttattaaaacttgaacctttttaatattgtgtttgatgaaatagggattacccataaatctcttctgctgcgtagcagtgcaatggtcgacttgagaaaaaacccttgtgcagttgtttgaactgcaaacaccatttttatgtgaaagaatgattgacagacaaactatatttaatcagactttggtatttgggagatattttattcaaaaatgaacaaagtgaacctgtcacttcaagggaaaaaaattgacaatrgatacgtttcaggttttaaagtaaaaaattagaattttggaaaatttgtatctcccatcataagcttgacagcttcctaatgcttaaagacttttctgaggagattggtggtgaaattaatgattgtgattatttgctgttttataatgaaatgtgtcagcatagctcagtgaaccaatatttttccaaatgaccagagcatatgtatatcacaaaattatgcatggataaaagatctattcgaaataaagtgtggaggccaggcgtggtggctcacggttgtgatcccagtattttggg

SEQ ID NO: 21461 - DNA, 601 bp, Human
ctgtttttatttcaagtagatattaaagagagttgcaaaaaaataaaaaagcagtgtcaccatctcattaatttaaaaacagtacattttacctttaaaatgttatgaaatgggtttattcttattttaatggattaactttttaaaaatttctcagttttaattcctgacatggtaaaatatcaataggtatataacccacatgaacaaaaactctttgggatgtcagtaatttttaagagtatgaagggatcccgagaccaaaaaggtgagggctgcttccctaaccagacggggagcscagatagaaatggcagcgtaggaaatgactctgtatcttctcttgctccaggtgctgctcttctgaggtgaatttttgttatttttcttttgtttgttagcacataaagcacatttggtttttaaattgctgtcctgtgaccatctatctaaggagttggcaaacgtttttgtaaaggacaaaatagtaagtacatcaggctggcatagtaagtactctttgcttagcaggcaaagaggcaaaattgagtttgttaggtaggtacttacataacaagagagaagacaaatttccacaaat

SEQ ID NO: 21462 - DNA, 601 bp, Human
ttcatctataaaaaccacttttagctcatggattgtacaaaaatccagcattgggctagatttaacccacaggcggtagttgcctatctgtgatctgtctagtcactgaagggctgtttttgccaaagaataaatctggattgaaaacatcagtacaaacgaattggtaaaaattgtcataactcttttttttttttttttgagaccgagttttgctcttgttgcccaggctgcagcgcaatggcgtgatcttggctcactgcaacccccgactcccgggttcaagtgattatcctgcctstgtctcccgagtagctgggattacaggcatgcgccaccacgcccggctaattttgtatttttagtagagatggggtttctgcatgttggtcaggctggtctcaaactcccgaaaaattgtcataactctacaggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatga

SEQ ID NO: 21463 - DNA, 601 bp, Human
tctgcatgttggtcaggctggtctcaaactcccgaaaaattgtcataactctacaggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatgatttttactgtctagttgatgaaacccaaaacttgaaaaattagggaaaaataaaatatacttatgtaattaggcactraagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactgtccagtggaaatacagtgtgaaccacatatgtaattttaaattttctaatagccattttgaaaaaatgaaaaggaacagatgaattaattttagtaatacatttt

SEQ ID NO: 21464 - DNA, 601 bp, Human
ttaggcactaaagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactgtccagtggaaatacagtgtgaaccacatatgtaattttaaattttctaatagccattttgaaaaaatgaaaaggaacagatgaattaattttagtratacattttatttgacccagtatatctaaaatatcctttcagtatgtaatcaacataaaaattattaatgagatattttacattatatttttcatgctaagtcttcaaaatccagtgtgtgtttcacatttacatcacatctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgcta

SEQ ID NO: 21465 - DNA, 601 bp, Human
atctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgctagaattaaactatttaggatcttgaatttattattggttaatgtttaacatttactggttatcgttgttttgtgcatgagctagtctaggaaatagaaaacacatttttggagagtatttactaaatatctacaggtgcrtgaaactaccgtaggtaccatgcatacaagtgaaacacatagtttgctttccaggacagaagttactggttcactggagatatggtggattctttgacctgagtccagcttcctttctgtgaataatttctacttctgtacccttttgtgtatataggaccattgtatataccctgtgaccagctatttcattcccttttttccccttattttccttgtggaaatacacctacatttgttttttctttcttctatgctagtagcaagatgtttagcagtattaaaaatgtataaggtact

SEQ ID NO: 21466 - DNA, 601 bp, Human
ttcatgttttaagcattctgtataccagtgtgtgtcatccagggaaattcaaaccatgtgctgagctttctgttagtggggcttggtgcatccttgccagatgggtagaagaaaacctggtgaaaccccactgttttaccttctgaggctgacaaaggtgggcatatcattgtactatcagtaattgggggctttacctattttatctttgtagaaattatacttatgagtcagcagtagtggagactgccggagtttctactttcatttcatttaatacgtcttacatcatttgattaatttttttttttttttgatacagagtctcactctgtcaccgaggctggagtgcagtggcacgatcttggctcactgcaacctctgcctcccaggttcaagtgattctcctgcctcagtctcccaagtagctgggattacaggtgaccgtcaccatgcccagcttatttttgtatttttagtagagacagggtttcaccatgttggtcaggctgatctcgtgctcctaacttcaagtgatccacccacctcagcctcacaaagtgctggggttacggacacaagccaccactcccggcgtgat

SEQ ID NO: 21467 - DNA, 601 bp, Human
gtatgtttttcatacagttacttctgctaaaatctcttttatcgtcttacgtctcccatgcacagttcttggccatttggccagcaaagattattgagtatctctctttggggtgacagatttttcattctattagatatatagaaagtggcttcatattagttattgagctgacctgtatatataattcagtatgagagagagtatgttaaagtcagcagaatatatcctcctttccagtagatatggaaaccatgtcagtctgaatttgaagattttagaaggcacacctagattgttstgctcagcctgttaccatgtaatgttgcaaattttctttggttattagaaattgactactaaatttcatctacacatacatacattttagtttacaaagttggaattatccctaatttttattgagcattttgtatatgcaggcactgtactaggcaaagtacttctgaagaaatgttggctcttcattaaagttggtatattttaattatggtatttaagaactggtctggctgaagctgatttccaagctactagaatgtaagtgatcttcacttatctgggaaattgtccctctaga

SEQ ID NO: 21468 - DNA, 601 bp, Human
cctctagactgaactaaagctcactctgatagtttctttccatcactgaaagtacaaatatagtctggaaataactttactgagaattttattttcttctgttggccattgacatcacattcattcattcactcacttagcaaatatttattaagtgcatactgtgtgccaggcagtgttccaggctctgaggatacagcagtgaacaaagtcatggccctctgggatcacttattctgaaggatgggggtaggaatatatataatatgtatagataatataatatataatatgtatagayagtgtaatatgtaatatgtgagatggtgataagtactaacaagaaagtaaagtagagaagaaatctaagaaatgctgggcatttgggggtgaggggttgtattttctttttaaaggatggccagggaagacctcactgagaaggtggcattcatataaagacccaaaggaagtcaggaataggaggaagagagaagtacagcctatttatcttctttctttaatacagtaagttagctacttgtgttgcccaagctaccaaaattggattaatttctaaagaaccctcaacagataatta

SEQ ID NO: 21469 - DNA, 601 bp, Human
ctatttaaaaaacaaacccttttcagagagtcccttattctcattatccttaagagaggaggttggattgttttccctaccagcctgcctcctgctgtatcttacaatgaaatcttcagccacaactgcgtttgctgtctcttcctatgaaataactctcagaatgcttaatttgacttcctataggttgagtagaaatgggctgagaggcagggagccttaacataatatggggagacaaagaggactataaaacaagaaggtaaatggtgtgagctcaagtgtcttgggtattgctagrttctttccagtttgaacatcccttattactggtttcctgaagtcttcttatgtccctgctctgcctgtagtttgctgagaatgaggcttctgcattgttggatcccaattttacctaagcatggagctttgacttttctaactaattctttaattttttgatacttggccattagactctgacatattaccttatagaatgaattcagcaaataaattataattcatgatattaattttcattctccaccctcagcatctgtgagcgggtaactccccggctatcccatgccaactcagc

SEQ ID NO: 21470 - DNA, 601 bp, Human
actctgattttgcttttagttattcttttgattaaaataggtcctccatatccatgagttccacatccgtggattcagctaactgcggatcaaaaatattcaggggaaaagaaaaaggatggttttgtctgtactgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaarcatccatggattttggtatccacaggggcccaggaaccaatctcccatggatttggagacatgactgggctgccatatctctaaataatattcttggctgggtgcagtggctcacacctgtaatcccagcactttgggaggccaaggtgagaggactgcttgagcccagcagtttgagaccaccctaggcaacatagtaaggctctgtttctacaaaaacttttttaagttagctgggtgtggtggcacacacctgtagtcccagctacttggaaggctgaggcaggaagattgcttgag

SEQ ID NO: 21471 - DNA, 601 bp, Human
tgaacatgtacagacctttttttgtctatattccttaaaaatataacaattatttacatagtatttacattgcattaggtattataaataatctagagatggtttaaagtatacaagagaatgtgtataaatgcaaatactataccattttatgtaaggcacttaagcatccatggattttggtatccacaggggcccaggaaccaatctcccatggatttggagacatgactgggctgccatatctctaaataatattcttggctgggtgcagtggctcacacctgtaatcccagcactwtgggaggccaaggtgagaggactgcttgagcccagcagtttgagaccaccctaggcaacatagtaaggctctgtttctacaaaaacttttttaagttagctgggtgtggtggcacacacctgtagtcccagctacttggaaggctgaggcaggaagattgcttgagtctgggaggctgagactgtagtaagctgttattgtgccactgcactccaacctgaaaccttttcactctgggtgacagagcaagacgctgtctcaaaaaaagaacaacaataatattcttatgctattatttat

SEQ ID NO: 21472 - DNA, 601 bp, Human
gctgtcatttcagattacccagatttaccttagaacttttcctgtaactgtttcagccatgaaggttttcagtttgacagagttgccaagccaaacagttaattggaccaggagaggcaatgattgcctgtttgcactaactcatccatgggacaggaatcagcagcataagaattgtaatgaactttctgtatagctttgggaagcaacaagctgttgagcaaataaatagcactgaaaaagcaatcctatggtgctatttttttgttcaataacttttgcctatttctttcaggagtaracaaactcctggtccttttcagttttaaaaaggagagaggttgaggcactaggttaagaccaggagttcttcacttcctggtcttctggttattttctgtttactatttctgatttttatatattagaataaaatattggtttgtgtgtcatttcttaaagacaaaaaacatatttttcctattaggaaaaccatatttgtttactatatataattatagaacaagttaaacaaaaaatggggtaccccgcttcccccatcttctgtttcactctctcagatatgcagtggacataatct

SEQ ID NO: 21473 - DNA, 601 bp, Human
cacaaatgctatttatttactttgttttatcctctacttttttttttcttactagtaatatcatggacattgatccacattataaagaaaaatttatgtcatctttagtttctggtttatagacataacgtgattacttgataacttactgaatttgtaactttatcccttattataggaccttaaagttgtttctactctttttccaaatggtggtataaggagtatccttgcaactaaatctttgaactctagttgaagtgaacattttttcataacagttatgcttattagccatttsggaattgctcactcatgtcctctgcacctttttccaatatgttatcttttccacattgttgttttaaagtcttttgtaattgagatgttaacccttcttttagttagcatttattttcctagtttgttgtcctttagatttcttctgctttcttgatgcacagaagtttagatttttgtatcagcttttctcagtcagtgtttttcctcagtggcacacttagaaaattgtgcttcacctaaagttatataaaattcactatttttttttttttttacttctatggcaatgattttgttt

SEQ ID NO: 21474 - DNA, 601 bp, Human
agttagcatttattttcctagtttgttgtcctttagatttcttctgctttcttgatgcacagaagtttagatttttgtatcagcttttctcagtcagtgtttttcctcagtggcacacttagaaaattgtgcttcacctaaagttatataaaattcactatttttttttttttttacttctatggcaatgattttgttttatttgttttttggggggtggtggggaaatggagtcttgacttgtcgcccaggctggagtgcaaatggcgcaatctcagctcactgcaacctctgcctcctrggttcaagtgattctcctgcctcagcctccagagtagctgggattacagacatgcaccaccatgcccggctaatttttgtatttttagtagaaacagggtttcaccatgttggctatgctggtcttgaactcctgacctcagatgatccacccgccttggcctcccaaaatgctaggattacaggtgtaagccactgcacccagcccttgttttatagtttaagggtaattttaatcaaccgggaaataattttagtgaaagatatgagtagagtggatcaaacaccagaacaaattgtt

SEQ ID NO: 21475 - DNA, 601 bp, Human
atgattttgttttatttgttttttggggggtggtggggaaatggagtcttgacttgtcgcccaggctggagtgcaaatggcgcaatctcagctcactgcaacctctgcctcctgggttcaagtgattctcctgcctcagcctccagagtagctgggattacagacatgcaccaccatgcccggctaatttttgtatttttagtagaaacagggtttcaccatgttggctatgctggtcttgaactcctgacctcagatgatccacccgccttggcctcccaaaatgctaggattacaggtrtaagccactgcacccagcccttgttttatagtttaagggtaattttaatcaaccgggaaataattttagtgaaagatatgagtagagtggatcaaacaccagaacaaattgttctttccttactgttatgaaatgttgtctttatcatatactgaattttgtatgtatttctgtttctggactttttgtatatacaatgatgggatgtttacttctgttcctctgccatactgctttaatggtagttttttttttttaatcaaaagcagtatggttgagatgataattttctttgaaaat

SEQ ID NO: 21476 - DNA, 601 bp, Human
tccactcatccatgaacttcagttaaagacctcctactttggcttattctttaattcttattctttcctcctacgatggcttattcttcttacttctatctcctggctatccaagatgggtgtgtgtgtttctctgtttctggactttttgtatatacagtgattggatgtcactctacttctctgccatactgctgtaatggtaggtttttttggtgggggtgggggcatagtctcgctctgtcggccaggctgtagtgcagtggcacgatctcggctcactgcaacctgtgtgtctccygggctcaagcaattctcctgcctcagcctcccaagtagctgggattacaggcatgtgtgaccactcctggctaatttttgtatttttagtagagacggggtttcaccatgttggccaggctggtctagaactcctgacttcaggtaatccacccacctctcacctcccaaagtgctgggattacaggcacaagccactgcacctggccataatggtagttttttgttttgctttgttttgttttgttttgttttttgagacggagtctcgttctgtcaaccacattggagtgcagtggtg

SEQ ID NO: 21477 - DNA, 601 bp, Human
accacgcccggctaatttgtgtatttttagtagaaacagggtttcaccattttggctaggctggtcttgaactcctgacctcatgatccagctgcctcggcctcccaaagtgctagtgctgggattacagtcatgagccacagtgcctggccttttgtttgtttgtgttttttgttttgagacagaatttcgctgttgttgcccaggctggagtacaatggcgcgatctcggctcattgcagcctccacctcccagatgcaagcaattctcctgtcaaagcctcccaagtagctcggattmcaggcatgcacctggctaatttttttgtatttagtggagacggggtttcaccatgttagtcaggctggtcgcaaacccctgacctcaggtgatccacctgcctcagcctcccaaaatgctgggattacaggcatgtgccatcacgcctagccttggtagtatttttttttttttaatcaaaagcagtacggttgagatgagaattttctttgaaaattaatatccctgacataaatgtttttcagatgtttatacatcatgaggaacatccttttgtttgtattcaaaggattcatttga

SEQ ID NO: 21478 - DNA, 601 bp, Human
gccagtctcgaactcctgacctcaggtgatccatccacctcagcctcccaaagtgctgggattacaggcatgagccacgatgcccggcccacttctgatcgtctttaaagatagtgttaaatgaagcagcttgtagtaagttagcttagtggtgggctcaagaattagtagatatattttggcaaggtagtggtttattaagcattgtgtatatttttaaaattttagaaatagttattttggaaagagaaccacatacttttactactctcccaataaagaagagggtcggtttctaaattttttttttttttttgagacagtctcactctgttgcccaggctggagtgcagtagcgtgatctcagctcactgcaacctctgcctcccgggttcaaacattctcctgcctcaatctcccgagtagctgggattacaggtggctgccaccacacccggctaatttttgtatttttagtagagacagggtttcactgtattggccaggctggtctcgaacttctgacctcaagtgatcccccccacctcgccctcccaaagtgctaggattatgggcatgagccactgtgcccagcctaaac

SEQ ID NO: 21479 - DNA, 601 bp, Human
agaccaaggtgagaggatcacttgaggccacaagtttgagaccagccggtcaacatagcaagacccccatctctacaaaaaaatttttaaaatttagctgagtgtggtggcactcaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaagrtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgct

SEQ ID NO: 21480 - DNA, 601 bp, Human
ttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctccygcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttatttatttattttttttttttgagacagtttcactcttgttgccaaggctggagtgtagtggcaggattgtggctcactgcaacctctgcc

SEQ ID NO: 21481 - DNA, 601 bp, Human
acagagtctcgctttgttgtccaggctggagtgcagtggcaggatcttggctcactgcaacctttgcctcctgggttcaagcgattctcccgcttcagcctcccaagtagctgggattataggtgtgcaccaccacacctggctaatttttatatttttagtggagacagggtttcaccatgttggccaggctggtcttgaactcctgaacttaggtgatccacccgcctcggcctcccagagtgctgggattacgggcatgagccactatgcctggccagttttactgattttttttttwtttatttattttttttttttgagacagtttcactcttgttgccaaggctggagtgtagtggcaggattgtggctcactgcaacctctgcctcctaggttcaggcgattctcccacctcagcctctcgagtagctgggattacaggcattcaccatcactcccaactaattttttgtatttttagtagagacagggtttcaccatgttggccaggctggtctcgaactcctgaccttaggcgatccacttacctcggcttcccaaagtgctgggatcacaggtgtgagccaccttgcctgg

SEQ ID NO: 21482 - DNA, 601 bp, Human
aacacctggggggcatttttaaagcacatgttgctgggcttcaccctgagagtatctgactcagtaggtctgagatgtgcctaagtatttgcatgtcttacaaggttcagggtgatgctgctgctggcaatccggaaccacacattgacaaccactggcttagagcagtagttaccactacttttttattttctgtcacctaagaatgactacacatttctgttagtaatggctgtggctcattacagcagggattttcgctagaggctgtggtgaggtttgaaaagattatctttggatkaaaattctgagactgcttctcactttcccctaccaaaattagagccacagaaccaggaagccaataaattattaagcccttttttcttggcatttgtactcaaagcaaatagaaaataatgtatgtaatctactatagcaattttaatagacctaattcaaggagtatgtacaagtcaatagctttgtggtttagcagccaactcctaataggctgtaatctgacataattctactgtcttggctcttgccccagtacgacagatgattccataattccccccaaattgtagcttttggt

SEQ ID NO: 21483 - DNA, 601 bp, Human
aagtatggcctttagatcctgttaaaatattaaaacaatgcctttttacgtgttcaactgaattgtagctaattctgtggcttttaaatgagttgactgattccagttttcataattcatgaaaattgaacctagactcttagtttagtgaaggacatacttagatgaaaatgacgtgatctgatagtacctgcttcactgtgacttcatttcagctttcaaatgaaagtggagataatagatgcctcagtaaagtttcatgcattgttctaccttccagagtagttgcctttctcacagraattaagtgtttatgctgcttccttgtattatttgatatatttggatctccttggaattatttgtttttttaggtcagaagaaaagaagtttagatggattcagatctcaggaaagtggcagctggctttaaatatcaggtcattatattagatccacagaaatcaaaataattaggttttctagtgtaactagtataatgatcatcagtccattgatgatttagtaatgttcataaatggatttgctaacaggccggctttttagcaggctgtcagagttacgatgtgtgtctgcaaat

SEQ ID NO: 21484 - DNA, 601 bp, Human
aggtcattatattagatccacagaaatcaaaataattaggttttctagtgtaactagtataatgatcatcagtccattgatgatttagtaatgttcataaatggatttgctaacaggccggctttttagcaggctgtcagagttacgatgtgtgtctgcaaatggaatatgattcagatatccagtttaccatttttctgtctttgtcatccctttatactggtgtgtaatcaaaatttaaaaccctttcacagtactttgcctagttctgagccataatttttcctgttattacaacttaaaaaaatgtatttgtatgagctttttgaagtattttaaaaactttcttaagcatcttcctctgcctgaagcaaagcaattataaacatcagtggttaatattatctgtattgaattgagcattctaatttcctggatcccatttgcatctctaagatgaattcaaaacaatttctttattcctcccacaccccccacagccttttttttttttttgtactctgtttcatgttttaattttaaactcctaagtcaggagtgtccagtcttttggcttccctgggccacattgggaggagaa

SEQ ID NO: 21485 - DNA, 601 bp, Human
gggtagtgaggttctgatgatgctacttccactgattctggacatgactgagcaaatttctttcatactgcttttcttctgtctctatagtagagttaattaatactgttctttacctgtgctgagaattaagtgaagtatatgtgaaatcttagtgcttttaagtaaaatgggagtataattaaaaatattattagttagggggaaaaacccaacccttgaatctgaggcttcatttcaaaaatttatctttttctcttacctgttacacagaaattcaatacaatattcagttcaactsagtaaagaatacaaacaaaggccgggcatggtggcttatgcctgtaatcccagcactttgggaagccgaggcaggtagatcatctgaggtcaggagttcgagaccagcctgaccaaaatggagaaaccccatctctactaaaaatataaaattagccgagcgtggtggcatgcgcctgtaatcccaactactcgggaggctgaggcaggagaatcacttgaacccgggaggcagaggttgcagtgagccaagatcgtgccattacactccagcctgggcaagaagacctagactctgtct

SEQ ID NO: 21486 - DNA, 601 bp, Human
atactaattactaggccctacttctgatgtaatgaatcagaatctctgaagtatggcccctgggttctgcactttcagtggcattcctggtatgttaaaatgttgatgcacattatagtttaagaattactgttttagtgctggcctggtaagtattgttttgggacctcttcccctgaggaaggcctatgggtctagcagtacagtagatccaaagccaaattatctgagtcaccaaacatttaatggcaacttaagattacaaaaaggtcctgtatttttatttatctcggtcttgacrgtctgaattactgtggcctccatgtaaaatgtgaggcagttggtgaggactggcttacagtaggcctaacaggtcatccctcagaacgacagagtttgagcagtaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataattttttt

SEQ ID NO: 21487 - DNA, 601 bp, Human
cttgacagtctgaattactgtggcctccatgtaaaatgtgaggcagttggtgaggactggcttacagtaggcctaacaggtcatccctcagaacgacagagtttgagcagtaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataatttttttttttttttttgagatggagtctcactctgttacccaggctggagtgcggtggtgcaatctcagctcactgcagcctcctccgcctcctgggttcaagtgattctccctccttagcctcccaagtagctgggattacagacatctgccaccatgcctggctaatttttgtaccctttgtagagatgggattttgccatcttggccaggctggtctcaaacccctggcctcaagtgatcagcctaccttggcctcctgaagtgctaggattactgagccaccgtgcctggctgaga

SEQ ID NO: 21488 - DNA, 601 bp, Human
ctggcttacagtaggcctaacaggtcatccctcagaacgacagagtttgagcagtaggagattcttccctactcctgacttttcagccttgggagatttgcactcatttctcataggattgtatttttcaagttagtgtctgtttagactttgatccagtaactctatctccagtagtttgccatattgcagcattttgaataatctgtagaggaactctcaaatttttttcatatatatataatttttttttttttttttgagatggagtctcactctgttacccaggctggagtgcggyggtgcaatctcagctcactgcagcctcctccgcctcctgggttcaagtgattctccctccttagcctcccaagtagctgggattacagacatctgccaccatgcctggctaatttttgtaccctttgtagagatgggattttgccatcttggccaggctggtctcaaacccctggcctcaagtgatcagcctaccttggcctcctgaagtgctaggattactgagccaccgtgcctggctgagatttttgaattttgtgaatccctataggaatttttctttttggtcatttggttaaat

SEQ ID NO: 21489 - DNA, 601 bp, Human
aaaatcaactaaattagatataattatcactgtttcttttttttaacccgggcatttcaaatactagagacattttgataagacattcatatgtatacatatacatatacacatacacacatttctattagaataatgcaagttataaatgtaaagattatcttgagataaaatttactgttttaatattttattaatttgctgtattgcaatgttctatatgcttttcgtctttaaccaccaatccattatgagtgcaatttaaacaatctgtgactgagaaaaaccatttaaatctatrtagtcaaaaacatcagggtaactactgctattgaactggatgataagggccttaagtggctaaatcgtgaatcaattcatctgctcgcttagaaactaaaatggaagccctcagattgtcctgttttaaagaaaatgttttttgtttggttatgagttttttgggttttgggggtttgttttttttttttttcttttgagacagagtctcactctgtcatccaggctggactgcagtgacttgatctcagctcaatgcaacctccacctcctgggttcaaatgattcttctgcctcagcc

SEQ ID NO: 21490 - DNA, 601 bp, Human
tttaaagcagttaaaaaaaattttttttttttggaacggagttttgctcttattgcccaggcgagagtgcagtgaaacaatctcggctcactgcaacctccgcctcccgggttcgagtgattctcctacctcagcctgttgagtagctgggattataggcatgtgccaccttgcctggctaattttttgtatttgtagtagatacggggtttcactgtgttagccaggatggtcccaatctcctggcctcaggtgatcctcccgcctcggcttcccaaagtgctgggattacaggcgtaarccaccgcgcccggccctagtttaaaaaatttttatgtcctaaggccgtctcaaccagttaacttttgccagattaaacattgtttttctattctttatttctgtttgaatttgagtcttaggattaacccatcttaatttatagttacatcccttgaaacattagagattacagaattatgactatattaggaccatgttgagttaacacatttgtttgctttttgagacagagtctcactctgttgcccagtctggagtgcagcggtgcagtcatggctcactgcagcctcaacctcct

SEQ ID NO: 21491 - DNA, 601 bp, Human
ctattctttatttctgtttgaatttgagtcttaggattaacccatcttaatttatagttacatcccttgaaacattagagattacagaattatgactatattaggaccatgttgagttaacacatttgtttgctttttgagacagagtctcactctgttgcccagtctggagtgcagcggtgcagtcatggctcactgcagcctcaacctcctgggctcaagtgatcctcctccctcagtttcctgagtagatgggactacaggtacatgcggctctacaccccgccctgataatttttgkacttttattattattattattttttgagacagagttttactctgttgcccaggctggagtgcagtagcgtgatctcggctcactgcgacctctgcctcctgggttcaagctattctcctgcctcagcctcctgagtagctgggattacaggcacacgccaccaagcccagctaatttttgtatttttagtagaggtggggtttcgctatgttggccaggctggtctcaaactcctgatctcaagcgatccgtccaccttggcctcccaaagtgctgggattacaggcatgagccactgcg

SEQ ID NO: 21492 - DNA, 601 bp, Human
gttatcactgaagaaattttgtctcacagaggttgtcgctttccgaaaattatgcagctagtaattaatggagccaacacttaatcccctgtttttaccaccatcctacactgacccacaccctcatgatttcacctgagatgtgtatgtgaatttctaaccaagcttacttctctagctctgactgccagtcccttggttttgtttttgtttgtttatttgtttgtttgttttgttttgtttttgagacggactgtcattctatagcccaggctggagtgcagtggtgcaatcttggctyactgcaacctctgcctcctaggttcaagaggttctcctgctacagtctcctgagtagctgggactacagatgtgtgccaccacacccagctaatttttttgtacttttagtagaggtagggtttcaccatgttatccaggctggtctcgaactcttgacctcaggtaatccagctgccttggcctcccaaagtgccaggatcgcagacgtgagccactgcgcccggctggaatatgaacaggttctgaattatcgaccccagtgctctaccctgagactctgggcatgagccaccgtgcc

SEQ ID NO: 21493 - DNA, 601 bp, Human
acatataatttttcctgtcgtccttctagagtcccctgtgattattagctaatcttttgcttcttagtttttgtttgtgtcaaaatttaactaggcttttttaaagaaaacatttgttttttaattaaatttttacaattttttttactttttttttttgagatgtagtctcgctctgtctcccaggctagagtgcagtagcacaaccttggctcactgcaagctccacctccttggctcaagtgattcttgtgcctcagcctcctgagtggctgggactacagctgcctcctaccactcmtagctaatttttttgtatttttagtagagaccgggtttcacaatgttggtcaggctggtctcgaactcctgacctcaggtgatctgccgaccttggcctcccaaagtgctaggattacaggtgtgagcctctgtgcccgcctgtttttttgttttgttttactttttatcatataaatcttaaaatatgcaagatagaatggtataacaaacttggatatacctatcactcagctttagcagttatcagtatcttgccagtcttatttcatttattgcccatacagttgtttttgaggtg

SEQ ID NO: 21494 - DNA, 601 bp, Human
gttttactttttatcatataaatcttaaaatatgcaagatagaatggtataacaaacttggatatacctatcactcagctttagcagttatcagtatcttgccagtcttatttcatttattgcccatacagttgtttttgaggtggctcaaatattttaaatccaatcccagacctcgtatctcttcacccgtaagtactgtacttggtatctttaacagataaagacttgaaattacaatgttatcaagcctaacaaaattggacataattacttaatatcatccaataagcaggctaasctactttgatattttctcaattgccattctctagtctcgtttagagtttatttaagatcggctttactttttccttaaatgtttggaggaattcacagtgaagccctctgagcctggaattttcttggtgggaattttactttttaaattgacatctaatttataataaccttagcattaaggttattgcctgacctttgcacggtcaggataccacggccgttgaacatatgtcactgggcaggcagtgcctctactactggtaatgctagaggtgatgtttttggtaaacaagctggg

SEQ ID NO: 21495 - DNA, 601 bp, Human
gagcctggaattttcttggtgggaattttactttttaaattgacatctaatttataataaccttagcattaaggttattgcctgacctttgcacggtcaggataccacggccgttgaacatatgtcactgggcaggcagtgcctctactactggtaatgctagaggtgatgtttttggtaaacaagctgggtaagatttgccgagttccttttactgtttgtaatctttccttagagcatacctgtgttggattaacagtataaataatagggtgtttattatattgtttattaatattargctgtcagtggattattccggtctgatataagcttatgcagtggagaatatcttcatgttacttatattaacattattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatag

SEQ ID NO: 21496 - DNA, 601 bp, Human
tattgcttctattaagtaatagattagtccaatctgttagtaatagattagctcgctaatcttagcatttagtgctcaatgaatttttacatatgtatacactcatataatcactaccctgatcagatatagaatattttcagcaccctagaaggttcctcgtgttcctttactgtcagtgtgcacactccagagattaccactgttctgatttctatcactatagattcattttgtctgttcctgagtgtgctataaatggaacctacagtttttactcttctgtgtcttgtgtcttttrctcaacataatgtgagattaatctgtgtttttagtagtttgctcctttttattggtgtgtagtattccattccatgaatataccatttatatcttctattgcacctttgggttatttctagtttgtggctgctgtgaatattcttgtatttgtcttttggtagacttatgtatatatttctcttgggcatatacctaggagtagaattgctggatcatagaataggtttctaattagctgtaggagacactgccaattttccaaagcagttgtaccagtgtatactctttctagcactgt

SEQ ID NO: 21497 - DNA, 601 bp, Human
acaaatacaaaatcttggatcactgtgttcctgtatcctactgagtactctcttgataaagcttctaaagaatgtgtgttcttatcaatgatgaaaaaataactgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtscctgcaacctttgctccttcacctacacctgctgtggtcagcagtggactgaatgacctgtttgaactctccacagggataggcatggcacctggtggatatgtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttg

SEQ ID NO: 21498 - DNA, 601 bp, Human
ctgtcatgattaaaaagatgaagaatatactaatttgactcctaagaatattgtaattatggtgttttcttattgatttatcaaaactactaagatatatagcaatattttaaggactgttaatctgttcttcccaatctcccctctcccttttttttttctcctgcaggtgggacaatccttcatcccatcatcggtgcctgcaacctttgctccttcacctacacctgctgtggtcagcagtggactgaatgacctgtttgaactctccacagggataggcatggcacctggtggataygtggctcctaaggctgtaagtaaagagttaacatagcaatactttcttaatggacaggacccaaactgtttcactttcaacatttgtgttacttctactggtaataaatcaaaggtttgggcccttgttctggaggacttagaggaagatgaaaggtggcttcaaacttagcagtaggaagcaccattagcatccttgttaaacatttttataattagacttaaaatttgacatattaattatttgagttttgttctcatgtttagaaatattgtctagtttgtcaacattgaagtcaat

SEQ ID NO: 21499 - DNA, 601 bp, Human
ttttctctaccatattcttttgaatccgtatatctactgaattgatacaccataatttatttaatcactcctctgttgatgaacatttaggttattccctggtcctccccaccacctgccactcttttagtatggctgagtacattatcatgattattcaccacccacagatcctttggtattctgtcttaggtggtcagaacagctcatgactcctgatttttttattttatttttttttagacggagtctcactctgtcgcccaggctggagtgcagtggcgtgatcttggctcactgyaagctctgcctcagcctccccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaat

SEQ ID NO: 21500 - DNA, 601 bp, Human
ccagtagctgggactacaggcgcccgccaccactcctagctaatttctttttgtatttttagtagaggcggggtttcactatgttagccaggatggtctccatctcctgatctcgtgatctgccctcctcagcctcccaaagtgctgggattgcaggcgtgagccaccacgcctggccttaaatttttttatctttatttttttaatagtataggccaggtataccacaggttccaggaccaaggggcgtgttatgaattatttaggtagataaaaagaataggcattcagattatatgarcaatatctgagtatttactatttaccacaaactatagcaagagttaaaaacgtatataagacatagtcgatgcctttaagggaattaccaataatggctttggttggaaatgatgaaaaaaaatcttcaaagattacagccatgctgttttcattagtagatgcagtttcttccctttaaaccattttaccaaaactaacagaaaaacacattatgctcattggaatttttcttttcctcttggtagcagtacttaaaagtagtaaaataaccaagctgaacagaaggtagagcagaagc

SEQ ID NO: 21501 - DNA, 601 bp, Human
aaactaacagaaaaacacattatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttytttatttgttaaaaaatacatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgacagattttgcaatccagtttaacaaaaataggtaagcaatctgggtccctagcttgatgttgagacaacagtttgccttagaaccaacaagagaacattccatttagcactg

SEQ ID NO: 21502 - DNA, 601 bp, Human
attatgctcattggaatttttcttttcctcttggtagcagtacttaaaagtagtaaaataaccaagctgaacagaaggtagagcagaagccagggtcgtttaaagactggttttttaaaattattattatttggttcttaaataattgagaacgatctcaaaattcagaaaataagactctatccggagtcttttgcactggcttgatatttatagtataaaaattactataattgcctaaggaagtgaatttgttcacttaattgttaatcttaatttgttctttatttgttaaaaaatrcatagcatcaagataaatcttgtctgattctattgagctttatactgtgtttcaggtctggctacctgcagtaaaggctaaaggcttggagatttccggaacatttactcaccgccaagggcacatctatatggaaatgaacttcaccaataaagctctgcagcacatgacagattttgcaatccagtttaacaaaaataggtaagcaatctgggtccctagcttgatgttgagacaacagtttgccttagaaccaacaagagaacattccatttagcactggttaaaaactcacatatt

SEQ ID NO: 21503 - DNA, 601 bp, Human
tacctgaggtcaggggttcaaaagaccagtctggccaacatggtgaaaccccgtctctactgaaaatacaaaaatgagctgagcatggtggcaggtacctgtaatcccagctactcaggaggctgaagcaggcaaatcccttgaacctgggaggccaaggttgcagtgagccgagattacgccaatgcactccagtctgggcgacagagtgaaactccatctcaaaaagaaaaccaaacctcacacattggcagatgctgtatgtagagtgagccctggctcttgcaagccttttcagttrtcagcttcaactctggaggcactagggagtttgttgggaaactcatccaaatgcgatgaagaaaccagaacttatttactatcttggattctaggattagaacgtttttgataaatttttaactgaaatccatttattcattcaacaaatcattgtttaacattagcatgagccagacatttctaggtactggggctagagtagtgaaccaaacaaagctcctgactgaaagttcacattttggtgggggaaattagcatatttggttggtataagaaatatggaagtatatatgctgaa

SEQ ID NO: 21504 - DNA, 601 bp, Human
atttggttggtataagaaatatggaagtatatatgctgaacaaataatcacataaaccttgacaacctccttttagcaatgaattctctgccttaataaggaagagagcatgaagaagtaaaatgttaatgtcttattctttttgaaacatcagtgggttttattcagttttatggttcaggaaaatggctgttagaccttaatggcatgtccattcatttgtaaatacaggatatttagccctgcatataaaaagtagtaattggacccttaaagcagatttcataaaatttgtcaatgrcaatttgcataagtgactgtctgatttatttctcatcatttggaaacacttttgtactctggatttgagagcttggcatgttaaaaatcatttaactatctagaaagtctgtgtttctttctgtcaagactaccaatgtttccagccatttttgaggagctggccctgttaaaggccagggctgttgggaaaataaataaataggccaaggctattggtggaattctgttgtaataaaggaaatctgcagatgcagagtctgcattcatctctagcctttttttttttcctttttttttt

SEQ ID NO: 21505 - DNA, 601 bp, Human
tcttaccttttgtcagatttaagtatttcaaatttttgatgttatagtaaatagtttttttttttttttgagacagagtttttcgcttgtcacccaggctggaatgcaatggtgtcatctctgcccactgtaacctccgtctcctgggttcaagcagttctccatcctcagcctcctgagtagctgggattagaggcacccgccaccatgcccagctaatttttgtgtatttagtagaggcagggtttcaccatgttggccaggctaatcttgaactcctgacctcaggtgatctgcctgyccttggcctcccaaagtgctgggattacaggtgtgagtcactgggcccagcagtaaatagtatttttaattttaattttttattattgctagtatatagaaatataattgatttttatatattgaacttgtttcctgcaactttgttaaacttactttttctttctagtggcctttttgtaaattccttctagtttcctacataaataaatcatgtcatttatgaacagagacagttttatcttttcctattcaatcttatgccttttattttttcttcttgtctgattgtactaacagg

SEQ ID NO: 21506 - DNA, 601 bp, Human
cgtctcctgggttcaagcagttctccatcctcagcctcctgagtagctgggattagaggcacccgccaccatgcccagctaatttttgtgtatttagtagaggcagggtttcaccatgttggccaggctaatcttgaactcctgacctcaggtgatctgcctgcccttggcctcccaaagtgctgggattacaggtgtgagtcactgggcccagcagtaaatagtatttttaattttaattttttattattgctagtatatagaaatataattgatttttatatattgaacttgtttcctkcaactttgttaaacttactttttctttctagtggcctttttgtaaattccttctagtttcctacataaataaatcatgtcatttatgaacagagacagttttatcttttcctattcaatcttatgccttttattttttcttcttgtctgattgtactaacaggacctccagtaaatgttggataggagtggtaagaaaagtgttctaattcatgggagaagcattcagtctttcatcattaagtgtgatgttagccataggtttttcgtggagcttgaggaagtttcattctgttcctgg

SEQ ID NO: 21507 - DNA, 601 bp, Human
tttttgtaaattccttctagtttcctacataaataaatcatgtcatttatgaacagagacagttttatcttttcctattcaatcttatgccttttattttttcttcttgtctgattgtactaacaggacctccagtaaatgttggataggagtggtaagaaaagtgttctaattcatgggagaagcattcagtctttcatcattaagtgtgatgttagccataggtttttcgtggagcttgaggaagtttcattctgttcctggttttctgagttttattatgaatgggtattaaattttrccagatgcctcttctgcatttactaaaatgattatgtgaacttttttagtccattaatatgatggattacatcagttgacttttcaaatgttaaaccaaccttacattcctgggataaatcctacttgtttaggatgtgttgtctttttttgtgtattgatggagttcattggcagaaacttttttacatctatgttcatgatatatttactcttcatttctgatatgatttacttttttttattatttctttcctgagttagattggctccctttaccttttcctgttgtcttgccctc

SEQ ID NO: 21508 - DNA, 601 bp, Human
attctagagggctgatctttgccttcaagccctgtctttcaaggaagccctgtcttccaaggtgtttgttttctctttagaaggtggtgctttttgagctctttcatctccagggcccccttggtagaaagggacttgctaccttttttttttttttccagccttattcatatgctgctcctgtttgatcttggtctactctgggaatggggctgtcttctgagaatgaatatttgtggtcagtctctaagacctactactactggtttcctctgaactccttgtgcctgcctactgtatmaccagagcatctcaccagttctgtggactttctttgacagtagttttggagaaggtgaaattacagctttatagggactttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtc

SEQ ID NO: 21509 - DNA, 601 bp, Human
tttttcccccttgtttgtttcctctatttcatttcttaaatgagcacttggaagatttggaaccatgctgctgccatgtttcccaatattgacttaatgacagagttttgatgactgtgagagcaaaatcaaaagagtaaaattttttttgccttataactattatgcctaaatgagtgatgtgaattctcaagatcatttcattattacaatttggtagtcttaagatgtagtttatctaggaaaaggaaaatatttctttagccactctaactcttggaagagtatgtgtgtaaactcttttttttttttttttgagacagagtttcgctcttgttgcccaggctgcagtgcattggcatgatcttggctcactgcaacctccgcctcccgggttccaagtagctgggaattacaggcgcccacgaccacgcccgactaatttttttttgtaatttttggtagagatggggtttcaccgtattggccaggctggtctcaaactcctgacctcaggtgatccaccagcctcggcctcccaaagtgctgggattacaggcgtgagccaccgcaccagcctgtataaactctttagttaatt

SEQ ID NO: 21510 - DNA, 601 bp, Human
aaaccccatctctactaaaaatacaaaaattagcatggcatgatggtgcatgcctctagtcccagctacctgggggactcatgtgcgaggatcacttaaacctggaagttgagggctgtggtgagctgagctgaaatcatgccactttgctccagcctgggtgacagaatgagaccctatctccaaaaaaaaaaaaaagtttcctttaaatggagcaaaatgccattaaaacccaaagatatggcaaaatcctgcctctttttttttttttttttttttttttgagatggagtttcactcytattgaccaggctggagtgcaatggtgcgatctcggctcactacaacctccgcctcccgagttcaagcgattctcctgcctcagcctcccaagtagctgggattacaggcacccgccaccacgcccggctaatgttttgtatttttagtagagacagggtttcaccatgttggccaggctggttttgaactgctgacctcaggtgattcacccacctcagcctcccaaaatgctgggattacaggcatgagccaccatgcccagcctaaattctgcctcttgattaacctctgtgattta

SEQ ID NO: 21511 - DNA, 601 bp, Human
gaatgaaagtgagccttggtgcttggtcggtacctcctctttcctcatttacccctcatttactcctgcatacattggtggttctcataagggatttccagcacattgccatcctcccattgcagctggagcatagcactggggaaaggaggcaacacggcagcacagaaagcaaaaaaaaaaaaaaacacacacacacacaaaataatgccttctcattccagcttcccccaccccgctccccggcccaagatggagtctcgctccattgcccaggctggagtgcagtggcacaatctcrgctcactgcaagctccgcctcccgggttcatgccattctcctgcctcagcctccagagtagctgggactacaggcgccagccaccacacccggctaatttttttgtatttttttaatagagacggggtttcaccctgttagccaggatgttcttgatctcctgaccttgtgatccgcccgcctcggcctcccaaagtgctgggattacaggcatgagccactgcacccagcccagctttttaattttagttttttatggctctatgtaatattcatcttctgtgttcagatgaatcttat

SEQ ID NO: 21512 - DNA, 601 bp, Human
ccatgctgtaggtgctccaaataccaatgaatcagattccagtgatacactgctctgtggccatgccgcacatgaaacataggggaaaacagtcattgcattttctccaggagtccaaggccaacattttcccacattaaatcactgctagtcttgcaagaccacttcctgcaactaatcctttccagctcttcctttgagtccacccccaggtctggagtgccctggcctttagatttccttccagtctcgagggctctattaacatgaacgtttttggctttagtgccttctgattcarcaccctgggtctagctgagagctaaaaataccatcctttccagctgatctgccctaatcacaatagcaccaacactttaaatagcttttctgtgctagcatagacatttgacagatggaactaacactctgagggctacaggaagtcacaggcttaaaggacttaaccaacttagcactgagctttactttgctctttcatgtctttctagagaataaagaaagagaccctcttcccaagtcttaataattaatcagatcttaagagaaaagtgtatggtgggagtgcttatgatgccgc

SEQ ID NO: 21513 - DNA, 601 bp, Human
cttcccttgccattcatcatacatttagcagaatctcatcattctgcaatccgtaaatcttcaaactcaaacctaataactaaaatgtataaaaatcgaatcacacatactaatgttatggaaccctctctctagtcttctgataaaaatcacagtacagtcattcattaggaacagagtcaggttgctggccagaatgcttccaaatgtattaaagttacatccattcaacttgcttattcttcctggctgtttggcatgttttctaattctagaagagtgagaataagagagagagagrcagagagagtttcttagcctgtcatctcttacataggtggtgaaataattgagaatatttcatgattatttctgtaggaatctggcccttgccacatgtatatgctagaatgtatttgtgcctatgcaacaaggtgggtgttcaacaaaggctcctactttgtgtgtttttgggtttcctgggaaatgggcaagggcctagaaagttaggaatgatttttacaacttaaagcaagcccctctgtgttcaagacaatcctgtcaaaaggcattagccaaaccctagctgatgatgttgcct

SEQ ID NO: 21514 - DNA, 601 bp, Human
ggtggcaaccagaactgcctcatcccccacaaggtgattaaaagggcatattgaggccccttcttccagcaatattgcatagatgtaccctgagatacattttttgactcctcaaatagagccatttcttaactactctgcttggtgtcagtgaagacattggaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaaytagttcacgtctatgtctatggtattatgtaaatattggcatccccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaa

SEQ ID NO: 21515 - DNA, 601 bp, Human
ggcatattgaggccccttcttccagcaatattgcatagatgtaccctgagatacattttttgactcctcaaatagagccatttcttaactactctgcttggtgtcagtgaagacattggaaataaaaggggaaaagctaagtaataactaagtgtggtaaaaatgtctcatgaaaggagtcttagtgcctcctctcctgagctgtcagtggtttgaatgtgcgagaaagacatcagggtgagagctacctgcaaaactagttcacgtctatgtctatggtattatgtaaatattggcatcyccaacacctatcagagcagatattgatgaaaggtacctgttgtattgcagataacgtgggaaacacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtt

SEQ ID NO: 21516 - DNA, 601 bp, Human
acacagtgatgaaaaactccaggatccctttgttcagagagcttaccatttagaagggtagaaagaccatccatcatggcaaccttttcccagagagcacaatagaatatgacagatttttatgtggggagaatttagttcttgaagtaggcatgagtaatttgaatgctgtcttcagaaatgaatataataaacagtcaacaaagaagcagtgcttgtcatctctattcttaaagtttctctttctctgatacagcaacatctcataaagagagaaataacctttaattctggaacgttmtgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaatcttaaacatctaggttaataaatttgatttgcagttgacttctg

SEQ ID NO: 21517 - DNA, 601 bp, Human
ctctgatacagcaacatctcataaagagagaaataacctttaattctggaacgttatgtcctttttgaaactgtagtcatgaggaagagccaaaacaccaacccattcttaccctgagttggtgactatgaaaacttctgtcatagtttctgtcatagctgggatcttaggatctagcagcagtcacctttgcacagcttcagtctttctcaaaatctgtggttgagacagtttgtttcgttattattttcgaggcatagtattccctaaaggcttaagaaatcatttctgcctgctttgaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacagataccaacatgacagtcactatggcatacccacacacttatttctgtctttgtcctcttcagagtcttctttacctgtctagcacctaatttgagattgccagct

SEQ ID NO: 21518 - DNA, 601 bp, Human
agcttcagtctttctcaaaatctgtggttgagacagtttgtttcgttattattttcgaggcatagtattccctaaaggcttaagaaatcatttctgcctgctttgaaaaaaaaaaatcttaaacatctaggttaataaatttgatttgcagttgacttctgtagctctgggcccttcctgatcctggcagttgaggcccgaatggctcacaatgaagtagtagtgacttgggaagtagcactatggatgtggtcatcagtctgtgtgtccccattgatctggaaccagcatccagaaacarataccaacatgacagtcactatggcatacccacacacttatttctgtctttgtcctcttcagagtcttctttacctgtctagcacctaatttgagattgccagctccttaggcccaccaatatcataatctccaaaggtaactcgcactaaaccataggtgtaccttattctgttttcagtcctggaatgtgataggcagacaagtcatgaacctgttcttcactttttgctattgtgtgggagaatggcttctgaagtgtacacatgtccatgtgacagtacttgtcagggaactgaac

SEQ ID NO: 21519 - DNA, 601 bp, Human
agagtttctacatctcttttacccagttttccccattaataataacatcttacacacccatactacattttcaaaactaagaaataggtattagtacaatataataaactaaactatagacattattctaatttcaccagtttttacattacttttgggggtgggggattggtagtggatagtactatgaactcttattacatgtatcaatttgataactgctgccagagtccagacacagacttgttctgtcaccacaaaaaaaaaaaacttcctcttgctgtccctttatggtcagacwctcaccccagccctaaccccggcagcctttctccattactataattgtgtcatttttagaatgttgtataaattacacatgtaacatgtaacctcttaagattgttttttgcacacataatactcataacattcttccaagttgttacatgtatccatagcttgttcttttttatggccaagtaatagttcactgtgtccatgtaccacagtttctccattcatcctttgaagaatattttctcctttatatttaaacaaaagtttggaagtaattgtaaattcatatgtagttgtgaga

SEQ ID NO: 21520 - DNA, 601 bp, Human
tggtgtggtggctcatgcctgtaatgccaacactttggaaggctgtaatgggaggatcgcttgaggacaggagttcaagaccagcctggtcaacatagtgggaccccatctttattaaaacatattttttttaaagaaatacagtgagctcttcctgtaagtgacctgagatgatctctgctcagttggcctagaaaacccccaaaatcatacaaagcaagagattcaaatcttcatgtttactttaagaacacccgtggaagtgcccaggccatcaaaggtatgcatatccaaatagccrccaagtacttgaaagatgtcactttatagaagcaatgtgtgtcattccatattattatagtggagttggtatgtgtacctaagccaaacagacgggctgggcacaggatgacaggtggcccaaaaagagtgctaaatttgtgctgtacatgcttaaaaaggcaaagagtaatgccgaccctaagggtttagatgcagattctctggtcattgagcatgtccaggtgaacaaagccccaggatatgttgctgtatttatagagctcaggtcacattaacccatacataaactcccctgcca

SEQ ID NO: 21521 - DNA, 601 bp, Human
gaccaaaatagggagctgttttctatatataaggaatagctatattcttaagttagttgttttggttttttttacatttatcagaattgtcttcctgactaataccaagcagcagttttgggaatgccttggggactgaatattaaagctgtaaatcaatagaatatcttcccatgttcttttgtttggtttggggtttttttgcattttaaattttactttaactttttaggttgttagtttttaggaaattcaccgttgaccaaaatcttcttgaccttttattcaaagatagtctcacttttgcactatgttaaattgtccttagtctctaataagagaataaagaggtaaaatagtctaaaatctcacggtgctacatcattcaagacaatttttgttgacctgccctaattaacaagaggaatgatgtcagcaatataaaatatatagctattaaattttctggttctagagtgcgttttgcatgcttatattattgttaataatattctgcctaatctaatacaattaagattctaaatctgggtttaaattttgtccttactgactcacaaagtgaaattctcaatattcacca

SEQ ID NO: 21522 - DNA, 601 bp, Human
tagtctctaataagagaataaagaggtaaaatagtctaaaatctcacggtgctacatcattcaagacaatttttgttgacctgccctaattaacaagaggaatgatgtcagcaatataaaatatatagctattaaattttctggttctagagtgcgttttgcatgcttatattattgttaataatattctgcctaatctaatacaattaagattctaaatctgggtttaaattttgtccttactgactcacaaagtgaaattctcaatattcaccattaagatctttttaatattgatgtytaatttggtattcattagactaaaagaagaggtggtggtagaggggtatcagaggtatctgatttgcctgtctaaagaggcagaaaataaaagattaagctgttgatgtgaattgaggttgggttatactaagtaagtgtcttttcatgttcttgtcttccctcttaggggtgtatactctcctcattataatacagaaaggactaataccttggacctacctagtttatggttttatttcacttgattgtacatcctcctgaagttgggactgagatatagccatcctcttgtcagact

SEQ ID NO: 21523 - DNA, 601 bp, Human
ggggtgtatactctcctcattataatacagaaaggactaataccttggacctacctagtttatggttttatttcacttgattgtacatcctcctgaagttgggactgagatatagccatcctcttgtcagactgagaaactgaggcaggcagctgaaaggaccatcaacaagttaagggctttggcccttcccttttcatttaataataatccctataactcttagaaaagcattagagcagctgttgctctgcagtcagtggctttgatgtttttagtatggattatttcctaatcttayagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaa

SEQ ID NO: 21524 - DNA, 601 bp, Human
taatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagtatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaact

SEQ ID NO: 21525 - DNA, 601 bp, Human
gttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaargcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagtta

SEQ ID NO: 21526 - DNA, 601 bp, Human
ctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaggcattgaaatgactgtcattaaccacacagtcctggaggcagagatgcagttacctaccctagcttttgatgggttctcttacctgtagtagccttatccctggtcatttggattttcartttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctc

SEQ ID NO: 21527 - DNA, 601 bp, Human
ttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcakgtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcag

SEQ ID NO: 21528 - DNA, 601 bp, Human
atgggtggtccaaacaattgctgcttggggcaagggagctgggttcaggggagtgctcaggtgtttctggtgaccaccttagatacctgaacaaatcactcaaccatctgagaggaaaatttcaggataagaaagaatgcaacacaggaaaaccttagtttctggatttgaatgaaaataacactttatcgattcatctgaagaatgggattcttttcgatctaaaacaagtcccaaatgttcagcactaaactttcagagcagctatgttcatttatgaatcagttttggcctgagaaakaaattgagtaaatatataaaaggactactacaaaatacatttttattttcaatggctactggctttggaagcagctccttaattacagcaaagtttttaatttaattatcatggatttttttttccccttacagcataaggagttggtatgtttctcttgaattacctaaaaataacattaagcctagaggaaaaaagaaaaaaaaaaccaataatgaaggagcagagaaaggctttctctgcagtgctaagactttgtaacactagaaatgaatggcttgcaaaatgaatggcttacat

SEQ ID NO: 21529 - DNA, 601 bp, Human
tatttgattaaaaaactgaaaacataaaagaaaggctttataatgtgtgttttaaaattctaattacacatttatccataatcaataatgttcctggtatcaggaaattgcaataatgctcatgatactcctgaggaatagttaatatttctgttgattaggattgcgactgatttttgattcaccagttgaccaaattttcataaaagcaactcagaaccactgggtcaaatgctatttggggaatgagagtttattgatagcctaaattagaacactgcgatgctgcctgcacataatmtgctaagtactaatagcaggcttccctttaaaaataagcattggcttctggaccctttttctttgtaaaaaggtctgaaaggtcattagcccactgttttgtagtaaacagccatgatattttattacatgtaaatgagttatttttaattaatataagaaaaacaacattggaaagttttttgagtattataataatcaccaaggagcaaaaaaacaaaaaacaaaaaattgagagaggaaaaaaagaaaaaaaaaatggatcctttcaaatttcctaaaaataaatgtgcataattag

SEQ ID NO: 21530 - DNA, 601 bp, Human
gggtggccaataatggccataactttgtttcagtgtgtaaaatctaaaattaaccccaagaatgtaccctagaaagtgttcctcccagaatccaccagtgttcacatcctcaaatataaatattactcagagtctttaattctgaaaaccttgatgtctgctcttctgattattaaaccttgttttctatttgattaaaaaactgaaaacataaaagaaaggctttataatgtgtgttttaaaattctaattacacatttatccataatcaataatgttcctggtatcaggaaattgcaataatgctcatgatactcctgaggaatagttaatatttctgttgattaggattgcgactgatttttgattcaccagttgaccaaattttcataaaagcaactcagaaccactgggtcaaatgctatttggggaatgagagtttattgatagcctaaattagaacactgcgatgctgcctgcacataatatgctaagtactaatagcaggcttccctttaaaaataagcattggcttctggaccctttttctttgtaaaaaggtctgaaaggtcattagcccactgttttgtagtaaacagcc

SEQ ID NO: 21531 - DNA, 601 bp, Human
tgagagttgagtgcatagaaaagggagaagacttcagttcccccaaacctctccccttgagcatcatcaactttggaattaatttacgaagacattaaaaagagttgcatggagattaagccacacaattccccctggggtgtcggcatgacagaagccacctgtggtgacagctttcacaaaagagaggtagctatggggagccatcaacagtgaagtgtcttgacaaaaacacgacagggattttggatgctataatcctttttaaagggggagattattggatatttaaacaaatatyagcttagttaaatgtcagtgtttaaaaaattatctaatatatttgttttgcatttatgaaccacaaacgcagggcaggtgaagggtctggtttacttctattgggagagaatttcataatgagaaggcatgtatgtagtcctctgacagattactcagttggagcatctgtaaggtcaacttaaattgtgtcctttgttcacggtaacagagcgagctagttggggacctttcttgcagtcaaattgtcatgggcctacaaatggaaaattgcagcaggccttgggctcctcctagtttc

SEQ ID NO: 21532 - DNA, 601 bp, Human
attaattaactgaagagagaatgtaagtatttgtaaaactatagtccacgaagttagtgaacaatttatatcagccttttacgaaatattaataatcactttcctctttggaaatgtaacacaaaacaccaccacttactgaattgcaacttggtccacagcactgggttgggtgcattccatgcgctctaactgaaggtaacatgttctttaagcaagtcaaatgccagtacaggagaattactaacaagtgttgatgggacactactcgagaaagatgctgttaacgtgtgccatcttygtcttatcaaagatttcagaaacactgtgggataattattgataatctgggtgaagacctttgcctcagatccaattagcaggacctgtgggtaatttcaggcatgtgggcacattgcctcaaaaccccttggctgtgtagtcttcagtgccttgtttctggtgtctcagccatgagagttgagtgcatagaaaagggagaagacttcagttcccccaaacctctccccttgagcatcatcaactttggaattaatttacgaagacattaaaaagagttgcatggagattaagccacaca

SEQ ID NO: 21533 - DNA, 601 bp, Human
ttaacaactttgaaatgaaggaaagtgctatgcaatcacgaaccgctgagcctatttcaactatgagctaggaagtggtggtagtgtattggttcaatttaaatagttacaactcattaatcagacgatttctgccttaggaaagcagtacaaaatagcgggcggatactttggcatcagagggtactggatttgaatcccaattctactttttactcattctggaaatttggggaaaatctaataaattccccaaattccagtttttctcactgtaaaatggaaatagaaatatccttgrgtaagaatgttaggaaaattcattaaataaagttatgtacgtaggctacctggaattgtgcctggcatgtagtaggatagcagtaaatgatagcgctacagataaaaagaatgctacccaagaaaacacaaagcgctagaccagtaatggtcatcatgtgccacctgagacctagggcttcactagcggcggcttctcaggggctctgctgggaggagctgggcctccatctcggctttgagatcctcattgactttctggatttcactaagcagctttgatttttgtctgttttttact

SEQ ID NO: 21534 - DNA, 601 bp, Human
aggaaaaaaaagaaaagaaagcaaaacagaaattaaattacttacatgcatggctaggatgcttctcgggactaactctcggtattgtctaatggtaaagtgccatgttttgattctcatgagatcatcaaaggtgaactccaagatcagtctgccttctgtacatacctggaagtgacaaaccacacagtcattcattacgcactttgtgaaagccacattttgtaactcacatagccactcagcgtggtctccctttctgtccttgggcagtgctagctcttggtaaagatgtgacacragtgatgtgtccactgcacacggtacaaatgtcagctctaaaatcagtgggttcaagtgactgtacagctgcttattggccatgatgtgctagtaattctactagttactactgaaactctatgaccctcagtttcttcatctgtaaatatggagataaaacccatcttatagtgacattgggtcaaaaagttttcctccactttcatcatccttcaaccatagaggcttgagctcttattctaatcttggttatcctgctctaggacaaagtacccaataaactcattcatggttaagt

SEQ ID NO: 21535 - DNA, 601 bp, Human
tctttttatttatactttgaccatgaaattggggcaagtgtacctaaaatgcgtattctggactattcccattaccagtaggtggctgtggtagtaaaataatagactttggagacataaaaaccttttggtgacacagtcctccttcatttgttagccatgagactggctgtgtcaaattactaccctaagtctcagagtgcactatataaaatggagataatacatttaaagttatggtaaggattcaatatttttgcatgctttattcagttttgtaactcccagtggctagaaccaygtctggagcctaataaatctcaataaataattattgaatgaatgaaggaattaatgaataatatatcaattatatatgcctatgttagaaaatatagcacttgctgagtggattacgttttctccataaagtcttattagcgttaaaagaaaaaataaagccaatttaagcacatttaatatatttgaaaaataatattccaaaagtctaaaattcccataagatggggatgtaactattctacataaaataacacttattttctcagctttctaaatatgtacttgattaaatttgcta

SEQ ID NO: 21536 - DNA, 601 bp, Human
gtgatacgcaccaggggtcccagatactcttgaggctgaggtgtgagaatcacctgagcccggaagtcgaggctgcagtaagctatgattgtgccactgcagtccagcctgggtgacagagcaagaccatgtctcaaaaacaaagcaaagcaagacaaaatcacaccaaaaaaacacctatgccacttctggtggacaatgggaaggatcttcctctaaggctcatttcaaagatcacttagtccaatgagtatccctgacttctttttgacttttctactcacctactatttttttatcrtccctaaatattttgtctcttatgcttaaagattttcatcaaatggtctatcatttccttccatcgagttcagggtgcttgctctgaaggatgagaggaacaggatatagaactgttccaggtcatggagttgaataaagggttgaggaggacattctaaagtccagcagatactcaggcccactcctgacaagtatcttctttctttgaccttaagagtataaatttggtgctctttttatttatactttgaccatgaaattggggcaagtgtacctaaaatgcgtattctggactatt

SEQ ID NO: 21537 - DNA, 601 bp, Human
tgtcttggtaaactgaagagtagactatttaaacattttccatttcttatagctttagaaagaataaaaggagaaaactgtagatgtgtttttagcacaaaatatgtgacactcttttctttgtgtgtagatcaaataatttttatttaatcattctctctaatggtatgtatttaattttgtaaaaatattttttaggtatgtaactacaagtaccactttcataattggatttaaaatattttgccattagaaaatttgggaaacttttttcctctggtgtatcttctctttaaaacaragagaggactcctgggatccctagggtaactaactccaaggtacgagtgaagtatgaactttaaatagccaaattcatgagccagtgtgcaacagcagcatctactggtgaaatgtcatattgcaacccacctctattatacctttatagaattctcaagtaaagtcagttccatcagctgtggatgtggagcttagggattcccaagttcagaaggaatacccatggtttgggccctgctgtttaataaatgctactaattccaaaattgctagaaaaaaatatgtctgagtacatggt

SEQ ID NO: 21538 - DNA, 601 bp, Human
acgccaccaggcatgctgctaagtgatattttaattaaaccttaagtgacatatctcctgtctgtgactctgatggctttttaattcaggtcccattgcagcacgactcttaatattcctttctaattcccagtttgcaggggaaggtttccatggcagagttcctccctcccatcccaacctctgtccctgtcttttatccctcccccacctccaacctgcccaggattttttttttttttctaatgaaaagagactttaatttgggccctttgagtaggaagcagacagttaggatttygggcctaagaggaaagcgagacttacaggtacctgactggacagactcaggtttgcagctgtggtcttcttcttgctgccagtgctgtttgcattgttcccagcgctgctgttggaagtgctgctggtggaatttttcctttttctccgtttggttgttggttgccttgtgggttctgctgcaatatggaaaagggaagagggatcagttctagggcaaaagcaacaaggcaatcatcagtatggttactctaaggaagctgtcttggtaaactgaagagtagactatttaaacattttc

SEQ ID NO: 21539 - DNA, 601 bp, Human
agggacagaattcaagaagaatgaataaaagatgaagaaagttcctgtgcagttttcactatatgggattaccctcagctgtcagctttggaattcaaagaagtccccttcctaatggtctttgtcaagataaagaaatgaaagaaaggggccaagggttcgagagagttgagaccaaaccagaggctgatcctcccccttagctaatgcaatgggctaagcgagagcttcactgagctacatgtttagtggctgctggttaattacctgagtcttaaaataagaggggacgcccatgttgggaaggcccagtcaaattacaatatgggactgagccgctgggagctagtttccagtggagcacagggtctccaatgatggtgctgagaggccttaatacgccaccaggcatgctgctaagtgatattttaattaaaccttaagtgacatatctcctgtctgtgactctgatggctttttaattcaggtcccattgcagcacgactcttaatattcctttctaattcccagtttgcaggggaaggtttccatggcagagttcctccctcccatcccaacctctgtccctgtcttttatccc

SEQ ID NO: 21540 - DNA, 601 bp, Human
cctttaagtagctatatcaccgtttcagaatcctctgagatgcactttttcttatttgctagaggaaactaacgaatgttactgcctttaactccaggattggataaagaaatgggctcctgtgtacactttttcagttgatttatctaaatcaggccattttctctattcaaaatttcaccagaagtgggcataacttgatacttttttaataaagagactctttattttcctcttttggctttttccccctgatcttcagaggtattaggtataaagcctagctcagaaagtggaggamcacctggagactattttcattatttgaagactgcaatttgtaaccttgtaaaatgtaacatggcaccttccattttaggctggtcattctccccatgaccccttctttctaatgcagtgggaatgaaaagtataccccctgtctgtgggagacaggagaagagaaacaatggcccaaggaatcctcagggtactgatggggttggttttggccaaagagaactgaccagtggaaagtagatacaagtaggtgggggcagatgtgaaagacacacttggaagtaagtggggaatccctgtg

SEQ ID NO: 21541 - DNA, 601 bp, Human
ttggaaaacacatgcgtaaggcgtcacagggcaggagaaggatgttaaccaaccaagtgggtctgcattagtatcgtgactccaaagtcattgagagaggatgggagagtatgaggaagcataatttgaaagaggaggaggaaaataaaaagcagccaacttaagcatgatattaaaagaaaagctctcaacactccaaatgcattcattgaattagaaaacaacaatcattgaagaaaagtactatgaacatcgtggtttgaatcatttccaatggagccaacaggcttgtaatctgttyggtgaatctttgttctaggagcagctggaaaagatgtctaggcataggtgtttttaaatgtactaaatttcaaagggatgccacatatgttttactaattatataaaatatccctagctagatacttagttgtgtgtgtgtgtgagagagagagagcgtgtgtgtgtgtgtgtatgtgtttgtgtgcgtgcataattgacaaatggcaagttaagggcttcatatgcacatagacagttaaggccacttaaaaatttatgtgcatgtttctattggttcttctaagcctctagactagga

SEQ ID NO: 21542 - DNA, 601 bp, Human
gagggttaatctcatttcatgacttgtgtccagcacacttgaagggcttggaaaacacatgcgtaaggcgtcacagggcaggagaaggatgttaaccaaccaagtgggtctgcattagtatcgtgactccaaagtcattgagagaggatgggagagtatgaggaagcataatttgaaagaggaggaggaaaataaaaagcagccaacttaagcatgatattaaaagaaaagctctcaacactccaaatgcattcattgaattagaaaacaacaatcattgaagaaaagtactatgaacatmgtggtttgaatcatttccaatggagccaacaggcttgtaatctgttcggtgaatctttgttctaggagcagctggaaaagatgtctaggcataggtgtttttaaatgtactaaatttcaaagggatgccacatatgttttactaattatataaaatatccctagctagatacttagttgtgtgtgtgtgtgagagagagagagcgtgtgtgtgtgtgtgtatgtgtttgtgtgcgtgcataattgacaaatggcaagttaagggcttcatatgcacatagacagttaaggccacttaaaa

SEQ ID NO: 21543 - DNA, 601 bp, Human
ccatctgttatttcatggtgcctgtcacctatcaccacacaggcaaccctgccacccatctgggcagtaaagagaaccggtctgtccagctggtgccataaagggaagatgaagaacgctaattataattacattgatgaagctggtagtcatcagagatggaagcgtgcaagaagaatccatctaatcactcttttaagtacaaattgtccttccatgcaaataagtaagccacctactgtagctgggagcatggggaggccacagctggagaggccagggatggggaagaagaatgcayacacagggcagagctccagcttctttgttcaaaggggaccatatggggttgatgagggaccttggcatgggacaggacatctgtcaggtggattcttctgggcaggctctgagcaatactccacttaaaagtgcagtaacttcaggaaagtgaccaactgtgatcagcctccactgaggccagagaaggtagggctagccagatgcttttggagatgagagggtggggtttccagtagaaaggctaattcaataaaatattttgacaactgggcagaaattcattttactagagctttgc

SEQ ID NO: 21544 - DNA, 601 bp, Human
catattaatgagatcctgagcactgagcatttatggacaatatggccttcgtttgatgcataaaaaggaaattcaacacaaacacgttgttaaaaccgtgccagaagatgcgctagagttttctctcattttaattacaatcagtgccagtatctgtattacctgtgaaggcctccaagaaagggtcatggaagcttattgggaataatcctctcaattagaaaaaaagaaagaagaaagaaaatcagatcattgtggtttagaaatagatatttgcatggaaaagtttttatctcttctstttcctctcctgtaagtaaagatttgcaattgtaatgatcacccacgggcctattgacagtggattctggtgccgatcatcttattgggaagcctggggtggggggttttctgatttggtctcttgagtggcgggaggtttactgttccacgggctgttgttccccagcgcgggtgaattgttgaagtcctcctcgtcgtccatgccgttggccgcatcatattgcgtgttttctaatctagtgattagcctttcgtcctcgtccccaaactcacctcccatcagagttggctctcctac

SEQ ID NO: 21545 - DNA, 601 bp, Human
gggcgcggtgactcacgtctgtaatcccagcactttgggaggctgaggcaggcggatcacgaggtcaggagatcaagaccatcctggctaacacggtgaaaccctgtctctactaaaaaaaatacaaaaaattagccgggcgtggtggcaggcgcttgtagtcccagctactcgggaggctgaggcaggagaatagcgtgaacccgggaggcggagcttgcagtgagccgagatcccaccactgcactccagcttgggtgacagagcgagactccgtctcaaaaaaaaaaaaaaaaaaaaagacctaatgtaaatgacgagttgatgggtgcagcaaaccaaaatggcacatgtatacctatgtatcaaacctgcacatagtgcacatgtaccccagaagttaaagtataagaaaaaaaaaaagagtgtagtgcagtcacccacgcactccggtcattcactcattcattcattcattcattcacaaaagaagcatttatgagttcctgctgtgtgccaggctctggcctaggcactgggaacagtgaacagaacagactcgactcagagctcaaggacttttagtccagttgaggagatc

SEQ ID NO: 21546 - DNA, 601 bp, Human
cagctactcgggaggctgaggcaggagaatagcgtgaacccgggaggcggagcttgcagtgagccgagatcccaccactgcactccagcttgggtgacagagcgagactccgtctcaaaaaaaaaaaaaaaaaaaaagacctaatgtaaatgacgagttgatgggtgcagcaaaccaaaatggcacatgtatacctatgtatcaaacctgcacatagtgcacatgtaccccagaagttaaagtataagaaaaaaaaaaagagtgtagtgcagtcacccacgcactccggtcattcactcaytcattcattcattcattcacaaaagaagcatttatgagttcctgctgtgtgccaggctctggcctaggcactgggaacagtgaacagaacagactcgactcagagctcaaggacttttagtccagttgaggagatcaatcatataattgatcaaataatcacagatttgtggtcgtaagtgtcctggggaaaactcaagcggaagggaagatgggagggtcaggtatatgtctgcgggtggagagtctgcagtttcctagagagtggtctgggaggcctctctgaagaggtgacatttga

SEQ ID NO: 21547 - DNA, 601 bp, Human
cccagaagttaaagtataagaaaaaaaaaaagagtgtagtgcagtcacccacgcactccggtcattcactcattcattcattcattcattcacaaaagaagcatttatgagttcctgctgtgtgccaggctctggcctaggcactgggaacagtgaacagaacagactcgactcagagctcaaggacttttagtccagttgaggagatcaatcatataattgatcaaataatcacagatttgtggtcgtaagtgtcctggggaaaactcaagcggaagggaagatgggagggtcaggtatwtgtctgcgggtggagagtctgcagtttcctagagagtggtctgggaggcctctctgaagaggtgacatttgaacagaaccttagatgaagtgagggagggctcaggggacctgaggcaaagcagagggggccaccagtgcaaaggcgtgaggtaggatcgtgcttggggtgttcaagaaacaagaaggaggctggcgtgacgagcaccaaatgattgagcagaagtggagatgaagtcgcagagtgaactgagagtcagatggtggagggcattttatttcatttatttatttagagaca

SEQ ID NO: 21548 - DNA, 601 bp, Human
cgctggagcctgggaagttgaggctgcagtgagctgtgattgcaccactgctctccagcctgggcgacaaagccacaccctgcatcaaaaagaaaaaaaaaagaaaagaaaagaaaaaagaggcgagatcattaaaggagtgagtcagagaagaggcccttgtgggcttcctgctgtctacaagagaaaaggatgctgagacacgcctgccagtgaggcttcggagatcccagagactcggacacaccttggataagcaggctttctgactgggacctgagtctagctccttggcatcagygtcccatttgtgtgtgtgcttgggtggtttggaggggctgcagctgagagctgactgcagggagaagtgacgctagggtatggcatggccccttgtggtcatcccgtcaccctcctcctgctgggctgggctggagagcgggagtgggggacacctttctttcttttttttttttttttgagacggagtctcgctctgtccccaagctggaatgcagtgctgcaatctcagctcactgcaacctccgcctcctgggttcaagtgattgcctcagcctcctgagtagctgggagtacaggc

SEQ ID NO: 21549 - DNA, 601 bp, Human
cgacaaagccacaccctgcatcaaaaagaaaaaaaaaagaaaagaaaagaaaaaagaggcgagatcattaaaggagtgagtcagagaagaggcccttgtgggcttcctgctgtctacaagagaaaaggatgctgagacacgcctgccagtgaggcttcggagatcccagagactcggacacaccttggataagcaggctttctgactgggacctgagtctagctccttggcatcagtgtcccatttgtgtgtgtgcttgggtggtttggaggggctgcagctgagagctgactgcagggaraagtgacgctagggtatggcatggccccttgtggtcatcccgtcaccctcctcctgctgggctgggctggagagcgggagtgggggacacctttctttcttttttttttttttttgagacggagtctcgctctgtccccaagctggaatgcagtgctgcaatctcagctcactgcaacctccgcctcctgggttcaagtgattgcctcagcctcctgagtagctgggagtacaggcatgtgccaccacgcctggctaatttttgtatttttagtagagatggggtttcaccatgttggcc

SEQ ID NO: 21550 - DNA, 601 bp, Human
ctttggccagcatggtgagtgtggttgcaggctgggcagggggtggtgggcagcctgggctgggatgcaggtgtggccacttgtgctcctgagcccagtgaaggtggcggagcggggggcagggatcggggagcaggtgctgtcaacagcgtccaagggggccgggcgcggtcgctcacacctgtaatcccagcactttgggaggccaaggtgagcggattgcttgaggccgggagtttgagaccagtctggccaacatggtgaaatcccgtctctactaaaaatacaaaaattagctggrcgtggtgacgcatgcctgtaatcccagctactcaggaggctgaggcaggagaatcgcttgaacccgggaggcggagtctgcagtgagccgagatcgtgccactgcccagcctgggtgacagagccaagactccgtctcaaaaaaaaaaaaacaaaaaacaaaaaacagtgttggccgggcacggtggctcacgcctgtaatcccagcactttgggaggccgagacaggtggatcacaaggtcaggagattgagaccatcctggctaacatggtgaaaccctgtctctactaaaactacaa

SEQ ID NO: 21551 - DNA, 601 bp, Human
cttttggggacaggatatttggcattaactatactataggccgggtactgtgcttatgctcatcttccattcacaaactcactcactctgccaacaccccagcagacaggtgcttgttatcaacataccctttccgcagatgagaaaactgagacccggagaagctggctcgcttttgcacagatcttccagctgatgcgtggcaggctggaacttcaatgctagaagtcagtcatgtgataggcccactctgggcctcagtttccagtctcgaaaggatgcctcaggcggggtgcagtgrctcacacctgtaattccagcacttggggaggctgaggcaggaggattgcttgaggtcaggtgtttcagaccagcctgggcaaaatagaacccccctccaccgccatctctacaacaaatttaagagtttagccaaatgcagtggtgtctgcctgtggtcccagctacttaggaggctgaagtgggagaatcacttgagcccaggagttcaaggttacaatgattgcatcactggactccagcctgggcgacagagtgagaccctgtctctaaaaatgaaaatgggctgggtatggtggct

SEQ ID NO: 21552 - DNA, 601 bp, Human
gagaccctgtctctaaaaatgaaaatgggctgggtatggtggctcatgccagtaatcctagcacttcgggaggccgaggcaggcggatcacttaaagtcaagagttcaaggccagcctggccaacgtggtgaaaccctgtcactaccaaaaatacaaaaactagccggtgtggtggggcacacctgtagtcccagctactcaggaggctgaggcaggagaattgcttgaactcaggaggcagaggttgcagtgggccaagattgtgccgctgcactccaacctgggcgacagagtgagatsctatctcaaataaaataaaataaaacaaaaaaatagaatagaacaaaataaaatataaaaataaaataaaaaatgggccaggcacagtggctcacccctgtaatcccagcactttgggagggtgaggtgggtggatcacctgaggtcaggagttcgagaccagcgtggccaacatggtgaaaccccatttctactaaaaatacaaaaaattatccgggcatggtgatgcccacctgtgatcccagctactccggaggctgaggcaggagaattgcttgaatgtgcgagatggagatttca

SEQ ID NO: 21553 - DNA, 601 bp, Human
cgggaggccgaggcaggcggatcacttaaagtcaagagttcaaggccagcctggccaacgtggtgaaaccctgtcactaccaaaaatacaaaaactagccggtgtggtggggcacacctgtagtcccagctactcaggaggctgaggcaggagaattgcttgaactcaggaggcagaggttgcagtgggccaagattgtgccgctgcactccaacctgggcgacagagtgagatgctatctcaaataaaataaaataaaacaaaaaaatagaatagaacaaaataaaatataaaaataaamtaaaaaatgggccaggcacagtggctcacccctgtaatcccagcactttgggagggtgaggtgggtggatcacctgaggtcaggagttcgagaccagcgtggccaacatggtgaaaccccatttctactaaaaatacaaaaaattatccgggcatggtgatgcccacctgtgatcccagctactccggaggctgaggcaggagaattgcttgaatgtgcgagatggagatttcagtgagctgagatcatgtcactgcactccagcctgggcaacagagcaagactccgtctcaaaaaaaa

SEQ ID NO: 21554 - DNA, 601 bp, Human
cgacagagtgagatgctatctcaaataaaataaaataaaacaaaaaaatagaatagaacaaaataaaatataaaaataaaataaaaaatgggccaggcacagtggctcacccctgtaatcccagcactttgggagggtgaggtgggtggatcacctgaggtcaggagttcgagaccagcgtggccaacatggtgaaaccccatttctactaaaaatacaaaaaattatccgggcatggtgatgcccacctgtgatcccagctactccggaggctgaggcaggagaattgcttgaatgtgcragatggagatttcagtgagctgagatcatgtcactgcactccagcctgggcaacagagcaagactccgtctcaaaaaaaaaaaaataaaataaaataaaaattgaaaaaaatgataaagcggcgcctcatcctctcccatcagctatgcctcatggcccatgatgaggtctgtaattattggtgtgattctccttctggcttcctagatgggcaccaacaagtttgccagccagcagggcatgacggcctatggcacccggcgccacctctacgaccccaagctgggcacagaccagcct

SEQ ID NO: 21555 - DNA, 601 bp, Human
aaaaaatgggccaggcacagtggctcacccctgtaatcccagcactttgggagggtgaggtgggtggatcacctgaggtcaggagttcgagaccagcgtggccaacatggtgaaaccccatttctactaaaaatacaaaaaattatccgggcatggtgatgcccacctgtgatcccagctactccggaggctgaggcaggagaattgcttgaatgtgcgagatggagatttcagtgagctgagatcatgtcactgcactccagcctgggcaacagagcaagactccgtctcaaaaaaaaawaaataaaataaaataaaaattgaaaaaaatgataaagcggcgcctcatcctctcccatcagctatgcctcatggcccatgatgaggtctgtaattattggtgtgattctccttctggcttcctagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggtgagtgggggcccccgggacacgccgt

SEQ ID NO: 21556 - DNA, 601 bp, Human
cagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccaytggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaa

SEQ ID NO: 21557 - DNA, 601 bp, Human
cacagaatgccgttcccaagtgcaggcccttgcatgacacagaactttaattacttctacagtggtcagagaaaaacaaggaacttcaacaacaggagtgcagaaataattccagcatggccatctgctattgtgaagggtgcaaggggaaattactccacggccctgctgggagtcccacaatgaacaagaactttatctactggccaagagtacaactgcatgagtcatcactctgatttctttcacgcaatgccaaaggagacttccttttgaaattctcatcagcagccaaataagkacccagctcaaatggacatgcagtgtggcatggacagtaccccttccccagccccgcaaccaacctttcaagaagctacaactgccgagatcagcatcccctctccccaccatttcaaactttctagccactggaaaagaaaaatggtaggaaacattttaggattaaattatgtctgccctgattttcacgaggatcagctgcctgcatgtccatataaggttgtctatactactggcaattctacagatttcagtttctacaccaaacggctctggtgagcacgtcatttttccgggc

SEQ ID NO: 21558 - DNA, 601 bp, Human
ttctggaaagccccagtacagggccccggaatcattctctaaatggcaattgaacaactgggttcacttcattccttggtcaaatcataaatatgaatttactacaagtgctacctgagaaaacaaagttgtcaagccaatctcagggtatgttgagacaggcctgggcctggatattgggccacccggatctcaatctcagctgtcaccaagcctgtctgggactgactctcagcaatttgctctcctactgataagagaagagcctgcatcacgtgatcactaagacccttcccagttstaaatgttctgtgattcctcaccaattatcctagaacatgtcaaggtatttttaaatggcactttcacctaggtatggcatttcattaagaaactgtttcaagcggtatcagaaacaaaggctgcatgagacacggagaagttctcaggaaacactcgctgatcaatgctgctgcttacagagcaggccggtcccactcgggcctcgggccgtcagcatcaaacccacacactccacgctgcccagcaaccctctgtcctgacccttgagtttcatttaggaaaccccagggccgctcga

SEQ ID NO: 21559 - DNA, 601 bp, Human
tccttctttttttgtttttgtttttttgtttttttgatttttctttttttttctaaggtgcagacaccccctccccccaaggaaatgattggtggtcatctcatctcatggtatactccttacacacaaaacattcaaactactttttttccatctcttgcagtcttgctaaccacaaggaaaaaaagttggcctcatcatacggtcagtaatagatcctcaacatacaatcaacccaaccattagcattctcagtgtgcatgctcacggcaaaggcttaggcgccgctcggaagggcggrtaccagtggcgagtccagggtcacccacataccatgcaccacgggtgctatgccacttcttacaggacctttttagccctcaaaagaccttccaaggagaggccctggaggcaactgggtagggtgcagaacggcatgctttggctggaacacgcatccctccttccacggccggctctcagcctggaagccttttagcctacaggatccacctctctgctccctcagaggtgcctcttcatgtgcagggccaggtggtcagacctggaaaaacacctgcaagggcaaatcagaagcaca

SEQ ID NO: 21560 - DNA, 601 bp, Human
tagtctgtatgggaaaactacctttttcagtgtattttgtgaggtaaaccatttgagtaatttcttgatatcctattcacccagctatattcgaattagatttttgttgttatttcgaatatgtaaaattttaaggcttaatttcctccagcttgggaaaatgaagtttattttctttgtttcactttatacttcatccaatggatgttgagacaaatacttaagaaaatatataaaaaaattaactttatcattcaaatgaagattttatagttgactcctatttttttatagttgaccsctatgcttctttaagtgaatatacctgcttaaattttcataggtaattagcatataaatgatatttgaatgtgtttgtgaaaagcattattacagtgttgagagtgggtgcagatgatttttttgggggcttatgtatacatatctatgattgtctgaatctttgaaatttagtttgtcagatatcaagttatcttaatttttttcaagttatctacagggttacctggatagcgtaatagagttaatttagagattaactgtttaatatttataaactcatttgtaatatctctaatat

SEQ ID NO: 21561 - DNA, 601 bp, Human
actgtgtaattacagtaaggaaaatcgaagtgaattttattactcaagtagattgcaaatatttcattgttcaaaagtatttgattaggccattttgacaatatttctgagaagtgttggaagaaatgttgaacaaaatgagaaacagcattttgtagagaatcttggattttaaagttttacttaacatgtgtaattaaagtagcatgctttacttatttagaatatttaattatccattttattttactagaatatgaatgcccagagggtatttgtttgtttgtttcgctcacagatrtatctatccctggaatgtcctttgggatgtatctgtccctgaaacgtcatttggcaaatagttgacactcaagaaatgtttgttgccgaatggattacctgacctgccccagccttcttataactttcccagagtcagtgggggaaaaatacttaaaaattgttttagaattacaaaccagagagtaaattgttaataccttagctataggggagaggtggttagagtggagttagaaagttagaatatttacttagtttttgtttctgtatcattctattacccaaggactggcagtgg

SEQ ID NO: 21562 - DNA, 601 bp, Human
aatacttaaaaattgttttagaattacaaaccagagagtaaattgttaataccttagctataggggagaggtggttagagtggagttagaaagttagaatatttacttagtttttgtttctgtatcattctattacccaaggactggcagtggaagtggggagtagaatgatagtttgtaaggcagtgtttccttaaacaggatgctagatacctccaaagaaatgaacatttgttgagcaggggctataaagtagtctttatgccagattatgtttcatgtgtgttatcttaattttcaygacaactctgggaaatgggtagcattaatccccattttacaaatgaaaggaaaactgaggttcagcgaatttaaaggcagtaacttctcctgattatgttatattactggtgagcaacagatctgggagacggaatgttcttacccaaatttgtctccaaagcctgtgccattgccactacaccaaatggcattcttctctggtgtctggaagggtgctaattataattatattagtttttagctagtttcttttcatggtctatgctagtgtttaatcagtgtccttattggcaaagat

SEQ ID NO: 21563 - DNA, 601 bp, Human
agatttggttcataacactagaattcaccttatgccatccatgaatcctgatgggtatgaaaagtcccaggaaggtaaagaatagcatttaattcttaatcatttgatcatcatatagaatgattattttgatggagaagagaatttgaactggttcttttggaatttcttccaattttttttccttttaatttatgattgattttagctcttgtattcttatatgatgatctggtctgttcaacaattaggtgatcaaatttatatatttagtggtgtcttccacttggtaatggttctwatttactagaaatagagtataagacttttataaattgttttattttagcaatagttctgttgacaaagagtcaaactctgtaaaatatttgaagagatttattctgagccaaatatgagtgaccatggcccatgacacagccctcagacccagaggacatgtgttcagggtagtcagggtgcagcttggttttaaacattttaagaagacatgagacatcagtcagacacatttaagatatacattggcttggtccagaaatcgggcgagggttgaaagatttattatcaatcgaaagga

SEQ ID NO: 21564 - DNA, 601 bp, Human
agactctgtctcaaaaaaaaaaaaaaaacaaatagagttcccctctgatcagtaatttccactcaacattgtgataatgtcattatatgtggattattgacacttaaacagtgctttaatataatttgtctaattggaatatttttcctcccagattatgagcagagggcaaaaataaaaagataatggttttacctctctgttcaaaatatctggaagagatacagtttttaaacacgcaatgtgaaaaagatgtgttttaactgtaatgcctggccaggtgctgtggctcacgcctgtmatcccagcactttgggaggccaaggtgggtggatcacgaggtcaggagttcgagaccagcctggccaacatggtgaaacctcatctctactaaagatacaaaaaattagctgggcgtggtggcgcacacctgtaatcccagctactcgggaggctgaggcaggagaatggcgtgaacccaggaggcagaggttgcagtaagccaagattgtgccattgcactccagcctgggcgacaaggcgaggctccgtctcaaaaaaaaaaaaaaaaaaagaggtaatgcctgacaggttcttcctg

SEQ ID NO: 21565 - DNA, 601 bp, Human
aaacagtgctttaatataatttgtctaattggaatatttttcctcccagattatgagcagagggcaaaaataaaaagataatggttttacctctctgttcaaaatatctggaagagatacagtttttaaacacgcaatgtgaaaaagatgtgttttaactgtaatgcctggccaggtgctgtggctcacgcctgtcatcccagcactttgggaggccaaggtgggtggatcacgaggtcaggagttcgagaccagcctggccaacatggtgaaacctcatctctactaaagatacaaaaamttagctgggcgtggtggcgcacacctgtaatcccagctactcgggaggctgaggcaggagaatggcgtgaacccaggaggcagaggttgcagtaagccaagattgtgccattgcactccagcctgggcgacaaggcgaggctccgtctcaaaaaaaaaaaaaaaaaaagaggtaatgcctgacaggttcttcctgcctgctgcacaggcaaaacagttcattgagaccatggtatcgcagtaaagagtttaattaatgcaaggccagccacgcaggagaattggagttatcactcaaatc

SEQ ID NO: 21566 - DNA, 601 bp, Human
tggccaggtgctgtggctcacgcctgtcatcccagcactttgggaggccaaggtgggtggatcacgaggtcaggagttcgagaccagcctggccaacatggtgaaacctcatctctactaaagatacaaaaaattagctgggcgtggtggcgcacacctgtaatcccagctactcgggaggctgaggcaggagaatggcgtgaacccaggaggcagaggttgcagtaagccaagattgtgccattgcactccagcctgggcgacaaggcgaggctccgtctcaaaaaaaaaaaaaaaaaaagaggtaatgcctgacaggttcttcctgcctgctgcacaggcaaaacagttcattgagaccatggtatcgcagtaaagagtttaattaatgcaaggccagccacgcaggagaattggagttatcactcaaatcagtctccctgaaggctcagaggttagggtttttcaaagatagtttgatggacaagggactagagaatgggttgattggttggggatgaaatcatagggatgtggaaaacagtccttatgtgctgagtcagcttctagttgggaaccacaggaccagctgagttacaac

SEQ ID NO: 21567 - DNA, 601 bp, Human
gtccttatgtgctgagtcagcttctagttgggaaccacaggaccagctgagttacaactcactcactggtccaggtgacgtcagctggttgtcagaaatgcaaaagtcagaataacatctcagaaggccaatcttaggttctacagtagtgatgttatctacaggagtagttgaggaagttacaaatcttaacaacttccaaaacaatgactggttatcctttaattacacatacatgttagccaaattcaggcccctcttataatcccaaccttgtgacctttcattagttttacaaagktggtttagttttgggaaaggttgttatcatccttgctttaagattaaactgtaagctaaatttctcccaaagttagcttggccgatgcccaggaatgaccaaggacagcttggaggttagaagtaaggtggagtctggctgggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaa

SEQ ID NO: 21568 - DNA, 601 bp, Human
ctacagtagtgatgttatctacaggagtagttgaggaagttacaaatcttaacaacttccaaaacaatgactggttatcctttaattacacatacatgttagccaaattcaggcccctcttataatcccaaccttgtgacctttcattagttttacaaaggtggtttagttttgggaaaggttgttatcatccttgctttaagattaaactgtaagctaaatttctcccaaagttagcttggccgatgcccaggaatgaccaaggacagcttggaggttagaagtaaggtggagtctggcygggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaattccagctacttgggaggctgagatgggagaatcgcttgaacccgggagatggtggttgcagtgagctgagattgcgccactgcactccagcctgggtgactgagtgagactccatctcaaaaaaaaaaaaaaaggcgga

SEQ ID NO: 21569 - DNA, 601 bp, Human
taaactgtaagctaaatttctcccaaagttagcttggccgatgcccaggaatgaccaaggacagcttggaggttagaagtaaggtggagtctggctgggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaattccagctacttgggaggctgagatgggagaatcgcttgaacccrggagatggtggttgcagtgagctgagattgcgccactgcactccagcctgggtgactgagtgagactccatctcaaaaaaaaaaaaaaaggcggagtcaaccatgtcagatttcttttactgttataattttgcaaagacagtttcataatcataggtgattgataatagcgaagcctgatgtgttcacatttgccttgagttaaggtatctaaagtagtacgtgttggaataaaatataagtgaacatggcttatattcaaatcctttatcatatcatacaggagattcaataagtgta

SEQ ID NO: 21570 - DNA, 601 bp, Human
ctttaaatgggtgaattgcatggtatttgaattacatcagtaaaactactaaaaaaaaaaaaaagtgacaagtattagcaccaggggcaatggggaagaaatttagtttcaacatttactggaatatccagaagtaccatagtggagacttcatgtcatatagagtagcctgccattttagaatgacagtacatactgatggatatttagatttaggaggttaattgagattctccaaaaattgctttgaaagattgccaatagtagaaaaaagtacttctacagttggtaatcatatatkgttctcaaagagtcaaataagaactatgaagttataccctggttggcaaaataaattttttgttttcttttattatattttatgtgtttaatgctatgtttgataaaattcacttatttagagctttaaaaatagtctcataataaatcacacatcatgttggctaaatctggaaagttaataatagttacattccagtgaaaataagtcacagatttacagatgtggtgtccagaccttggcatggtgagaggtaggaatcttcagtcatgcagacatttttctttccatgacatattt

SEQ ID NO: 21571 - DNA, 601 bp, Human
taataatccatcttgaaacagacaacatgatacattttcctcttttcccttataggttctttggtggttaactacccttttgatgatgatgaacaaggacttgccacatatagtaaatcaccagatgatgctgtgttccaacaaatagcactttcttattccaaggtaggcttgtctttgaatataaaatgttacaaaattaattcttttatttaaaaatatgctttaaagtcctgcaagactcaggtcaagtgcttccatagttaataaagcatgactttttcagctgtttccgaaaaayagctttttctcctgtttcccacctcacttttgaatacactacatgtctttctccattggccttttatctatggttttagcacagtacctggaacatatacatgtcaatttatttcatttgacaaataagttataagcccagtaaagtaggccaagataagggcttaatgaattatagctctggagccaaatcttgcccaccacctgtttttgtaaataaaattgtattgacacacagccacagctatatttttatatattgtgtgtggctgctttctccttcaacatttcaaagtaagtc

SEQ ID NO: 21572 - DNA, 601 bp, Human
catatgtgtgctctccaacttcagctgaaccctcagtcctacatggcaacatttcctgtttagctacttgactccctggctcagttcccactatggtgattcagagcctttatcctctatctgagcctcctgttccagctctatccctcttattcatagtagatcactttgcattgaactcaagtagaactttgagtaatctgatgtgagttcactaagattctgtcttctcaattgtttctcatgtgtgtcttaacaatattctcctccatttcttgatcccactgcattctgcctcctsgaatcttgtgtcttcatatcttattttataaatgaggaaggtgataattaaactccccagtcttcactcacagccttttttctcttggtcaataagcagctcctctaaaaatattgtcttctgctaaccttagtaagcccccatgaagctaccattcaaagtttctttatttttactcttcaaaacttctcaaaagtagatagtcttgggagacatctgagcagccaaagacaatgatggctatgtgataacctatctcccagggtttttctttaaacaatataaaacgacttaaaaact

SEQ ID NO: 21573 - DNA, 601 bp, Human
ttattcataatagccccaaatggaagcaaccaaaatgtccatcaactgatgaatgggttaacaaactgataagtagacatacaaaatcatacagtggaatattattcagccataaaaagtaatgaagtaatgatacacagtacaacttgaatgaaccttaaaaacctactaagtgaaagaagtcacaagagactacatattgtatgattcagtttatatgtaatgttcagagtaggcaaacccatagagacagaaagtagattggtggttgcctagggtttggagtgggggtggggagtargggttggggaaaaatggagaatgctaataggtatagagtttctttttggggtgatgaaaatgtcctaaaatttattatggtgggtggttatacaactctatgaatactaaaaaccattgaattgtacactttaaatggagtcaatgtgtggaatgtgaattatatctcaataaagtggattttgaaaacctaaagaagactgaggggtggaggatccattctgtattcgtatataagttaaaaaaatgagatctaaaagttatataccaagcccggtgtgatggctcacacctgtaatct

SEQ ID NO: 21574 - DNA, 601 bp, Human
ttttgtttttgttaggacagagtcttgctttgtcacccaggctgtagtgcagtggtgcaatcatggtttactgcagcctcaacctcctggggtcaagctattttcccatctcagcctcccaaggagctggttctacagacatgtagcaccatgtgtggcttttttttttttttttttttttttgtagagatgaggtctcactgtattgcccaggctggtcttgaacttctgagctcaagcagttctccaaccttggcctcccaaagtgttgggattacaggtgtgatcttacctgtccctktttatatattttaaatggttaattctctgtggtagaaaaatgggaaattattctttttctcttcacactttcagtactttttttctgtttcaaaaagagataaatgaagttttgaccatctttcaaagctcaatttcttctaggaaactccccctgccactctcatcagatgtaatctttctctcctcttgctttcaatggcatgcatttgtgtctccatggcagtttttcttacccttcattgagttatcagttggacacctactgtatgctagatgctgaggacacagagacacaaac

SEQ ID NO: 21575 - DNA, 601 bp, Human
ggtcactttttacccgtgtttaaaaaagaccagcataaattggatacacacctaatcattggccaagtgatagaaagatgggctgtggagtgaatgtttttattctttttcttgttgccagtgatttactgtgaaatgattaatttccttttgtttggatatgtgtggtggccagtaggtaaagattataagaaatatactaatgttaattaggataatcagactaatactttctgccagtacatttctgcatttttctttttcctgagtggtgtgacataaagtctgtgagtttttttttactatatttaaagacattttattctgaaaaattttaaatatacagaaaagttatgactagccaataattattcctatacctagatttaacatttttaacattttgttatatttgctttattttaatgtaaattttatttacacactcacatacacatacatatttttgactgaactattgtaatataaattgcaggtatggtattttacccctaaatatttcagcatctatctcctaaaaataaggagctactacatactatctctaagtgctactgtcctacccaagaaaattaacagt

SEQ ID NO: 21576 - DNA, 601 bp, Human
tggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatrgattgctgcgaagtttagggctggttatacctttgactctcctttagtggcagatagagtacacgaaaaaaaaaaaaaggaaagattcctggggtaaatattctagttattgcttagttgactcattgtgacatgcttccaacctggacattaaacaagacattttagaatacacatcaaatcctgatcctcatggccttaggttttttatttaaaaggagagttaggctgaagtaattctacagtcagttccaattcatagtagaatttattggaaatgtgttcaagatagtttttcct

SEQ ID NO: 21577 - DNA, 601 bp, Human
atattctagttattgcttagttgactcattgtgacatgcttccaacctggacattaaacaagacattttagaatacacatcaaatcctgatcctcatggccttaggttttttatttaaaaggagagttaggctgaagtaattctacagtcagttccaattcatagtagaatttattggaaatgtgttcaagatagtttttcctttaaaggagtaacagaagtgttagttgatgaagcacaaagaacatagaaaatgcatagaaagaacatttctcgttcttttaatttgctaaatacaggyaagcccaaagcaatgcagtctatttaacatgctagtaacttttttttttttttttttttttttttgagacagagcttctctctatcgcccaggctggagtgcatggcactatctcagctgcctgcaacttctgcctcctgggttcaagggatgcttgtgcctcagcctcccaagtagttgatattactggtgtgtgccaccacacccaactaatttttgtatttttagtagagacagggtttctcttgtagttttcttttttatcttttgataagtatagatgttaccacaggatatttt

SEQ ID NO: 21578 - DNA, 601 bp, Human
ctcaaaaaaaaaaaaagaaaaaaaagagttttatggatcaagctgccatatttcagtcattgatgcagtttattttttatggtatgaagtaggagttcaacttcgtttgtttgtatgtagaaattcagttgtgtcagcactatttgttgaaagactattctttccccactgaatggttttggtatccttcccaaaaatgagtttaccatagatgtgtggatttatttctggactctcaattctattccattggtctatatgtttgcctttatgccagtatcacttttttttttttttttttggttgttgttttccttttttttaatttattttttatttatttttatttattatttattatttattatttatttttttattatactttaagttttagggtacatgtgcacaacgtgcaggttagttacatatgtatacatgtgccatgttggtgtgctgcactcatcaactcatcatttaacattaggtatatctcctaatgctatccctcccccgaccccacaacaggccctggtgtgtgatgttccccttcctgtgtccatgtgttctcattgttcagtccccacctatgagtgagaac

SEQ ID NO: 21579 - DNA, 601 bp, Human
aaagagttttatggatcaagctgccatatttcagtcattgatgcagtttattttttatggtatgaagtaggagttcaacttcgtttgtttgtatgtagaaattcagttgtgtcagcactatttgttgaaagactattctttccccactgaatggttttggtatccttcccaaaaatgagtttaccatagatgtgtggatttatttctggactctcaattctattccattggtctatatgtttgcctttatgccagtatcacttttttttttttttttttggttgttgttttccttttttttaatttattttttatttatttttatttattatttattatttattatttatttttttattatactttaagttttagggtacatgtgcacaacgtgcaggttagttacatatgtatacatgtgccatgttggtgtgctgcactcatcaactcatcatttaacattaggtatatctcctaatgctatccctcccccgaccccacaacaggccctggtgtgtgatgttccccttcctgtgtccatgtgttctcattgttcagtccccacctatgagtgagaacatgcggtgtttggttttttgtc

SEQ ID NO: 21580 - DNA, 601 bp, Human
ctgccatatttcagtcattgatgcagtttattttttatggtatgaagtaggagttcaacttcgtttgtttgtatgtagaaattcagttgtgtcagcactatttgttgaaagactattctttccccactgaatggttttggtatccttcccaaaaatgagtttaccatagatgtgtggatttatttctggactctcaattctattccattggtctatatgtttgcctttatgccagtatcacttttttttttttttttttggttgttgttttccttttttttaatttattttttatttattattatttattatttattatttattatttatttttttattatactttaagttttagggtacatgtgcacaacgtgcaggttagttacatatgtatacatgtgccatgttggtgtgctgcactcatcaactcatcatttaacattaggtatatctcctaatgctatccctcccccgaccccacaacaggccctggtgtgtgatgttccccttcctgtgtccatgtgttctcattgttcagtccccacctatgagtgagaacatgcggtgtttggttttttgtccttgcgatagtttgctgaga

SEQ ID NO: 21581 - DNA, 601 bp, Human
tgtgggcagacaataagagatctcttcttagtatgttagtggaggtgagtcttttccttttaactagaggcaaactcccaggaatatgttcagtgaaaacctttatcaaaacattgtcttttaccaaaaatgtatattatttattttaaatttatatagaaagaagagttttggtcattttatgtttcctaaatagatgccatttattcacatctctggaatctgctataatttaggtaatttgaccttgcaagatgctgcaagttctttaatttgaatatcacagagttactggagtcartataccatggtgggaaggaaatcactcaaggcattagaagattgggttctaatgcttcaggctatgacaatatcagagttctcttttatttccagctctgtgagcctgaatattgaatgaatagcaaacaaggtcagagtcagtggggagggaagagaagaagcaggccatacagagtttgatacttgtttgtgtgtggtttttgttttgtttgtttgtttggttggttttggtcatgcctcaagctagtgcctctaccatgtctggcattatgacaacataaatttatattttaaacat

SEQ ID NO: 21582 - DNA, 601 bp, Human
aagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaaygtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatg

SEQ ID NO: 21583 - DNA, 601 bp, Human
ttgaaaacatttgttaggtgcttataatgtcaaagtagttttacccaataaagaaccaaaacttccggtaagtttaattgagggttttcagagaaattcatctcgtttaccctcctcttcttttttaaaaaattactgttttgggtcaccatccaatttttatagcggccaaacctcccacaggcagcagcaacaggcgcttaaaacttgtgaacattttaggtgttggtaacaaatacaattttcaggtgccagagggcacatgtgatcttttacacaaaaatgcctctgacccacaatyggtagttcatcttgaattgtctcttctgttagtgatcatgaataatagataaacatttattaggtgagtgactgaagctaggggatgtcctctgtgactgtgagagtttctctctgaacaaagttagttggaccattcctgattgaacttctgaccttgatctcgttaacacctgctctaaggaaagattaaagggaggcagcctgccagctgcatcctttgctgtctgggcagacactacagagatggcccatatatgggcctagagatctgtacattttagaatttaaaaatgatcaa

SEQ ID NO: 21584 - DNA, 601 bp, Human
atttagccaagatcctaatctaaactttagccattgaaatgttgattgattgcaactttactgtaggtttaagctgattaaagaaagaagatgtgtagtttttttctatgtaaggctaacttggactggatattgactgtaggatggagattgtcttttgatagctggatgaagtcttttatgtctggatcctcattattacctgtagggggagaattgatcatgcatcataaagttgatcctgtcttccctgtatttgcttcctaggacctaaaacctagtaatctagctgtgaatgaacactgtgagctgaaggtaaaatgaagagacagtattcattgtttgctttactttgagattatatgtttgactaagcaggcagactttcttagggagtagctttgtgagccatgactatctgaaattcgtattatttttattatcagactttgaaatttaaaccatttctgagtaagctaagtgacattgaaagtggcatcacttgtttttattttaacataaagttaaattataaatttgatatattagtcataataaaggaggataatagtcaaatatcaagtaagtaggcccaaagagg

SEQ ID NO: 21585 - DNA, 601 bp, Human
gtaatttttcttatctgcatggccagtcactggctacgtgcctagttactcatgtcattcacagaagtgtactgtagcatgcagctgtgggctctcgggtagggggaatggagggtaggtttttttgtctgtttgggggtggctttttgacctttttaaaaacttgagttgaaaattattttttgcactgtatgtttaacaatgcccttgactaggcatctaagatattaaccagcttcagcagattatgcgtctgacaggaacaccccccgcttatctcattaacaggatgccaagccaygaggtgagaacaaagagactgtacagggatgtcgcactgagaagccacattctcattttattgccaccgtataaccaacagttcttaacatcactggatgcttgcatgtgccttgaggcctgcctatgtgctattgcaagatgttgacttttgggataaaatgtcatccagtcctgtgagattgggaatataattagtaagcttgtaaatggaaaattgttatttttatatttggttgtgtgaatttagtgcttgtgaggcggtttctttctaggtgctctgcctgtagctagggtgtgc

SEQ ID NO: 21586 - DNA, 601 bp, Human
gactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttgaatcttggaaggtgataaatacggcttttattatctatttgtgttgtcagatttttttttaatcacatgagatgattgtatgtttaaatgatcacagaacttgggattgggggaatgggcaggtacagtggagaaakgagagaaagtaatgggaatgttgagagaaaagattggtgaggcaggaagaagcagatacagaagaaagctgtaacttgctcacaactgctgtggatttatggtgtctctgagtggaggacagaaaccactgaagtgcaggtgggtgtttagaggagccacccaggagctccctgcagggtgctctgctctaacggtagctgccgttgctacagatcctgtcgtcttccacactcatgaacttttcccctctcctcttctttctctgccctcagaggcataaccatcctctcctgtttgtg

SEQ ID NO: 21587 - DNA, 601 bp, Human
tatttggttaatgggcacgctagaagcccagtccccatcagtccgtggtgagacccatgtaacaaatgtgcacatgtacccccaaatcaaaaataaaataaaaaaattttaaaacatagaaaatacagatacacacacacacacacacacatacacacataaaggagaagagggctaatatatcctagagtaggtattttggaggagagttctttgtttggatatgaagggtcaaaactatgtttgctcaataaggcatacttttttgtaacatgttaaaaactcttttccttcctgtctmtggtactgatagctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagtaagtcctaagggtaggattaacatcttgaaccactaaccaaaagcggtgggaaaaataaaaactgaatggtcataaccaacttgctaaagcttgtagatgaggtctctaatg

SEQ ID NO: 21588 - DNA, 601 bp, Human
cagcccctcacataggagttttgcatggagagttgaggttttcagagtcattgcatttacaacatctctctgagcttttacagttttacaattagtagaactggggcaaagagaatttatgtcttatcagttaacttagaactagttagggacatagccaggaatggaacccatgtatcctgtgtccagtcccatattctttccacaaaacacaagttcagaactctagttaaatcccaagagccaagaccatctgttgctgtagcttgtgagagtgctctttcattcttgagcacctccrtagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaag

SEQ ID NO: 21589 - DNA, 601 bp, Human
gcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtc

SEQ ID NO: 21590 - DNA, 601 bp, Human
gcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccrgagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgc

SEQ ID NO: 21591 - DNA, 601 bp, Human
gtcgggtccgcggcctgcgctgtagcggtcgccgccgttccctggaagtagcaacttccctaccccaccccagtcctggtccccgtccagccggtgagtctgaagtcgtcgctgctccgagtcccttgtcgctgggagcggcacatggggtctccggactttgatgtgggggcgggggaggaagcgaccaggtccggcacgaaggagggagaggtggcctgaggagcggaggggggatgtgtggattccggtgaaagggacctgacaatcgcccccaacccgtgagaaaaggaggagcccrgttcttgcttgagaatgataaacttggaaacccttgggaaaggcgtgggggtcatgcagagacttgtattggtagggagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggt

SEQ ID NO: 21592 - DNA, 601 bp, Human
gagcctgagtcgaggtccctgccggagttgacacagaggagagagggccctggccttcgggagctccagggatgtgggtcgggctggtgggtcaaagtatctgttggcttctttcaagtggtgggaccccaaagaatgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgmgctttactgacactgttctttttctagctgacgtgaagatgagcagctcagaggaggtgtcctggatttcctggttctgtgggctccgtggcaatgaattcttctgtgaagtgagttctcttcaacctccctacttgccagcttcacatatcttcccaccagacgttccttcacatattccacttctacactgttctcttacatgctatttgaaaacttcctatcagcaaagagtcccccctataaaccccgacgaacctgtgctaaagtggcaaaactggggcccaagtcctgagtctg

SEQ ID NO: 21593 - DNA, 601 bp, Human
atgtttaacttcaaagaaaaggggctgagatgtaaattagaggagctggagaggagtgcttcagagtttgggttgctttaagaaagggtggttccgaattctcccgtggttggagggccgaatgtgggaggagggaggataccagaggcagggaaggagaacttgagctttactgacactgttctttttctagctgacgtgaagatgagcagctcagaggaggtgtcctggatttcctggttctgtgggctccgtggcaatgaattcttctgtgaagtgagttctcttcaacctccctacktgccagcttcacatatcttcccaccagacgttccttcacatattccacttctacactgttctcttacatgctatttgaaaacttcctatcagcaaagagtcccccctataaaccccgacgaacctgtgctaaagtggcaaaactggggcccaagtcctgagtctgccaccgtccagcaatataacgttgggctagtcaatttgtgtctttttcttttttttgagactgggtctcactctgtcaccgaggctggagggtagtggtgcgatctcggcttactgccacctctgcctcccaggt

SEQ ID NO: 21594 - DNA, 601 bp, Human
tctaagaaaaagattgctgtatctacttatccttagaaaagaaaagccaaagcttttatgggagagagtgtaggtgaactagggagagacacaagtacttctgctgagttgggagtgagaaacaagcacaacagatgcagttgtgttgatgataaggcatcacttagagcattttgcccaggtcaaagatgaggattttgatatgggttccctcttggcttccatgtcctgacaggtggatgaagactacatccaggacaaatttaatcttactggactcaatgagcaggtccctcactaycgacaagctctagacatgatcttggacctggagcctggtgaggcaccctcagggttgttttgtgtgtgtgcgtgcactatttttctcttcaaatctctattcacttgcctgaattttgaaatttcctttggttctctgatttctttaaccccaaattcatgctttattttgatcctccacctgactcttgtctagttttgtgacgtatatcacttgttctcatgttttctaaatccgcaattcagacctcatgcgtttcctcatgggtctggtttgttgtctgtttctcctgctttgcac

SEQ ID NO: 21595 - DNA, 601 bp, Human
gagcaggtccatagaggagctcaggtggggaggtgggaatgcaggtgactggcagggcctggatggggctcatgctgctgcctctctgacctctgccctggcctaggctctacggtttcaagatccatccgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttatygtggtgggaatatgaaataaagtagaagaaaaggccatgagctagtctgctggtgcttgctgttggggaagggaaggtgatggtgtgttggactccaggggccctcatggcccagcccaccctccccagattgaaaaccaggacagatttgtgctcagtggattgggtggtgtttttagtatggagcagaacagaattcctaggactgcgtgtgatgaaatgcaaggtcaaaaggaaaagacaaagcatatttcaaagatgagaaatatttgtttggatatctatgactgtctgtttata

SEQ ID NO: 21596 - DNA, 601 bp, Human
tctaaaggggccgtcttacttcttttgccaggcacctggggccggcagtgcggggtccccaaaaatccagattcaaggtttcctggacatcagcaggctgggtgccgatcgtgtggcgcgtcagagtccaggtcaccctcactccagatgtcacctttcaggccatggatatcccggcagggccccacacccagcaggccagtgatgccaccaaagccaaattcagcctctcagctacttcttccagaacagccaacaccccaggccagagttggcaaggcccgcccgttcctgcaggttmtaggcctctccaggctgcagcctgggcctggccctatcctgtgagctcctgggggcccagcttcttcgtctgtcttcagggaaaagctgctctgaatcactgatccctggctacaagtagaagccagaccaacctagttctcatcacggaggagcctgtgggtctcctgagcaaacaagaatcaggaaagctgcccaaaggctgctcactgctggaccaaagccaggccgcgggcaatgccgagaccgcccgtgtgaagaccgccgcgcaactggggccgggggaagcaccttactccac

SEQ ID NO: 21597 - DNA, 601 bp, Human
tgaaaccagcttcttcactcgccatcatgctgccgagatcacccagggtgtggcagggacccagcgttcatgcctgttgctgaggaggacaccgagggaggtggccagcatttgcctggccactcacccactgaaggacagccggtggggggcgtccttctggtttgggctatggtgagttaagctgctagggagcatgacgtgcaggtctgtgtgtggacgcgcattccgagtctccgggataaaggagtgtggccactgggctgcattacaagcacgcatctacccgtgtgagaaaccrtgaagaatcttccagagcgaacgccccagcagacgctcccggcagaccacgcgcatttttaacatcagattttcttccgtccattttggaaagggttttgctgtcatcatcacttccaaccccttccctctcctgttctgaagtttctgcaagagcgacccttcctcatctcgccctctcccgcgttctctccttccctcctgtccgctgccgcctggtcagctggtaaacccgcccctcagttccaccgatcagcttcgccgttttctcagatccgcatctcattttctcccctaacgc

SEQ ID NO: 21598 - DNA, 601 bp, Human
ttcttacgtgtgcatctttaatacaaatccagcttcccaatgagaaaaccgtacctaacaaagggcactgtccaaaccgagctggtgccacacaactccctcaggtgtgcaccacgggcagttcacccacagccccttgcatgcgtgtggacatgcccacgtgacgtgccaacgtgcccatgtgccgattccagacaccggcctgccggcggcccccccacctacaccccgggccactgtttccgtcacgctaatcctatcacctggggatgaagagatcatacagtgtgcaccccttgaraccagcttcttcactcgccatcatgctgccgagatcacccagggtgtggcagggacccagcgttcatgcctgttgctgaggaggacaccgagggaggtggccagcatttgcctggccactcacccactgaaggacagccggtggggggcgtccttctggtttgggctatggtgagttaagctgctagggagcatgacgtgcaggtctgtgtgtggacgcgcattccgagtctccgggataaaggagtgtggccactgggctgcattacaagcacgcatctacccgtgtgagaaaccgtga

SEQ ID NO: 21599 - DNA, 601 bp, Human
taacaacatagtattaggtgaaagcattctcactacaggaatctgaacatggctggggcaccccatgccccgacctccaccacgtaccaggttggcctgtgctcagctgcagggccagagctgctagcatgtgcgctttaccacgtggcggccacgtcatccacaggtccacaggccagggtgccacagcggctcgtcagcctcagggtctaccttcctttccccctcgtggctgccacgtggctgctccaccccgcctgttgcattggtctcccacggagaaagtctgcaggaggtgggygcagccaggtgtgtccctttagatcggggcccagcagcctcccagaaaccacctcaagccaacacccactgatgtgtcccctccaccgccaggggctcagccccactctgctcagtgccctcaactccagtgctcagagcaggctggggaaagctgggtgcccaggaagctcggctgccaccgggctggaaacagaccccaggacgctcctggtggcagctggctcttgggggtcaggaaggggcccgccaagcccacctcctgccatgcagttctgccacctgcttctgtgctcaggac

SEQ ID NO: 21600 - DNA, 601 bp, Human
atgcgccggccaagggccctcctttgggctccgggcgcgcccacccagctgagctgtgaagcgcaagctgcctccccgacgaggctttcatcacttgcctgtgcacgattcttaatacacttttttcaggtccttgcccttttccctactgaatacaggtttaacaacatagtattaggtgaaagcattctcactacaggaatctgaacatggctggggcaccccatgccccgacctccaccacgtaccaggttggcctgtgctcagctgcagggccagagctgctagcatgtgcgctttrccacgtggcggccacgtcatccacaggtccacaggccagggtgccacagcggctcgtcagcctcagggtctaccttcctttccccctcgtggctgccacgtggctgctccaccccgcctgttgcattggtctcccacggagaaagtctgcaggaggtgggtgcagccaggtgtgtccctttagatcggggcccagcagcctcccagaaaccacctcaagccaacacccactgatgtgtcccctccaccgccaggggctcagccccactctgctcagtgccctcaactccagtgctcagag

SEQ ID NO: 21601 - DNA, 601 bp, Human
cacattcggaggagacagcgatcagattcacatgaatatgacgaatattcatccgcgcagccttaaggttgcttcccgcatcggctcttccgtgatgaaaatctatctcatctaggtaagttcggagaagccgaagcatgcgccggccaagggccctcctttgggctccgggcgcgcccacccagctgagctgtgaagcgcaagctgcctccccgacgaggctttcatcacttgcctgtgcacgattcttaatacacttttttcaggtccttgcccttttccctactgaatacaggtttarcaacatagtattaggtgaaagcattctcactacaggaatctgaacatggctggggcaccccatgccccgacctccaccacgtaccaggttggcctgtgctcagctgcagggccagagctgctagcatgtgcgctttaccacgtggcggccacgtcatccacaggtccacaggccagggtgccacagcggctcgtcagcctcagggtctaccttcctttccccctcgtggctgccacgtggctgctccaccccgcctgttgcattggtctcccacggagaaagtctgcaggaggtgggtgc

SEQ ID NO: 21602 - DNA, 601 bp, Human
agggaaggttggagcacctcggctgcaggaggcagggaggcatctacccggaccacagaggaacaggtgtgtgtaacactcatcagttcatggacagggctgatggctgccccgggcctcctgggagggctttgaggctgcatgcatgcagacccctggtgcaccagacgcagtgtggacggggtgacccctggtgcaccagatgcagtgtggacggggtgaaccctggtgtaccacacttgaccagacgtagtgtggacggggtgaggccacaaggacagcatgggcaggcagaggccarcagtgggcgactggtgcacagctgtggtggaggcgagcggtgcggccaggaagacccctgcgctgcgtggactggagatgggcgcccacacaccaaggaggtgcttcgggcagcctggcaaagcagccgcagctaagagagagtcacctgcagatgaagcttcgtcggcacccactgtgggcaggaggggctgcgcatgcgagcggtgggcagaggcgcagtgggagatgggccctggggtcagggacaggcctggtgccagacgtgagcccggggggctggcctgggcagctggatgtg

SEQ ID NO: 21603 - DNA, 601 bp, Human
ctcccgcgaacacagacctggcacacagcacagcagcccaaccctggcgcctccactcagccagtacatggcatcgctgtggtcacggccaaccccaccctgccaagggctcccagttacccccagcccagggagggcaggggcagtgtggggtgcagaggcacacaggtggaggaagtgccctaggccgaagaaccaggtgcagcactgggcacagggtggggatgtgtgtgcaccacctgcgcatccacccacacccaaacacatccacccgcacacgtccatcccacactcccgtgcrtgacaacgcccacccacgggtgcagagatgctctgtgcgaacagccgtggctgaggacaccaggacatgcaggcctcgtccacatgggcatgtccgagtccccggagacaccagtgagcctcccatgtggacatgactcccacccaccacctgtccagcggggccccaggtactcctgacggatcaatggcgcaggctcagcacagaggttgccggggcctaggtggcgtctttccctcccttcctgccgagcatggagcctgtggatcccgggcggcagtgcctgggttgctggaccgc

SEQ ID NO: 21604 - DNA, 601 bp, Human
acactgagcaggtgcagctgggtggggcggccagggaacctgagacctgcaggcccggggatgcaggtagaaagtggtaagtccccgcggcacacaagcacgtcggcggaggcaggcagacgccacccagccgtaaggatacatccacaggagcatgcactgcccccgtgtcgcccaagaacctgcccagaaatgctgcccctggctggcgaggcttgggtctgagcagtgttcacaacagtcacgtttttaatttcagtgtccatgacaactcttagaccggaacagctcccgcgaacamagacctggcacacagcacagcagcccaaccctggcgcctccactcagccagtacatggcatcgctgtggtcacggccaaccccaccctgccaagggctcccagttacccccagcccagggagggcaggggcagtgtggggtgcagaggcacacaggtggaggaagtgccctaggccgaagaaccaggtgcagcactgggcacagggtggggatgtgtgtgcaccacctgcgcatccacccacacccaaacacatccacccgcacacgtccatcccacactcccgtgcatgacaacgccca

SEQ ID NO: 21605 - DNA, 601 bp, Human
acaactcacttggacgtaaaaatgttaaacaagggagactgagggagagccaagccaggcgccacacgagattggaacaaagacctcctgagggtgggccagatcccaggggtgccccagaccatccctggctgaagaacagagcccaggcctgggaaactccacgggtaacagagatggtaaacagcagggacccctcaaaaagcaccaggcatgcacccgacaccacacacccaggcctgcacccgacaccgcagccggcccttcctgggacgccaccacagagacaaaggcgggaggmggctggcacacaggtttggcccatgggcgccggcggaagcagctgaagccagtgcaggagacccccagatggaggcatggcttccgacaccacctgcgtcccccgcaggaacacagacggttccaactttgcaatgccataaactgtatcctaggaaaagggaagcaaaaccgtgaggcgctggccaactgtgggcaagggcagggtacaacctcgcctgttaccagcatcgagaggaggagaaaaaacagaccgagcctggcagaaaacagaaagtgcgctccaagcaggacggccaag

SEQ ID NO: 21606 - DNA, 601 bp, Human
cccatgtgtgacccctactccccgctcccggccttgtccccagagacaggcccttccccagccagtgcccctccctgagcctatttaccctcatccctgccttgtccctggccagggccgcccctgcacggcacttcccaccccatccggatgattgcattcctgtgtccgactggccatccgtctccctggggaggaggagggggcaggaggccaggacagggctgcattcataggcccggaagctggacaggaccgtgtggttccgcaaggggtcccgggggccgggagagggcctgaygtggggcggcgcaggcaggggctgcatagcccctagacacaactcacttggacgtaaaaatgttaaacaagggagactgagggagagccaagccaggcgccacacgagattggaacaaagacctcctgagggtgggccagatcccaggggtgccccagaccatccctggctgaagaacagagcccaggcctgggaaactccacgggtaacagagatggtaaacagcagggacccctcaaaaagcaccaggcatgcacccgacaccacacacccaggcctgcacccgacaccgcagccggc

SEQ ID NO: 21607 - DNA, 601 bp, Human
accgctgcatgccggacccaggacagtgctgggcccaggataggcggctgcaaagcgagtgggcaaatgaagagcgaggggtcgctgaaaggcaaaccactccccggggatagggccagcgccaggggcagctgctggtgaccacggaggaagcccacggctgcccgaaccccggccccagcaggatctacacagccagctccaggggactcaaggggcgagcacgtgctagaccgtggttgatgtgcgtgcccacacatatgccggtatctatctgcgtacgtgcccatgactgacatcratgtgtgtccatgtgaggtcatgtgtatggtgtgatatccatgtgtggtgcccatgtgtgccatgtgatacccgtgtgtgtgtgctgtgacatctgtatgtccccgtgcggcccatgtgtgtgctgcgatgtccatgtgtgatgtctgtgtggggtccacgtgtgtgctgtgatgtccgtgtgatgtctatgcaggcctgtgtgagacccatgtgtgctgtgtgaggctgtgtgtactgtgacatctgtgtgttatctgtgcgtgcccatgaggcctgtgtgtgctgtgatgtccgtgtg

SEQ ID NO: 21608 - DNA, 601 bp, Human
cacacacacgtgcacaaacatgcacacgcttgccgctctgagctcaacctgggcctggctgtgtggggccggttcaccgctgcatgccggacccaggacagtgctgggcccaggataggcggctgcaaagcgagtgggcaaatgaagagcgaggggtcgctgaaaggcaaaccactccccggggatagggccagcgccaggggcagctgctggtgaccacggaggaagcccacggctgcccgaaccccggccccagcaggatctacacagccagctccaggggactcaaggggcgagcacrtgctagaccgtggttgatgtgcgtgcccacacatatgccggtatctatctgcgtacgtgcccatgactgacatcaatgtgtgtccatgtgaggtcatgtgtatggtgtgatatccatgtgtggtgcccatgtgtgccatgtgatacccgtgtgtgtgtgctgtgacatctgtatgtccccgtgcggcccatgtgtgtgctgcgatgtccatgtgtgatgtctgtgtggggtccacgtgtgtgctgtgatgtccgtgtgatgtctatgcaggcctgtgtgagacccatgtgtgctgtgtga

SEQ ID NO: 21609 - DNA, 601 bp, Human
gtgttccatgcacatccgtgaaccaacctctcccactaacctaggtgtggccgcctcaccgagaccacccgaaacgtccgattccccaaacgctggcgggacaaggacagcggtcagcaggagtgggctgcctggatgtttgggaagcggggggccggccggtcaaggggagtccctggcatggcaaggcccttgcatccccatggggcctcctgaggaacccgcgatctggggagacaggcagctgggccaaggtgtccagggagtcttcagaaaaggtacaccacccccgcccaccctytcagggagcaccttcccaccccacacctgggccccgcccagatgctccccctccctcacggggcccctcacctggcctctcccagctctactttcccttaagacatggctctactcccaggatctcacacacgcacacacacacgtgcacaaacatgcacacgcttgccgctctgagctcaacctgggcctggctgtgtggggccggttcaccgctgcatgccggacccaggacagtgctgggcccaggataggcggctgcaaagcgagtgggcaaatgaagagcgaggggtcgctgaaa

SEQ ID NO: 21610 - DNA, 601 bp, Human
gaacggggtggccacagccctaccctctgagggcatcccgacctgggtgttccaacccccactcagcacggggccctgggaggggctggttgggcccagctccacaatcagcctgggaaggcgccgccctcaggcctcatagagtggccacgggaagagcccggggccttcagggccgggaccacagaccccgaccccaggagagacaggacacatgactctgggggcaacacacccacctactcttaccaggggaactacagacatccctggccacacagacacagcccataccccccccacatcccacagtccctcgtacacctcaggtgaggtgtcagacctgtggctgcaggacaggcggtgacctgcaggcaaggcacacatgaggcgcctcctgtcctgtgggcttgctctggagacagcggaggcaccgcccctggacaaggccagcaggcagtccacgaatctgaaggtccacagagccccgagtccccggcccctcccgacctctgccccaacctgggcttcctgcccaccctccctcctcccctcaacaaaccacacatgcgggccatggccctgacataggaggggccgc

SEQ ID NO: 21611 - DNA, 601 bp, Human
aggaagcggccgccccctagtctgcgccgagtggcaccaacaccgtgagccacacgctgcccagggcttccacattcctgtagccaccacacacgcggattccacgctaagaacaacccagacagtgtgtgcacagcagagggcagatggggacatgcacaccctgggagagcctgagtggctggtgcccagcaccggccccgcctggagcatgaggctcttccacagagggtgggatggggctcagggacaagggcgaggggcggggcgggggacgggacgcaggtgttctgcagtcaasggtgccaggtgggcagccggggtggggtaggggtcccgtccacaaggtagaggctgcagcgtcagggggctcgtgtccctaaggacagaactgctctcctcagctcccgaggccgagggagcgctgacctggcctggttcatcacaagatcaccacagacagaggggcccgcgccgagagcgagggaagcagctgccccccagcagctccaggggggcctgcccgagagcccacaggacgacctgggccagtgcagggcagaacgcccatggtaaacccccacaacctgccaggtccacc

SEQ ID NO: 21612 - DNA, 601 bp, Human
caaaatgcatcaccaagagtctggagaagcaaatcgtgctgtgttcacgtgatggaaccgttatcagaaactgctgggtcgtatgaaaacacaggtgagacccagaggcatcaccccgactgacgggaggcggacacagaaggctgcgtgcccgtgatcccacctcggcacagctggggaaggccctctgctctaggaagcgggacccgggtcctcgcagggtcgtcgcggggccgccacgggagaagggggcccgagggagctgtctgtgtgcaggagcctgctctgtcaacgtgctggygggttcatggggtgaatgtgtacaatgttttcctgtgtgcacctaagacagtgcatttttcagaaggaaggaaggaagggaaggagggaggaaagaaagaaacaagaaggagatgtaagtcacgggcaccagagcctcgtagagcagaggaagcggccgccccctagtctgcgccgagtggcaccaacaccgtgagccacacgctgcccagggcttccacattcctgtagccaccacacacgcggattccacgctaagaacaacccagacagtgtgtgcacagcagagggcagatgggga

SEQ ID NO: 21613 - DNA, 601 bp, Human
gaaacaccgttaagaaaagttaaaataaatggagagatcatatttatgtcccgaaggttcaatattattaggaagtcagcattcccaaaactgattttaaggactcaacaaaatgaaaattgatgagctgattccagaatggaaatggaaatgcacagcaggacctaaaacagccaagaccctcgtcaagaacatggtggaggatctcaaggctcacagccgtgcagacagcgtcacatgggaggaaagggaagaaaaacaggtccacggaacagaagagtccagacggacccactcacaygtggccaactgcctttccacagaggagccaagccaaccggaaggagggctcctcggcgcatcgtgccgcagcgacctgccatcccgggaaagggtgggccaccaccccagcctcacaccacgtgtgagtggcagcccaggagaccctggacctagaggtagaagcttccagaagaaaacacagagaacctgttacccggatgaccctggggtaaacagattcctcaggacacaaaaggtattcacctaaaaaacgggtgatacgctgggcttcataaaaactgaaaacgtgttctcgtca

SEQ ID NO: 21614 - DNA, 601 bp, Human
agataagctaaaattaaaaggatgaaaaaagacataccacacaaacactgatcaaaagagctgggatggctgcctcaacatcagaccaattaattagaccacaaaaagaccaacaggaaacgtcctacttaatggtgaaatgtcagaaactttttctcccacatcaacacggtaacacccacactcactgctgctgatgattgtagctaatgcaaaaaggcaaaaataaagaaattaaagaaataaaaggtacagagatcagaaaggaaaatgtaaatctgtgtttatctgcagatgacayagcagtgtgtgcaagagaaaattcaagagaatctgtttttggcagaggcaggtctcattacgccatccaggctggtttctaactcctggtgatcctccggcctcggcctcataacgcactaggataacaggcacaagccactgcacccggcctaacatggagaatttagaacgctgtgggatatgaggttggtttacaaaactcaagtgtatttctacctactaataaccaaccgtcaagaaacaattaggccgggcacagtggctcatgcctgtaatcccaacacttcgggaggccaag

SEQ ID NO: 21615 - DNA, 601 bp, Human
tgcactccagactgggcgacagagcgagactaccttccacaaaaaaaaaaaaggcaacacattttcggacaaagaaaagcaaaaggaatcggtcactggtgagccacatttctaagacagtctttaggctacaggaacgtgacgcccgaggacagccagaatcggggggcgtaaacaaggcagaaagggtggatgtgtcggttgatattcaaaagaaaaattactgaaaaattccttgacagactcatgactaatagcttcttgtacggttttctgcataatagacgtggaaaatcggccygagggtgagaggagccaccgcgggcctctggccgccctggacgagtcttcacaggttatgctgggtggcagtgagttatgaaggcgtatcctaatctctaaagtaaaactaaacacgatcactaagcagagtataggttaaaaagcaacaacagatgcaaggaatcatttaacacctgattaatataaaagaaggccagaaaggaaaaacaaggatgaacagaaaacacgtagccagatgacaccgaaatccaaatcatcagcaattacactaaaaataaatgaactgaacactcaagag

SEQ ID NO: 21616 - DNA, 601 bp, Human
aagaatttaaaaaataaattttaaagaacaggccttggtggctgacgcctgtaatcccagcactctgggaggctgaggtgggcggatcacaaggtcaggagttcgagaccagcctggccaacatggtgaaaccccgtctctactaaaaatacaaaaattagccggacgtggtggcgggcgcctgtagtccaagctactcgggaggctgaggcaggagaatggcgtgaacctgggaagcagaggctgcagtgagccgagatcgcgccactgcactccagactgggcgacagagcgagactaycttccacaaaaaaaaaaaaggcaacacattttcggacaaagaaaagcaaaaggaatcggtcactggtgagccacatttctaagacagtctttaggctacaggaacgtgacgcccgaggacagccagaatcggggggcgtaaacaaggcagaaagggtggatgtgtcggttgatattcaaaagaaaaattactgaaaaattccttgacagactcatgactaatagcttcttgtacggttttctgcataatagacgtggaaaatcggcccgagggtgagaggagccaccgcgggcctctggc

SEQ ID NO: 21617 - DNA, 601 bp, Human
gctcctgacagcggcgggtgtgggagcccaagggatttaatctccaagtccctcgtgggaggagccctgatggggggacatgctgcctggccccttccagccaaagggtctgtagccccaggagctgcaggctgatactgcccctgtgggggtgtctcctcttgcggctgaacatccaacccagggctgcctggggtcccaaggtgctgtaggggctgcaggtctggacgggatgccatgactccatggccagggcccatggggaccactcacagacactggggcctcactctctcctggytggtcaggagccctgcccaaagaagggctgaggaggttgagcagcccctcacaggaccgaggcaaggcaggcctagagcccgtggctccatcctcaccccgcagcgggcggcaaactcccccactgctggccagcgagaggcctgagtacaggcaagtgtccggcctggcagaggcgccgtctggaggtcaaggccggcaggatggtggacagggaagagcaggggggcggcactggccgtgggggcacctgaagggttccgactcgtgcacatccagggccgcgccgcggatccggccc

SEQ ID NO: 21618 - DNA, 601 bp, Human
ctcctctcgcatctcgatggatgcctgctcgctgtaccatgcagcatggggggtgcagatgaggttgggtgcatccttcagagggccctggctaaagctgggaacagcacaggcatggtcagtgcagcctgagtgctgtggctgggtacggaggggaggtggctgggcactggaaccccctgtggggggccctgcctgggaaccacagaccccacggccccgctctgctcggcaggctggctgagctcaagagcacagccccgggaccatcagacacaccaggggctcctgacagcggcgsgtgtgggagcccaagggatttaatctccaagtccctcgtgggaggagccctgatggggggacatgctgcctggccccttccagccaaagggtctgtagccccaggagctgcaggctgatactgcccctgtgggggtgtctcctcttgcggctgaacatccaacccagggctgcctggggtcccaaggtgctgtaggggctgcaggtctggacgggatgccatgactccatggccagggcccatggggaccactcacagacactggggcctcactctctcctggttggtcaggagccctgc

SEQ ID NO: 21619 - DNA, 601 bp, Human
gctggcaggaagggacccccaggcctgaccgagcggcccccacgcccacctgtgatggctctgcggatctcccgtgccgcctcctctcgcatctcgatggatgcctgctcgctgtaccatgcagcatggggggtgcagatgaggttgggtgcatccttcagagggccctggctaaagctgggaacagcacaggcatggtcagtgcagcctgagtgctgtggctgggtacggaggggaggtggctgggcactggaaccccctgtggggggccctgcctgggaaccacagaccccacggcccygctctgctcggcaggctggctgagctcaagagcacagccccgggaccatcagacacaccaggggctcctgacagcggcgggtgtgggagcccaagggatttaatctccaagtccctcgtgggaggagccctgatggggggacatgctgcctggccccttccagccaaagggtctgtagccccaggagctgcaggctgatactgcccctgtgggggtgtctcctcttgcggctgaacatccaacccagggctgcctggggtcccaaggtgctgtaggggctgcaggtctggacgggatgcc

SEQ ID NO: 21620 - DNA, 601 bp, Human
ccctccacgtccccaggacagacgtcgatgggcagcgggcacgctgggcaccgcccaagcttttccttttggagctgcttcgtgatgccgtcttcatttggaacaagggggggttcatgccaaaattaggaaaaacagcctttgttttgtttttctaaattattctaaaaataagacaagcaggtagaaaaaacaatgcactgtgtggcataaaaagaaaaacgggaaggattcattgtcctgagaagtttgccaactgcctcattctggggcacgttccaacatacaaaaaaaaaaaaamcaaaaaaaaaaacctcaaattgacttccaaatgctccttcaggttttctttttgttgacagctaagcaaacagatcctttgtaatgttctaaaaactgtacacagacaagaacgttcatgggagaataactactgacttcttctgcttaacgaggaacgcgaaggacacagggcagagcgcccacaggacggacgacgacaagcgacacgaggcccagcgctgccccctcccgcctcctgacagcccggaccagtctctgcagtgccagggccaccacacagatgcctcctccacacact

SEQ ID NO: 21621 - DNA, 601 bp, Human
cctgtctttctctcctctcttttttttaattttctataataaagtttcctattggataaggtcagctccctgatttatgcctggttcctattggaagctcacaggggctgacatcacttaggaaagcgaagggggtagggctgccagatcagtttgtcaccacccaggctcccttgcctttggctgggtgcaacttccattttaggtgttggatctgagggggaaaaaaaagagagagggagagagagagaaagaagagcaggaaagatcccgaaaggaggaagaggtggcgaaaaatcarctgccctgctggatttgtctttctcagcaccttggcgaagccttgggtttctttcttaaaggactgatttttagaactccacatttgaggtgtgtggcttttgaagaaaatgtatgtactgacgggaaaaggaggataagcaagtcgaatttttgtcttacggtaaccggagggaattaaaaaacgggagagtctgttatgctgatgagtaacttttaagcaattatttttcttttctactttcagtactttggcgggggagattttggtattttattatatttaaaaaggtaaaatata

SEQ ID NO: 21622 - DNA, 601 bp, Human
aatactccttttcctacttcccaaggaggtgaagtttcctgaagacagtgcttttttacatgtagagttttttgtggttctgttactctgttgtctccattagtcaaggaacacgttttgccatcaatataatatttaacaaactatagtagtatagtttggaaagtagaaacgcccttttatgaatgtattattatatttttggaggcagagtctcactctgttgtccagcctggagtgcagcggtgccatctcggctcactacactctccgtctcctgggttcacgcaattctcatgcytcggctgggattacaggtgcctaccaccatgcctggctaatttttgtatttttagtagagataaggtttccccatgttggccaggctggtcttgaccaactgaacctgacctcaagtgatccacccacctcggcctcgtaaagtgctgggattacaggtgtgagccacctactttcatttctttctttcttttttttttttttttgagacggagtcttgcattgtcgccccagctggagtgcaatggcgcgatcttggctcactgcaacctccgcctccctgatttgcgctattctcctg

SEQ ID NO: 21623 - DNA, 601 bp, Human
cccatgttggccaggctggtcttgaccaactgaacctgacctcaagtgatccacccacctcggcctcgtaaagtgctgggattacaggtgtgagccacctactttcatttctttctttcttttttttttttttttgagacggagtcttgcattgtcgccccagctggagtgcaatggcgcgatcttggctcactgcaacctccgcctccctgatttgcgctattctcctgcctcagcctcccgagttgctgggattataggagtacgccaccacacccggctaattttgtctgtgtgtgtkttttttttttttttttttttttgagacggagtcttgcactgtcgcctaggctggagtgcaatagtgcgatcttggctcactgtaagctccacctccggcgttcacgccattctcctgtctcagcctcccgagtagctggaattacaggctcccgccaccacgcccggcctttttttgtatttttttagtagagacagggtttcactatgttggccagactggtctcgaacttctgacctcgtgatccgcctgcttcggcctcccaaagtgctgggattacaggtgtaagccacagtgccc

SEQ ID NO: 21624 - DNA, 601 bp, Human
tgccaccacacccagccaatttttgtagttttagtagaaatggggtttcaccatgttggccaggatggtctcgatctcttgacctcgtgatccacctgcctcggcctcccaaagtactgggattacgcgtgagctactgcacccggctgagtgattttttttttttttttttaagatagagaaagtccctcatactgaggagccttgcagttgagagagaacagaattccagttggaggatcaaggaatttgagggaggcagcatgcttgcagtgttcctaggatttttacaggaactacmatagaaagttagggatgaaattatattgaaaggggaaagctggactgctcaggtttggaggtcatggggaattccaggattcagtatgtggttgctctcttatttttaacttctgcttagcagtaaaaccacacccttccttcttcctgaaagtaatgtttaacttcctctccctgcagcattacactctatgtaatgggagtggggtggaggaagagtctcccaaggtggttggatctcactattctactggaagaggagcaggcaaatatatttttatgtggtataatgtcattagat

SEQ ID NO: 21625 - DNA, 601 bp, Human
caccggcttgacccatatagacatttaagcttgtggttcttgctttatttagagcagtagtttttcagattgtgggttgtgatctatttgtgtgatccgttagtgaataaaacaaaattttgtggagcataatcagcattccaagggaaaggaataaagaaaaagtagtatagaccattgtttctcagttgtgggccattttgcctgccctgccctgaggacatttggacatttgcagtgttggagatatttttggttgttataacttggaacaggggagagggagtgctactggcatctrgtgagtaaaggccaggggtactggtaaacatccaacaatagacaagacagctcctcataacaaagaatcatctggccgaaaatgtcagtggtgctgaggttgaaaaactctggtatagacagatcggagagcattgagcattgcttatagttttgtttgttttttttgagatggagtctcgctctgtcacccaggctggagtgcagtggcacaatctcagctcaccgcaagctccgcctcatgggttcacgccattctcctgcctcagcctcccaagtagctgggactacaggtgcccgc

SEQ ID NO: 21626 - DNA, 601 bp, Human
ttttggttgttataacttggaacaggggagagggagtgctactggcatctagtgagtaaaggccaggggtactggtaaacatccaacaatagacaagacagctcctcataacaaagaatcatctggccgaaaatgtcagtggtgctgaggttgaaaaactctggtatagacagatcggagagcattgagcattgcttatagttttgtttgttttttttgagatggagtctcgctctgtcacccaggctggagtgcagtggcacaatctcagctcaccgcaagctccgcctcatgggttcaygccattctcctgcctcagcctcccaagtagctgggactacaggtgcccgccaccacgcccggctaattttttgtatttttagtgttagccaggatggtcttgatctcccaaccttgtgatccgcccgccttggcctcccaaattgctgggattacaggcgtgagccaccacacccagcctgagcgttgcttatagttaaacattgtttgtttcatgatctgtatgtttattttgagctataatgtagaatatgtttcttggtgagggtcgcaaacaaagcttgaatattactataaggta

SEQ ID NO: 21627 - DNA, 601 bp, Human
cttgtgtgtgtctatgtccttgccctagttatttgtatttcaagtcaggctgtgataaattcagcaaaaggggtacagagtactaggaggttagggcatgggtgaggaaggtctgttctttctgtgatgcctttctcttcttatttatctttttgtggttaaactcaagtgcctttattttattaaagttttcctgaattctttttatatcctataaatgctgctatataatctttctctctttggaatacacctctgtgtgctgtgttccattctacatatgtattatatacttccataygagaagtatatattccatcttgaattactgcatctggtacatatcattaatccctaccccacagtgatataaacattcagaaggcagggactgttaatcaactttctctcaactgcagtaccttgcttataataggtatttactattacagtgagtagaaaaacatattcaggaatcttgtaggtgttgagggatatttaagggaggatttctggatttgagtcatcttgaagcttctggtttcccctcaggaatgtaagctcagagaggagtgaagctcgccggaaacttcgggaatgt

SEQ ID NO: 21628 - DNA, 601 bp, Human
aactcctcttggaatttctctgaggacactgtcatctctattttgaacactatcaacgaggttatcgctgagaacttggaggctgccaaaaagcttcgagagacacagggtattgagaagctggtgttgatcaacaaatcagggtgagcttaccacctaaaattacagtcaaaagaatttgagtgagtggagagttgttttcctcttttggttactaagaaaggaaatttccccttatttacgtgtaatgtgtgaagagctattgctctattatctgtcttaatgttgatccataaattgrtaatagattcatgtcaaacttttcttgtgtcgctatttgggatagaatacaggatttggtaaaaatttgatttaacccattttggcatttatattcttttttgtttgtttgaggcagagtctcgctctgtcacccaggctggagtgcagtggcgcagtctctgcaacctccacctcccgggttcaagtgattctcctggctcagcctcctgagtagctgggactacaggtgcgtgccaccatgcccagctaattttttgtacttttagtggagatggggtttcaccgtgttagccaagat

SEQ ID NO: 21629 - DNA, 601 bp, Human
taagaagtttaccattaagtgaaatagatactttaaacttgtcagtatggtaacaattaatacataaaactcacaccaatgaaggttctttagatccttataatttttaagactgtaaaacggccttgagaccaaataatttgaaaactgctagtttagatggaattgttttttgatttaagagtctgtaggggccaggtgtgatggctcacacctgtaatcccagtactttgggagactgaggtgggagaatcacttgagcccaggagtttcagaccagcctgagcaacatagtgagacmtcatctctacaaaaagcttaaaaattatccaggcattgtgatgcacatagttggtgctaagtagaagtgtgaatgaagggaaggaaggaggaccagagagcaattttcatgatgtgtacagattttgaagaattgtttttgacatggataactttctgacttcatacagataagaaacctgatcgggaagaaattcagatgagcaatatgggatcaaacacaaaatcactaggtaggtgattaattcctgcctaaggatgtggagtaatatttcactggctaaggagagctgtctagctc

SEQ ID NO: 21630 - DNA, 601 bp, Human
attttctaaatttcttggtaaccctaatatgtagtcagggttgagaagtgctatgctaacttatacacacagccaattaatgactacatggatagaaacacttttatttgttctttatctaactttgtaactaaattacattttaccagattcccaattagagagtcatattaaagctctatctactatggcaggttcttaatctaagatgtacatcaaattacctgatgaacttttaaaggtacacaaacttgtgaccagagttagacagttgggttaggaggactgcaatagggtctgygcagatgtatttacatgaacactccaaaggcaattctaataaagagtcagaatgaaaaccataggattaaggtcacggttcataaccagggccaattttgctccctgcaggacatgtggcaatgtctggagacactgttgtttgttactggggtggggatgggggctgctactggtatccagtgggcggaagccagggaggttgctaagcatcctgcaatgcacaagacagtcacatgacaaagaataattcaccccaaaatgtcaataagggtggctcttgagaaatccttattaagaa

SEQ ID NO: 21631 - DNA, 601 bp, Human
gatgacaagtggtgctcataattggggtgaactagtactcaaagggctgacgtcccagaggtaccttgcattcagatctctggggagtaaggctcaggcatcagtgattttctaaatttcttggtaaccctaatatgtagtcagggttgagaagtgctatgctaacttatacacacagccaattaatgactacatggatagaaacacttttatttgttctttatctaactttgtaactaaattacattttaccagattcccaattagagagtcatattaaagctctatctactatggcagrttcttaatctaagatgtacatcaaattacctgatgaacttttaaaggtacacaaacttgtgaccagagttagacagttgggttaggaggactgcaatagggtctgtgcagatgtatttacatgaacactccaaaggcaattctaataaagagtcagaatgaaaaccataggattaaggtcacggttcataaccagggccaattttgctccctgcaggacatgtggcaatgtctggagacactgttgtttgttactggggtggggatgggggctgctactggtatccagtgggcggaagcc

SEQ ID NO: 21632 - DNA, 601 bp, Human
aaatggtcacttaaggccttctgtgaaaggggaatgcttactctttgttacattatgttcatctttgaaactaaaaacacacagtcagtgaatggatgtgaacctaactgagcagaagttaaaagatgacaagtggtgctcataattggggtgaactagtactcaaagggctgacgtcccagaggtaccttgcattcagatctctggggagtaaggctcaggcatcagtgattttctaaatttcttggtaaccctaatatgtagtcagggttgagaagtgctatgctaacttatacacacagccaattaatgactacatggatagaaacacttttatttgttctttatctaactttgtaactaaattacattttaccagattcccaattagagagtcatattaaagctctatctactatggcaggttcttaatctaagatgtacatcaaattacctgatgaacttttaaaggtacacaaacttgtgaccagagttagacagttgggttaggaggactgcaatagggtctgtgcagatgtatttacatgaacactccaaaggcaattctaataaagagtcagaatgaaaaccataggattaa

SEQ ID NO: 21633 - DNA, 601 bp, Human
ctggaagttgtagagtgctccaccatatgttatccagtcaacacactggcccaattataggaccagagtcacaagcttgtatggaatccacgctcttttatgtattaacttctcaggccttaaaaagaaggtgtactcattcaaacccctcaccctcaatttgtcattgtgaaagctcaaaagcggccaagcagagggctgagtggaaaatgatggtacaataataatacgttaaaacccaatagcacaatccagccagtgaagcacctgctgagtaacatcacatctgatcctttcaacagccttggcattcagctatgattatgctccttgtcacagagttgaggtcagttggatatggtgctccagccagtgggaggtggagatggcacagtccactggcactgtcttgatgccagctcagggctcttcttactccaccagggatatctgggttttctgactccagccctgaatactcccaattatttcaacttcctcttttggggaaaatgtggacattagaaaagatgatctaccaagtctcccaggttttaggaatctggtcatctgacagaaagaagatgtttgtgccatgttg

SEQ ID NO: 21634 - DNA, 601 bp, Human
ggaatgggggaaagaagatcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagccggtagctttgcttgggacatccattgctgtcagcagtgctttcagcagttgcttttggttaccagggtcattttgattccttattttctattagaaagggttaatctggaagttgtagagtgctccacyatatgttatccagtcaacacactggcccaattataggaccagagtcacaagcttgtatggaatccacgctcttttatgtattaacttctcaggccttaaaaagaaggtgtactcattcaaacccctcaccctcaatttgtcattgtgaaagctcaaaagcggccaagcagagggctgagtggaaaatgatggtacaataataatacgttaaaacccaatagcacaatccagccagtgaagcacctgctgagtaacatcacatctgatcctttcaacagccttggcattcagctatgatta

SEQ ID NO: 21635 - DNA, 601 bp, Human
caaatgactcctggggaataaatctgcagttgggaaaaatgctttataatcgagctgcagctggggagatgatttgggaagaagctagaagaagaagagaaagtagggatgggggcggatggggagggaggaatgggggaaagaagatcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagcyggtagctttgcttgggacatccattgctgtcagcagtgctttcagcagttgcttttggttaccagggtcattttgattccttattttctattagaaagggttaatctggaagttgtagagtgctccaccatatgttatccagtcaacacactggcccaattataggaccagagtcacaagcttgtatggaatccacgctcttttatgtattaacttctcaggccttaaaaagaaggtgtactcattcaaacccctcaccctcaatttgtcattgtgaaagctcaaaagcggccaagcaga

SEQ ID NO: 21636 - DNA, 601 bp, Human
cttgggagaataaacttctttctcatcccactgttcgtcttccctggaggcatcactgttcctctgtttaacaaatgactcctggggaataaatctgcagttgggaaaaatgctttataatcgagctgcagctggggagatgatttgggaagaagctagaagaagaagagaaagtagggatgggggcggatggggagggaggaatgggggaaagaagatcacagggaccacatttatctgtcatttaagcctccaggagttctgcagtctgggttggtttgggagagttacttaattcaakagcttttctctaaggggataaggagaaagagaagacaaaagacttgggatcctagcaggagggtggcagccggtagctttgcttgggacatccattgctgtcagcagtgctttcagcagttgcttttggttaccagggtcattttgattccttattttctattagaaagggttaatctggaagttgtagagtgctccaccatatgttatccagtcaacacactggcccaattataggaccagagtcacaagcttgtatggaatccacgctcttttatgtattaacttctcaggccttaaa

SEQ ID NO: 21637 - DNA, 601 bp, Human
gactctcattgaaaggaaaatgttatggcataagtcagaatgatctttaaatcagctcaaacttatttttcttacatcaaagacttgggagaataaacttctttctcatcccactgttcgtcttccctggaggcatcactgttcctctgtttaacaaatgactcctggggaataaatctgcagttgggaaaaatgctttataatcgagctgcagctggggagatgatttgggaagaagctagaagaagaagagaaagtagggatgggggcggatggggagggaggaatgggggaaagaagrtcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagccggtagctttgcttgggacatccattgctgtcagcagtgctttcagcagttgcttttggttaccagggtcattttgattccttattttctattagaaagggttaatctggaagttgtagagtgctccaccatatgttatccagtcaa

SEQ ID NO: 21638 - DNA, 601 bp, Human
ctaatcccacaggctctgagtcaacctgattttctattccaagcatcctctgcatcaaaaagtggactggcacgaaagcaggtaaactcagggcgatgcatgaaagagagaaacgactctcattgaaaggaaaatgttatggcataagtcagaatgatctttaaatcagctcaaacttatttttcttacatcaaagacttgggagaataaacttctttctcatcccactgttcgtcttccctggaggcatcactgttcctctgtttaacaaatgactcctggggaataaatctgcagttgkgaaaaatgctttataatcgagctgcagctggggagatgatttgggaagaagctagaagaagaagagaaagtagggatgggggcggatggggagggaggaatgggggaaagaagatcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagccggtagctttgcttgggacatccattgctgtca

SEQ ID NO: 21639 - DNA, 601 bp, Human
gtttgctggttaagacaaagctgaccttttgactacaggaaccatggaaagcggagaaaaatatccaattttagaaggggtgaaacaatgatggaaaaaaaaataaactgagccaagttttatttgaagaatcttaccaagctggctatcattttttcaggcacctgctacgtaacagccactgtgatggcacataatacaattccattgtatgggtgaaaggaggacagctaaagctgtgagtacctcccaccagactgagctgcttctctgcagtcctggggtgggactggaatgggcwggggctgctgggatcacaatcctgcactgcttccctccactggctggaatctggtgaaaggtagcaggtgccctgtacttattaccgagggcatgaaaacttacgaggaaaaccagttttcaggaaatatctctggagcctttgtcattccagacctttcttgtcagcttttcaaggtgtcatgggctgctaatcccacaggctctgagtcaacctgattttctattccaagcatcctctgcatcaaaaagtggactggcacgaaagcaggtaaactcagggcgatgcatgaaagagaga

SEQ ID NO: 21640 - DNA, 601 bp, Human
ctggaggacacccaggcccatttgtttatgaatggtctgtagctgctttcatggtacaatgcagaattacatggctgtgactgagacagtatggcccgcaacaccgggaatatttattctctgaccttttgcagaaaacgtttgctggttaagacaaagctgaccttttgactacaggaaccatggaaagcggagaaaaatatccaattttagaaggggtgaaacaatgatggaaaaaaaaataaactgagccaagttttatttgaagaatcttaccaagctggctatcattttttcaggyacctgctacgtaacagccactgtgatggcacataatacaattccattgtatgggtgaaaggaggacagctaaagctgtgagtacctcccaccagactgagctgcttctctgcagtcctggggtgggactggaatgggcaggggctgctgggatcacaatcctgcactgcttccctccactggctggaatctggtgaaaggtagcaggtgccctgtacttattaccgagggcatgaaaacttacgaggaaaaccagttttcaggaaatatctctggagcctttgtcattccagacctttct

SEQ ID NO: 21641 - DNA, 601 bp, Human
tgtaatcccagcactttgggaggccgaggtgggtggatcatgaggtcaggagattgagatcatcctggctaacaaggtgaaaccccgtctctactaaaaattcaaaaattagccaagcatggtggcgggcacctgtagtcccagctactcaggaggctaaggcaggagaatggtgtgaacccggaaagcggagcttgcagtgagccaagattgcgccactgcactccagcctgggcaacacagtgagactccatctcaaaaagaaaaacaaaaaaacaagcaaaaaaaacaccagtatcaygtacagagccacagtgagggttaataagctcacagatacagctctttgaatagtgtctgctcaaaactatttgctaaaatactagttgtaataacttctgattgttgagaagaggggtgagcaaactgccgcccaggggtccgatccagcccacagccggttgtgcataattggtgttttcctggaggacacccaggcccatttgtttatgaatggtctgtagctgctttcatggtacaatgcagaattacatggctgtgactgagacagtatggcccgcaacaccgggaatatttattc

SEQ ID NO: 21642 - DNA, 601 bp, Human
caggagatggcacagtgcggagctccagaggatgggatctagggctagccggcttggcttccaatcctgggcctaccatttcacaagctgtggggccttgggcaaagtgcttaatctttctgtacttctatttcctcatttgtaaagggagggtcatattaacagtatcatgtacaggctgggcgcggtggctcatgcctgtaatcccagcactttgggaggccgaggtgggtggatcatgaggtcaggagattgagatcatcctggctaacaaggtgaaaccccgtctctactaaaaatwcaaaaattagccaagcatggtggcgggcacctgtagtcccagctactcaggaggctaaggcaggagaatggtgtgaacccggaaagcggagcttgcagtgagccaagattgcgccactgcactccagcctgggcaacacagtgagactccatctcaaaaagaaaaacaaaaaaacaagcaaaaaaaacaccagtatcatgtacagagccacagtgagggttaataagctcacagatacagctctttgaatagtgtctgctcaaaactatttgctaaaatactagttgtaataacttctga

SEQ ID NO: 21643 - DNA, 601 bp, Human
cccacttcagactgctggtctctagagctataagatcataaatgtgtgttgggttcagccaccaagtttgtggtcattggttatgacagcaacaggaaagtaacacagcgtgcaagtactgggaagaaagctggggcacagtaaatgctcttcaaatgttcatatcattaacagtggcaggagatggcacagtgcggagctccagaggatgggatctagggctagccggcttggcttccaatcctgggcctaccatttcacaagctgtggggccttgggcaaagtgcttaatctttctgtrcttctatttcctcatttgtaaagggagggtcatattaacagtatcatgtacaggctgggcgcggtggctcatgcctgtaatcccagcactttgggaggccgaggtgggtggatcatgaggtcaggagattgagatcatcctggctaacaaggtgaaaccccgtctctactaaaaattcaaaaattagccaagcatggtggcgggcacctgtagtcccagctactcaggaggctaaggcaggagaatggtgtgaacccggaaagcggagcttgcagtgagccaagattgcgccactgcact

SEQ ID NO: 21644 - DNA, 601 bp, Human
gtcaaggaggctacaggtgcaaaccagggttgtcccaggaaagtgaggggctgtgatcacctggggtgcataaatatttttagtctacatttttttgagatgcctgacactcatgttttcttagccaaaaggttaaacagtggttaaggacacatgttgtggagccggacacctgtagaaccctaggtgtccgatttagctgtgggactttggacaatgcacttgacatctctgggacatggtgtacccctctgtaaaatggtcataacaggtcccacatcttaggttcttgtgcattagktgagctaaaacatgtgtgtggtacgcagaataatggccctcccagaaggtctacattttttttttttttttgagacggagtctcgctttgtcgcccaggctggagtgcagtggcgcgatctcggctcactgcaagctccgcctcccaggttcagaccattctcctgcctcagcctcccaagtagctgggactacaggcacccgccactacgcccagctaatttttttttgtatttttagtagagatggggtttcactgtgttagccaggatggtctcgatctcctgactttgtgatccac

SEQ ID NO: 21645 - DNA, 601 bp, Human
ttgtgaagctattttccagctgtatatagtaagatactgttggttcttaaaaactaggaggcattcttattcaaggaggtgcagttgctttgacaccaagtctcatctctttttgttctatctgcacgaaggccctcctttctcaccactatctgcactgcctgggaaatttctactcattctttaagatttgattatcaactcttccagctagcatattgtgacagcctctcccttaggtttagattggaaagtataggcatagtgacttgttaaattaaatatttgccccacatctcayagcttgtaagggagggtactagatgagaactgagttctctgactccatcatgccctgtctcctcccccatccttcctgcatggtgacttgctatgacttggtggctactgtgatgttggtaaggtggacctgacttggttgcagagctgaagaggcacagagcagagggatgtagagacatcatcaacacacggacttcccaccacagaggaacaacaacaaaataccttcatgtatccaggttgaactcgtgtcgctgccatgtggaaggagcacatgggtgtgctggatcgtcaagtc

SEQ ID NO: 21646 - DNA, 601 bp, Human
ttctatttccttaaaatttgtctagaagtccatgggaatctccatacctactattataatagaattgagtcagaaatggtgagtttcatgctcaaatttggagcaattctcctgaattcattttgttttaagagcagtgaaaagcaataataaaactgaagtgtaggtaggagacgaggataaatgcagttataaaaaccttgttttgatctccaaattagtcagtatatatataaaaaaagagataagctacatgaaacagtgaatgagactgactaagcaggagaactgtaaccaggargatgcttgattcaatccaatttaacacttcttattaaactcgtaaatccaggctgttggcattggaaaaagagataaaggaacaacaagacagaatgagcgcctattctataagtaaattttcagccaaattaaagggcatttatgagatcatctttagtgaaaaaaatcttcccattaacaataatcaagattggacctggcttatcaggaccttagcaacatggatctgtattattttatagatggtttcttcaagtgatttgtaatatcatttcatagatggtttcttcgagtgatt

SEQ ID NO: 21647 - DNA, 601 bp, Human
agggtgggcaaattagcaatcattttataaataagctatggtgtatttgtatacctaccgttcccaattattaaattatcctcagttccaaaaatttgattttcaataaataaattctatttccttaaaatttgtctagaagtccatgggaatctccatacctactattataatagaattgagtcagaaatggtgagtttcatgctcaaatttggagcaattctcctgaattcattttgttttaagagcagtgaaaagcaataataaaactgaagtgtaggtaggagacgaggataaatgyagttataaaaaccttgttttgatctccaaattagtcagtatatatataaaaaaagagataagctacatgaaacagtgaatgagactgactaagcaggagaactgtaaccaggaagatgcttgattcaatccaatttaacacttcttattaaactcgtaaatccaggctgttggcattggaaaaagagataaaggaacaacaagacagaatgagcgcctattctataagtaaattttcagccaaattaaagggcatttatgagatcatctttagtgaaaaaaatcttcccattaacaataa

SEQ ID NO: 21648 - DNA, 601 bp, Human
caccgtgcccagccaactctcttaattatatgatggcttggtgaggtaaaaaagctacaggagaaaagtttaaagctagcagaagttgattaatgacttttaaggaaagaagatatttctacaacataaacaaaaatatttgtgtgatttgctttattgagatatttgctttattgcagtagtgtggaaccaaaactacaatatctctaaggtatgcctgtaattcctttgacttaaagacagagaattttagatcctttcatgaatccagatgaagctgcatttcattctcatataatcratgctgaacaaagattaaatgtgatgttttgttgtattttatcatttagctaaatatttgttcatgacaatagccaagcaactctagaaaaacatatattaatattcaggtcgtgatagtgtagttgaaatacaattagtgtgcaaaaatgcttctgagtagaaacaaaagtgtagtttttgtttctatcttttgcatagttacaaaaccaaaagagactgtgaatgtgtaacgaacagcaggttttaacctctcaattaaaatgccaatacatcacagtgttatactaacatgtgaagg

SEQ ID NO: 21649 - DNA, 601 bp, Human
ccaatccacagcaaggccctgactctttttttttttttttttttttgagactgagtcttgctctgttgcctaggctggagtgcagtggcgagatcttggctcactgcaacctctgcctcgcgggttcaagcgattctccttcctcagcctcctgagtagctgggattacaggcgtgtgccaccatgcccagctattttgtatttttagtagagatggggtttcaccatgttggtcaggctggtctcgaactcctgacctcgtgatccacccgcctcagcctaccaaagtgctgggattacrgacgtgatccaccgtgcccagccaactctcttaattatatgatggcttggtgaggtaaaaaagctacaggagaaaagtttaaagctagcagaagttgattaatgacttttaaggaaagaagatatttctacaacataaacaaaaatatttgtgtgatttgctttattgagatatttgctttattgcagtagtgtggaaccaaaactacaatatctctaaggtatgcctgtaattcctttgacttaaagacagagaattttagatcctttcatgaatccagatgaagctgcatttcattct

SEQ ID NO: 21650 - DNA, 601 bp, Human
caaaagcaagagatgattaagcttagcgaggaaggcacgccacaacccaagacgggccaaaagctgggcctcttgtgccaaacagtgagccaagttgtgaatgcaaaggaaaagttcttgaagaaaattaaaagtgctaccccagtgaacacacgaataataagaaagtaaaacaggcttattgctgatatggagaaagtttgagtggtttggataaaagatcatatcaaccacaacattcccttcagctaaaacccaatccacagcaaggccctgactctttttttttttttttttttttgagactgagtcttgctctgttgcctaggctggagtgcagtggcgagatcttggctcactgcaacctctgcctcgcgggttcaagcgattctccttcctcagcctcctgagtagctgggattacaggcgtgtgccaccatgcccagctattttgtatttttagtagagatggggtttcaccatgttggtcaggctggtctcgaactcctgacctcgtgatccacccgcctcagcctaccaaagtgctgggattacagacgtgatccaccgtgcccagccaactctcttaattatatgatgg

SEQ ID NO: 21651 - DNA, 601 bp, Human
acgaactgcacccacctaagacagcaaccgtaatcaagaaatattgtgtgttccgactgctccacagactggcccttcctcctctctctcctcaggcctccctcttccataagacaaaacaatgtagaaattaggccaattaataaccctacaatggctcccaagtgttcaagtgaaagaaagggttgcacacctcttactttaaatcaaaagcaagagatgattaagcttagcgaggaaggcacgccacaacccaagacgggccaaaagctgggcctcttgtgccaaacagtgagccaasttgtgaatgcaaaggaaaagttcttgaagaaaattaaaagtgctaccccagtgaacacacgaataataagaaagtaaaacaggcttattgctgatatggagaaagtttgagtggtttggataaaagatcatatcaaccacaacattcccttcagctaaaacccaatccacagcaaggccctgactctttttttttttttttttttttgagactgagtcttgctctgttgcctaggctggagtgcagtggcgagatcttggctcactgcaacctctgcctcgcgggttcaagcgattctcc

SEQ ID NO: 21652 - DNA, 601 bp, Human
tttctgtaattcttgtagtatttcaaacctcttcattattattatatctattatggtgatctatgatcagtgctccctgatattactactgtaattgttttggagcaccacgaactgcacccacctaagacagcaaccgtaatcaagaaatattgtgtgttccgactgctccacagactggcccttcctcctctctctcctcaggcctccctcttccataagacaaaacaatgtagaaattaggccaattaataaccctacaatggctcccaagtgttcaagtgaaagaaagggttgcacrcctcttactttaaatcaaaagcaagagatgattaagcttagcgaggaaggcacgccacaacccaagacgggccaaaagctgggcctcttgtgccaaacagtgagccaagttgtgaatgcaaaggaaaagttcttgaagaaaattaaaagtgctaccccagtgaacacacgaataataagaaagtaaaacaggcttattgctgatatggagaaagtttgagtggtttggataaaagatcatatcaaccacaacattcccttcagctaaaacccaatccacagcaaggccctgactcttttt

SEQ ID NO: 21653 - DNA, 601 bp, Human
actgtgtcgtatgaagattggggttctgttgcttggagagggaacctctgcaagaacaactgagtccttagcaagctctgtgccctgtcactcaactgggctctgcatccagttcctgtctgctcgctggttcctcgctaacctcttccacctgctgcccccttctctttggttcaccatctttctcttccaggaaagtctctcttcctgcctttgcccttttgcctctgggtcttccctaataaaggttagccttttatgagttactgccacataatcatgaagggacaatattttaaarcctgttgaccacagcttttaaaattagaatccaatattgcccagatggtggtgtttattaaaccacatcaagtgtgtaattatctcctgagacctcacacacagcggtgctccaagtctctggtaaatcaggattaagttctgggaaaaatcaaatcacgcaaacaagtgtttattaggtgtctggatgtgcctcgcctaggaagtcctgaggcagcgcactgtctgcatggctggttgaacacagccctgcctgctcgcgagaaaaggctgcttctctcttccagcccttgccgatcca

SEQ ID NO: 21654 - DNA, 601 bp, Human
gcccagggcagtgcttcagagccttgtttaccctcaacactcacttgagaatttatggatgcccagagcccatcctggaccttttgagtctgaattttcagtgacgggcttcagaatccatatttactgagcatacttggtgactattaaggctaggaatccctagagcactctgatttttaggataaatctctctttcctttgctagtgtcaaagctcctccccagccaaacttcagtttaccttcgagcttatcattcacaccctctgtagggtctctttgctccttgggtctgtggtyccccaaggcacctctcatgtcactgagtcatgtgattcagtttgtcacccttatatcttctatgtacaaattcctgtgctagccactgtgcaaggcagacatgcagatcacgtggctcttcctgaacttgtgcagctctcaatcgagtaaggaaatggatgtccaaataaagtagaatgagaggcagaagtgcccaacagacgttacagccaagtgctgggaagataaacatgggttgttgccaccctctcaaacctatcaaaataaaatcacgcctcaatgctcagctcttgaagccat

SEQ ID NO: 21655 - DNA, 601 bp, Human
tcacctgtgacaactgatgctttatagttagagggcatgtgatttggaggctggcaactggggaccacatcctggggccatcttcctcagagagagatcatggaggggacgtgacctgcccaaggtgtgtggggcagtttaggaatgagactgcttttggtttcttcctttctcttctcttttccttccctttccttcccgtgctcccttccttaattagatgtgtttcagaagatctattactgatattgactaatccttgattaaaataaatgcagttttacttaaacactgagtcacstagaaactgcctttaaaaaagtcagaggaaacagctctctacacaggatgatttgtggggcaaaaataaccaagcccacaaagaccttctttgtctgtggctggggtgggctggggaggggcatggaggcagctctagttcctgctagggcattcttgctccagctttttgcataaacaccccaataatctctgaggccctccttacacctcagccactcactgcctgtctggctgggaggctgagccctgccgttcctcttacacccatttctaaagtgctgggttgtaattggaggat

SEQ ID NO: 21656 - DNA, 601 bp, Human
atgcatggtcccgcatctcaatgcctacgtgaggacctgatgggttttctttttaatttttattttttggcagttttggctcttgtccctgccccattccctcacctgtgacaactgatgctttatagttagagggcatgtgatttggaggctggcaactggggaccacatcctggggccatcttcctcagagagagatcatggaggggacgtgacctgcccaaggtgtgtggggcagtttaggaatgagactgcttttggtttcttcctttctcttctcttttccttccctttccttccygtgctcccttccttaattagatgtgtttcagaagatctattactgatattgactaatccttgattaaaataaatgcagttttacttaaacactgagtcacctagaaactgcctttaaaaaagtcagaggaaacagctctctacacaggatgatttgtggggcaaaaataaccaagcccacaaagaccttctttgtctgtggctggggtgggctggggaggggcatggaggcagctctagttcctgctagggcattcttgctccagctttttgcataaacaccccaataatctctgaggcc

SEQ ID NO: 21657 - DNA, 601 bp, Human
tctgcatctcatcccacagcgtgtgtgccttccacacagtcagggtcctcactatgcatggtcccgcatctcaatgcctacgtgaggacctgatgggttttctttttaatttttattttttggcagttttggctcttgtccctgccccattccctcacctgtgacaactgatgctttatagttagagggcatgtgatttggaggctggcaactggggaccacatcctggggccatcttcctcagagagagatcatggaggggacgtgacctgcccaaggtgtgtggggcagtttaggaatsagactgcttttggtttcttcctttctcttctcttttccttccctttccttcccgtgctcccttccttaattagatgtgtttcagaagatctattactgatattgactaatccttgattaaaataaatgcagttttacttaaacactgagtcacctagaaactgcctttaaaaaagtcagaggaaacagctctctacacaggatgatttgtggggcaaaaataaccaagcccacaaagaccttctttgtctgtggctggggtgggctggggaggggcatggaggcagctctagttcctgct

SEQ ID NO: 21658 - DNA, 601 bp, Human
atgtctagactccagggactcagaattcagattcacagctttctttgttcctgttcatctacgcggcaacatgtaaggggaaacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgyatttgctattagaaaaatttatcttcgctgtcctggtttggaaggcattttaataaatcatccaatttgtctgctctgcttccctgccagtctacacctaaatactactggagaactgcctcctgctcttcagattcctctcctaagagggtctcagtgtctgcacggcgccctttgcgccccagctttatgaatgctctaacatggccttgttctattaaaggctcttcctcatagcctattttcagcagggacccatctccatgcccatgtggtaaagaggatgtggggtccccgttg

SEQ ID NO: 21659 - DNA, 601 bp, Human
gaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacagctttctttgttcctgttcatctacgcggcaacatgtaaggggaaacagtgaatgtgaatagtaacctagagtccatgtaatgagttargttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggtttggaaggcattttaataaatcatccaatttgtctgctctgcttccctgccagtctacacctaaatactactggagaactgcctcctg

SEQ ID NO: 21660 - DNA, 601 bp, Human
gccttttgaatgattctcttgggcaagagagttaaagagaaacatgaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacagctttctttgttcctgttcatctacgcggcaacatgtaaggggraacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggtttggaaggcattttaataaatcatccaatttgtctgctctgct

SEQ ID NO: 21661 - DNA, 601 bp, Human
ggccttttgaatgattctcttgggcaagagagttaaagagaaacatgaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacagctttctttgttcctgttcatctacgcggcaacatgtaaggggaaacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggtttggaaggcattttaataaatcatccaatttgtctgctctgc

SEQ ID NO: 21662 - DNA, 601 bp, Human
attggaactgttttgacataaacacgcacacccacacctgaaggccttttgaatgattctcttgggcaagagagttaaagagaaacatgaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacasctttctttgttcctgttcatctacgcggcaacatgtaaggggaaacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggt

SEQ ID NO: 21663 - DNA, 601 bp, Human
tgaggcagaggaattcacagaggctctgccctcatatgaccgagctaatagtggactcacagaagaatgcctttctatttttctaacagcccccaaatacccaattcccaactgaatcaacacattgaagactagaacgactttcaaaggcataagaggccgggtgtggtggctcatgcctgtaatcccagcagtttgagaggatgaggcgggaagatcacttgatgtcaggagttcaagaccagcctggccaacatggttaaaccctgtctctactaaaaatataaaaattagccgggcrtggtggcaggtgcctgtaatcccagctactcgaaacgctgaggcaggagaattgcttgaacccgggaggtggaggttacagtgagctgagattgcgccactgcactccagcctgggcgacacagtgaaactccgtctcaaaaataaataaataaataaataaataaataaatacataaataaatggcataagaaagacactgacaaaaaacaaacagaccattggatgaaagggtatgtgggaagttcagatgggaagggaaaacctccaggtgaatttaaaactcaggcagtggagctg

SEQ ID NO: 21664 - DNA, 601 bp, Human
gaggggatggttaatgggtagaaaaatacagttagaagagaaaagatctagtgtttcatagcaccatagggcaaccataattcacagtaatttattgtatatttcagaacaactagaataatggaattgggatgttcctaacataaataataaatgtttaaggtgatggtatctcattacccttatttgattgttatacactgtatacttgtatcaaaaaatcacatggaccccataagtaagtacaactattatgtattcataaatttttttttaaaaaagctttggaaaatgctgtctwgtgtcagtggggtataaaacactctaaaactaggaagggctcattgtttgcttccagtatttaggggataatgaagtaggatcactctacctataggccacaagagaaaggtcagtataacctctcaaggtctaagttcactccacccatgattttttacctaagagttcactacagctgtgcaataaaattcctcctggagaattcagcttagaaagtgagagccgaaagtccatttttccattttaaagaccattctgttatcctctctggttgaatgcatgtcactcctgtctctgt

SEQ ID NO: 21665 - DNA, 601 bp, Human
gaagtggagttgggagagaggaataagaggggatggttaatgggtagaaaaatacagttagaagagaaaagatctagtgtttcatagcaccatagggcaaccataattcacagtaatttattgtatatttcagaacaactagaataatggaattgggatgttcctaacataaataataaatgtttaaggtgatggtatctcattacccttatttgattgttatacactgtatacttgtatcaaaaaatcacatggaccccataagtaagtacaactattatgtattcataaatttttttttaaaaaagctttggaaaatgctgtcttgtgtcagtggggtataaaacactctaaaactaggaagggctcattgtttgcttccagtatttaggggataatgaagtaggatcactctacctataggccacaagagaaaggtcagtataacctctcaaggtctaagttcactccacccatgattttttacctaagagttcactacagctgtgcaataaaattcctcctggagaattcagcttagaaagtgagagccgaaagtccatttttccattttaaagaccattctgttatcctctctggt

SEQ ID NO: 21666 - DNA, 601 bp, Human
tatgaagatggacagtagaatgatggttatcagagactgagaagtggagttgggagagaggaataagaggggatggttaatgggtagaaaaatacagttagaagagaaaagatctagtgtttcatagcaccatagggcaaccataattcacagtaatttattgtatatttcagaacaactagaataatggaattgggatgttcctaacataaataataaatgtttaaggtgatggtatctcattacccttatttgattgttatacactgtatacttgtatcaaaaaatcacatggaccccrtaagtaagtacaactattatgtattcataaatttttttttaaaaaagctttggaaaatgctgtcttgtgtcagtggggtataaaacactctaaaactaggaagggctcattgtttgcttccagtatttaggggataatgaagtaggatcactctacctataggccacaagagaaaggtcagtataacctctcaaggtctaagttcactccacccatgattttttacctaagagttcactacagctgtgcaataaaattcctcctggagaattcagcttagaaagtgagagccgaaagtcc

SEQ ID NO: 21667 - DNA, 601 bp, Human
cttctgcaccagatcaagcatgaggttcaaaggccgtttgcacatttgaggctgttctgccgagtccaacacacacacacacacacacacacacacacacagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttactttacctggttgtgtttgatgtcttcagcgggcgcaccatawgaattcctatacaaagttgaaattccagtgttttgagctaaaagcaaaaggaaaacaaaagtttagcaaagaaaacaacattacaaataaggaatagttgttattgaagcaagttcttgccctaacaaagcttgttttcttggggaccattccaagtagaagacattctttggccctgaacacttcattttacatacagatattaaaaaaggagaacagttattctagaaaatccccacagcatgtcagccgcttgcaataatgttcacatcacagacagggtcagggcagatgctgcaa

SEQ ID NO: 21668 - DNA, 601 bp, Human
gggtttcttttagttttgcaccatagcagaatacttgccttctgcaccagatcaagcatgaggttcaaaggccgtttgcacatttgaggctgttctgccgagtccaacacacacacacacacacacacacacacacacagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttacttttcctggttgtgtttgatgtcttcagcgggcgcaccataagaattcctatacaaagttgaaattccagtgttttgagctaaaagcaaaaggaaaacaaaagtttagcaaagaaaacaacattacaaataaggaatagttgttattgaagcaagttcttgccctaacaaagcttgttttcttggggaccattccaagtagaagacattctttggccctgaacacttcattttacatacagatattaaaaaaggagaacagttattctagaaaatccccacagcatgtcagccgcttgcaataa

SEQ ID NO: 21669 - DNA, 601 bp, Human
cccaactagactttgagtagcaagacactacaatgcatttcatgtattgcagaataatagaacttatttatgtgttcttttacaagttctctattgaacttgctgtgtctcctttattggtagtgatcatgtataatgaatgcttccttcctaatgcatttgcagggttacaggagctactccatctctgtccagtaattagacaattcctgtttagtgacatcttacagttgtctatttgggggtttcttttagttttgcaccatagcagaatacttgccttctgcaccagatcaagcaygaggttcaaaggccgtttgcacatttgaggctgttctgccgagtccaacacacacacacacacacacacacacacacacagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttactttacctggttgtgtttgatgtcttcagcgggcgcaccataagaattcctatacaaagttga

SEQ ID NO: 21670 - DNA, 601 bp, Human
aacacgtatcctcctgggatctcatcttcctcatttctgcagacaattacaactggcctgctcacgtgacagtggaactaaggacaccaggaaggaactcaagattccggttttgttatcatttaaatattggtcatcaaaacagcaaagctctttgtttctagttcctgaacaaaaatcctgttgtcagctagatagataccgttcaacatgatatttctctttgtaattatggggtggactggtagaagctcaaaaggatgtttggaaagtatgcatagttaagtctttttttttttttgagacagggtctcgctttgtcactcaggctggagtgcagtagtgcaattatggctcactgtagcctccaccttccaggttcaagccttcctcctgcctcagcatcccagctagctgggactacaggcacacaccaccatgcccagctaatttttgtattttttgtagacacacagttttgctatgttgcccaagctggtcttgaactcctgagctcaagcgatctgcctgcctcggcctcccaaaatgctaggattacaggcattagccactgcacctagtcagttaagtcttaaagtga

SEQ ID NO: 21671 - DNA, 601 bp, Human
caaagcataatcccaagaccagcagcatcagcatcacctgggaacttgttagaaatgcagattactgggtcccactccagacctactgaatcagggcctctggcgatgggccccagcaatctgtgctttaacagccctttggggaattctggctcatgctccaatttgagaaccattggcacagaggtaaaaaaaatgggacaggaagacagaagaaccaagatgagtatttgcctcttcctggctgggggactgaaggaaacacgtatcctcctgggatctcatcttcctcatttctgcrgacaattacaactggcctgctcacgtgacagtggaactaaggacaccaggaaggaactcaagattccggttttgttatcatttaaatattggtcatcaaaacagcaaagctctttgtttctagttcctgaacaaaaatcctgttgtcagctagatagataccgttcaacatgatatttctctttgtaattatggggtggactggtagaagctcaaaaggatgtttggaaagtatgcatagttaagtctttttttttttttgagacagggtctcgctttgtcactcaggctggagtgcagt

SEQ ID NO: 21672 - DNA, 601 bp, Human
tgttagcataatgacaaaagacttctttgggtttattccttaatgaatttgccaggaaactggatttattttgaacacaagggaaatagtagcccagtatagctcttccaacttttccatgtctcagagtgttcatagaaagactcagagtgttcacagaaaatgaaggaggccagatatgaagtatcagtggtcttcaaagcataatcccaagaccagcagcatcagcatcacctgggaacttgttagaaatgcagattactgggtcccactccagacctactgaatcagggcctctggygatgggccccagcaatctgtgctttaacagccctttggggaattctggctcatgctccaatttgagaaccattggcacagaggtaaaaaaaatgggacaggaagacagaagaaccaagatgagtatttgcctcttcctggctgggggactgaaggaaacacgtatcctcctgggatctcatcttcctcatttctgcagacaattacaactggcctgctcacgtgacagtggaactaaggacaccaggaaggaactcaagattccggttttgttatcatttaaatattggtcatcaaaaca

SEQ ID NO: 21673 - DNA, 601 bp, Human
ggacgcttgggttatttttaccttttagctgctgtaaataatgttgcaataaacattggtgcatttgtatctgttctagtccctggggtcccttttcaagcacctgcccctgaaatgagcagaacctcccaaggtatagggtgaggttaaccctacagcaagtgcataccgggatgcacaaagctctgctaatgtgcagtaattggggaggagatctggtgtgaattattaaacactcttaaagaaatactgtttgatcacttttgggtggactcagtgactccctattaatttaactaargttcagcacggaaacgttctctagaaattggtcttagttaatagataatgatttgtaattagcacgttgtgtgtaaatgaatgcttttaaaggcttacacataattcttctctcaagtaagtgaaactccctcttatatatgtcattgatttatactagtaatcaacctgatcttcaaagaagtggtgaacttcatcacagcagctgtctaggatgtcccacgtgtctagttagtggtagctgaatgaatgaggtttctgtctacctacagaagtccaaaagtccatagaggataaacct

SEQ ID NO: 21674 - DNA, 601 bp, Human
tgaaggccatgactttacctcaatgtagcaaaactgcacttgcacccccatgattgtatatatataagaataaaatagtccatggtatgcatagaccacattttatttatccattcatccattgatggacgcttgggttatttttaccttttagctgctgtaaataatgttgcaataaacattggtgcatttgtatctgttctagtccctggggtcccttttcaagcacctgcccctgaaatgagcagaacctcccaaggtatagggtgaggttaaccctacagcaagtgcataccgggawgcacaaagctctgctaatgtgcagtaattggggaggagatctggtgtgaattattaaacactcttaaagaaatactgtttgatcacttttgggtggactcagtgactccctattaatttaactaaagttcagcacggaaacgttctctagaaattggtcttagttaatagataatgatttgtaattagcacgttgtgtgtaaatgaatgcttttaaaggcttacacataattcttctctcaagtaagtgaaactccctcttatatatgtcattgatttatactagtaatcaacctgatct

SEQ ID NO: 21675 - DNA, 601 bp, Human
gtgctatcattctacataatctttatcatggcaaaatatacataacataaaacagcttgctttaagaaatgttgaagtgtaagattaattaggtggcattaagaacattcacagtgttgtgcaaccatcaccaccatccgtttccaccactttttaaatcatcccaaacagaaactctgtgcccattaaatgtaattcctcatcccctctctctcagcccatggcaagcaccattctactttctgtctctagaaatctgcctaatataggcactgcagagagtgtttgtccttgtgtgacwggcttctttcacttagcataaagtttgcatggtccatccatggtgttgcacatggcagaccttgatccgtttttgtggctgaataatattccactgtatgatgtgcattgctccactgatgaatgcactgaaggccatgactttacctcaatgtagcaaaactgcacttgcacccccatgattgtatatatataagaataaaatagtccatggtatgcatagaccacattttatttatccattcatccattgatggacgcttgggttatttttaccttttagctgctgtaaataatgttg

SEQ ID NO: 21676 - DNA, 601 bp, Human
gacgggcagctgagtagaagtcaacgtagttgccggtggacttgagacccaggtgcatggtgtactcgctggcgggagggcgatggtggacctggtcctcgaagaaggactcatcgtaatttcttgtggaattctgaaatggctggtaggtctcgtaatcttttctgctgggctcctgtgggactggctgtgctgaaacctaaacgggaaagaagagccacactgggttacttggtttcccttgactcagcctgcctcttgccccggcacccaactctccttcaaagaataggctgtgtayatccaggcattcaccactgtggccctgcttctccaaaactgccaactgtcattggctttccttttgaaaattggatcctaggtccacgtgctatcattctacataatctttatcatggcaaaatatacataacataaaacagcttgctttaagaaatgttgaagtgtaagattaattaggtggcattaagaacattcacagtgttgtgcaaccatcaccaccatccgtttccaccactttttaaatcatcccaaacagaaactctgtgcccattaaatgtaattcctcatcccctctctc

SEQ ID NO: 21677 - DNA, 601 bp, Human
ggaaatccatacatctttcaaaagtttgaaattgaagcaatatttagaaccatagatgaggaaacacggcggcattggtgtaatatacacaacgcgcttttcttctttaatctgtaatgtacatcaaatactttacaacaatgcattaacaaaaggcaagaaacatcttgctgtacagaggaaccccaatgcaacctgaagcctagagtcacaacggatgaagagagtaaacaaagcgtgagaagccgtcccccacacagtgtgtaaactattctgtgtcttgtgcttaacgataaccctyacgccccaccggcccgaatgcctcgtctctcctcccatcaaccacgttcagtataaagcacttctcgttactctacagctcacgctagaaaggtgctgcccactgtcatatttaggatcactttagctttctactgatttccaagttaacttgcgattcatttagctttctaaaatagctcttaatatttccttactggttatcacagccttcctatggaacaggctttaacaaactaaatttgcaggagaaaaaaacaaaacagaaagaaatgtcttgtggtatgcatgcacatgcact

SEQ ID NO: 21678 - DNA, 601 bp, Human
gatataggttcttggaaatagacattcttagcaaatatggatgacagatcaattgtaatttattttcttttaacactgtatcatcataaagaaaactggtataaatgaaaaaatctatttcaaatatctacatctaaaattttaggcagtgaaaaagcactttgttgacaaggagtgtggaatgatgtatgttaattgtcagaaactgctgaatgccttgtttagttgtcacaaacaaattcacatatcagaacgaacaatactgctaaatattccttttttcctgcttttttttttttttgttaaaacatactgggagaaagtaaagaaaaactggaaatccatacatctttcaaaagtttgaaattgaagcaatatttagaaccatagatgaggaaacacggcggcattggtgtaatatacacaacgcgcttttcttctttaatctgtaatgtacatcaaatactttacaacaatgcattaacaaaaggcaagaaacatcttgctgtacagaggaaccccaatgcaacctgaagcctagagtcacaacggatgaagagagtaaacaaagcgtgagaagccgtcccccacacagtgtgta

SEQ ID NO: 21679 - DNA, 601 bp, Human
gaacttatgaaagttctgacaatctggatttgaggcggggaatagcagaggcctagatggagcaggcatgacgttgagacaggagtgtgtgttgtgttaggagatggcacataactgtgctttgttaaacgttagacagaattgaaatttttaagttttacccaaggattctgtcagcagtagaagtgtcattagctatggtgtaacaactacatagtattacagtctattttccttattttttcaagttaaatatcctgtccaatgaattttttaaaagacaaaatctttttaaatttattttttttactttgactttaaaacttcccagtgtaaaaatgaagtctttagagcaaaaaacaatctataaaatatttagtcttaaatttaaaaaatcttaaaacattgtttcagtattttttctaatcaaagtaataagagtctaatgtagaaaacttggaaagccaaaaatagcacagaggaggaaacatgcctaataatctcatctccaaatatatgtcatgttttaccttttcaatggttctagaatactttatttagaatgttgcatattggctttgtctgacacatttaatttttt

SEQ ID NO: 21680 - DNA, 601 bp, Human
cagcagtagaagtgtcattagctatggtgtaacaactacatagtattacagtctattttccttattttttcaagttaaatatcctgtccaatgaattttttaaaagacaaaatctttttaaatttattttttttactttgactttaaaacttcccagtgtaaaaatgaagtctttagagcaaaaaacaatctataaaatatttagtcttaaatttaaaaaatcttaaaacattgtttcagtattttttctaatcaaagtaataagagtctaatgtagaaaacttggaaagccaaaaatagsacagaggaggaaacatgcctaataatctcatctccaaatatatgtcatgttttaccttttcaatggttctagaatactttatttagaatgttgcatattggctttgtctgacacatttaattttttaaaaagttaataaattatattagatcagggagaggaaaataagtccaaatatttaggtaaatatagtaatatatatatttggaagagaaattttgtttttacttcatttgttcatgtaaaagaaggggatatttaaaagttacaagtaacatccttccatttaatggctgaatc

SEQ ID NO: 21681 - DNA, 601 bp, Human
ataaattatattagatcagggagaggaaaataagtccaaatatttaggtaaatatagtaatatatatatttggaagagaaattttgtttttacttcatttgttcatgtaaaagaaggggatatttaaaagttacaagtaacatccttccatttaatggctgaatcagtgcagttaggtaattaatatttttggcaaacccagtcggtttgcccttgatgtttatgttaaggaaataattaaggtgctttcccaagttgtgagtgactagagccaccccctccaaagatgtaacctctgccytgattctgttaccagaacttctttctgtttccctgagcaaaataaatcgggcctgactcattttatctactcagcctcgttgccctgttccctgtcactcttacctcccccttctctcccttctctctctctggaggtgctggcacctagagtacaggctcctgtctgaggtcctgcagttccccgttcctgtgacagtgcagtgcctgtcccgctttagagcccaggactctgatcctgtgcgtaagataggggaagcctaggaaccatatggagagcgtgggtcttccgtgcttctgc

SEQ ID NO: 21682 - DNA, 601 bp, Human
agtgttttgtatactttaattgtatatacttaagccttaaaacaacatagtaaggtgagaattattatacatatggcaaggaggaaacagaggcccagagattttcatgcccagagtaacaagtgcagttgggatttgaacccaggtccctctgactctcacagctgctctgttatcatttgcactgtcctctgctgcctcccgtgtttcataaacctgtttcctcatgtgtaaagtaggaacagctatacctagcatctcagggtcattacaagaattcagcaaaatactgtattcacamgcattctgtaagcttataaatgatattgaaatgataatcatgtactgtgccaagttaaatggatctggtctgcatctttgttgtgtgacttggcaaaagctgatcagtgagagccacttctttcctcagcctaaatgtcaatgtggacaatgccatcgtccttgcagggttgtgaaggggaatctgaagacatgtaaaatttcatggtaaatttcccattccttaactaatatttataacattgttttctgggaagacactaagctagcttataaaataaccaacagcgggaatgcatct

SEQ ID NO: 21683 - DNA, 601 bp, Human
ggactactaaggtgtgtgtggagcataatgagctattggaagtataagagattgaactctacgacctttagagttagattccacaggcaaattatgataagccttttaatcaaaggaaattaatcaaaggaagatagagtagccagatttgtggagtagtcagtgttgcttttgacaagtgggtatgtcaagaagattgagcaaataaagtaatagcttgtgtttacagagtaagtcagctgtggacccgtcaactacttcttttatttacttagcaaactggtattgagcgcaacctagrtgcacacagttcatatataaataaaagatctagctgggcacggtagctcatgcctgtagtcccagcactttgggaggccgaggcaggcggatcacaaggtcaggagttcgagaccaaccaggccaatgtggtgaaaccctgtctctactaaaaatacaaaaattagcagacgtggtggtgggcacttgtagtcccagctcctcgggaggctgaggcaggagaatcgctttaacccaggaggtggaggttgcattgagccaagatcgcaccactgcactcctgcctgggcgatagaacaag

SEQ ID NO: 21684 - DNA, 601 bp, Human
gttcatatataaataaaagatctagctgggcacggtagctcatgcctgtagtcccagcactttgggaggccgaggcaggcggatcacaaggtcaggagttcgagaccaaccaggccaatgtggtgaaaccctgtctctactaaaaatacaaaaattagcagacgtggtggtgggcacttgtagtcccagctcctcgggaggctgaggcaggagaatcgctttaacccaggaggtggaggttgcattgagccaagatcgcaccactgcactcctgcctgggcgatagaacaagactgtctcaaaaaaaaaaaaaaaagatctttggtgggttggggtggggtcagtgtggttgggaaggagataatacagaagagaacccaagttcctccactcaagaagtttctgcagaataaacctggaaaacagtgttcttagatgacatttattctgattatactgcccataattagcactcaggtaaaagaaattaattgcaggatacaggccgtagttgtgtttcctgattattatttgagttttggcatcactgctctttggcccatgggtctcgtataaccagaatgaagagatttcattagca

SEQ ID NO: 21685 - DNA, 601 bp, Human
ctgggcacggtagctcatgcctgtagtcccagcactttgggaggccgaggcaggcggatcacaaggtcaggagttcgagaccaaccaggccaatgtggtgaaaccctgtctctactaaaaatacaaaaattagcagacgtggtggtgggcacttgtagtcccagctcctcgggaggctgaggcaggagaatcgctttaacccaggaggtggaggttgcattgagccaagatcgcaccactgcactcctgcctgggcgatagaacaagactgtctcaaaaaaaaaaaaaaaagatctttggygggttggggtggggtcagtgtggttgggaaggagataatacagaagagaacccaagttcctccactcaagaagtttctgcagaataaacctggaaaacagtgttcttagatgacatttattctgattatactgcccataattagcactcaggtaaaagaaattaattgcaggatacaggccgtagttgtgtttcctgattattatttgagttttggcatcactgctctttggcccatgggtctcgtataaccagaatgaagagatttcattagcaaaaaagaaaaattataaaatgtgtt

SEQ ID NO: 21686 - DNA, 601 bp, Human
cactgcactcctgcctgggcgatagaacaagactgtctcaaaaaaaaaaaaaaaagatctttggtgggttggggtggggtcagtgtggttgggaaggagataatacagaagagaacccaagttcctccactcaagaagtttctgcagaataaacctggaaaacagtgttcttagatgacatttattctgattatactgcccataattagcactcaggtaaaagaaattaattgcaggatacaggccgtagttgtgtttcctgattattatttgagttttggcatcactgctctttggcccrtgggtctcgtataaccagaatgaagagatttcattagcaaaaaagaaaaattataaaatgtgttaaattaatgttagagattgttagagatgactactacagttctcttccaagaaaatattccaaacatagattttattttccctctaaagcatccagcctttagtaattgccttcaaaggctatgtgtggttcagaaaactcagtgggttaggcacaggtctttgctttagttacagaagattcattcaaaggacttgttaacctgggtacacatatcttaagaggtttattttatga

SEQ ID NO: 21687 - DNA, 601 bp, Human
tgataagcctttgtaggggcagggggcagtaggtacttgattttgttacacttggttggcaaactacagcctcagaggcagttgaaaaatagagtatataagaatgagcaggccaggcatggtgactcacacctataatcacagcactttgggaagccaaggcgggtggatcccctgaggtcagaagttcgagaccagcctggccaacgtggtgaaatcccttgtctactaaaaatacaaaaattagctggctgtggtggcacgtgcctgaagtctcagctactggggaggcagaggcgaragaattgcttgaacccgggaggtggagggagccgagatctcaccattgcactccagcctgggccacagacacagactccacctcaaaaagaaaagaaaaggaaaagaaaagacaacgaacaagcaaatctgtgttcttgcccaatcttactaaattgctctctaggacagtatagggctttactattttatcatgttgcgtcttggtttccccattaaaaatagaagtctgggactatacccaaggatcacattgattcctttccattttctcgttctgtggtttgggtagttttatgtt

SEQ ID NO: 21688 - DNA, 601 bp, Human
aaataagtgaacgagtattatggtatggaggaagaaccctaagctaggagttaggagatctagggtttttgccttgtcctcagaatttgccctgagaattatgtagaaccatgtttctatgatgaataatttaagcatttagaatggagatgaagaaatatggaagaaggaatattgaattcaagtaaggccattaggcatcacatagtatttaagcttcttggcatcactgtttttcatcattaaagtgaggagatgagacattcactgatatcttatagccctctctgtaatagttaakagggaggtagtgtaaactgctttgtaaactgccaaagactacagagtttattatccttctctagattctgtgataatgtctacaagcactcttaatcccttcaaattgagaaactgaaagataatagttcataaatatacttctaaaaccatactgtggtaagctttacacaaaatgtacattggctaccatgtagaaaaacatagctgtctagctctctgcttaatgacagtaaattcccctgtcctcatgttttaggggacacttggggattgactttcataggaaaagctgatgcta

SEQ ID NO: 21689 - DNA, 601 bp, Human
acattcactgatatcttatagccctctctgtaatagttaatagggaggtagtgtaaactgctttgtaaactgccaaagactacagagtttattatccttctctagattctgtgataatgtctacaagcactcttaatcccttcaaattgagaaactgaaagataatagttcataaatatacttctaaaaccatactgtggtaagctttacacaaaatgtacattggctaccatgtagaaaaacatagctgtctagctctctgcttaatgacagtaaattcccctgtcctcatgttttaggrgacacttggggattgactttcataggaaaagctgatgctagaattgtctagcatgactggaaataactgatcagggcaggcctcccacatcaacatttacctcattccttctgtttagagaactgattaggggtggggtagaatattctaaagaatactctttattttaattttaatttaatttaatattattttatttgagatggagtcacactctgttacccaggctagagtgcagtggcacaatctctgctcactacagcctctgcttcccaggttcaagtgattctcttgcctcag

SEQ ID NO: 21690 - DNA, 601 bp, Human
atattctaaagaatactctttattttaattttaatttaatttaatattattttatttgagatggagtcacactctgttacccaggctagagtgcagtggcacaatctctgctcactacagcctctgcttcccaggttcaagtgattctcttgcctcagcctcccaagtagctgggattacaggcatgcaccaccacgcctggctaatttttgtatgtttagtagaaacagtgtttcaccatgttggccaggctggtctcaaactcctgacctcaggtgatccacccacctcggccacccaragtgctgagattacaagaatactctttaggagagcaatgttcaagatgacttgggcacccaacacttaactactcctcctacaagtagacccagcacttaactattactcctagagactaggaacaagagtggggatttttgtgtaccttcatggcaaattcatgcattgtcttggtagatagactctgctggcagcatcattgaatggggacctgaagaggtcctggtgaaatgcatcattctgaatcgcactaactaaaaatgtttcttgtggtgtgaaagtaagtcaatctaaaaaa

SEQ ID NO: 21691 - DNA, 601 bp, Human
aaaaaggaacctgagttgggtggtaggggatggcacatgatgtggctcagttcactcatggcaggagccgtgactgcccggcagtaggaatggcctttttatattaaactttgaaccccagcatgtcctaagaatgggtaagtgggaagcattgacacagttcaccctgagttactcctggggagaattttatagccaagtcagccttcagttcaaaccaaggagggggagaggggataaactggggatgagaggagaaagcagggaagtgattgccgaagagaagtagggacgactggarctctgatctggacgaggttgtgtcagagccagagaattccttgtagctttttcttccatgtttttagatgagtcgtgactgctgctgggagaaaccaccagaattatattctctcgaaggtgaaaattaattggattgaagcttatctgttagttttgcctggaaattctgcctggattatctggggcaaaagataagatgaagtgccctctagtgacccaactaagtggtggtcactggagctcatttgattgactgatagtggctctgtctaatgctttggttcttttgtgggaaatc

SEQ ID NO: 21692 - DNA, 601 bp, Human
ttaaaaaatgtcttgggggagctacttcgagactatgcagatatgttatttcttatttaacttttgcctattgattttagcatctattgatagattttgcctggagtcagggtatttttgaaccaataagaaattatatttcttggaaggatgacatcatgataaaagtatcccctgtctcatgtagggatttagagattatttccagtagactggtgcagccactagcaggaaaagatgatgaaggaatacgtgtatggaacagagcattactaaattggtgggataccatgtccaactrcaacttgatggtcacatacccatatctgagaaggactgttgtttgtgttagtgatcatggaagcagatgttctgaggacagcggccagtatgtgggaagtccagaccaaagaaacatttaggagacaagactttattcgtgctctctttgtggttttcttctgttccagcagagtaccatgggttaagaattaatcttcctcgtagtgtaatggttggatgttggcatgtaaaagacttgtacttcctcttcccagtggaaagcaggtgggccactccaaagtgtcattcagaaacctgt

SEQ ID NO: 21693 - DNA, 601 bp, Human
atagaaaggatgagcgttagagttagaataccatattacccatagatgtttgatgcacaaagcattgcatcagttatttatttgctggtaatttattctaataaaggatttattggtagtttgaagaactggaagagaacaaggctcatttcattgaagactcccagaatgaaataatttgcaaaacttatttaaaagtccaattgatgtagtctccagagcacctggtcagattgaaaaataaacagatttgtttggaaaaatcaacagtgcagttaaatatgtgttgacccttattttwaaaatgtaagtaggagcagatgaaggggaatacaattaaatttgttaaggagttactaagaaagagtaaggtcatggttgataaccttagttgaagataccccactgaatatgataaatcatgttgagccagttttgggaaacaatttgacaatttcttacagtgttaaaatatgtacagtcaccatatgatccagcagttactaagacaaaggaaagcatacgccagtgttcacatgagtgttcaagcagcattattcataatactgcaaaacaaaaatgcatttacctttattcatag

SEQ ID NO: 21694 - DNA, 601 bp, Human
attgcatcagttatttatttgctggtaatttattctaataaaggatttattggtagtttgaagaactggaagagaacaaggctcatttcattgaagactcccagaatgaaataatttgcaaaacttatttaaaagtccaattgatgtagtctccagagcacctggtcagattgaaaaataaacagatttgtttggaaaaatcaacagtgcagttaaatatgtgttgacccttatttttaaaatgtaagtaggagcagatgaaggggaatacaattaaatttgttaaggagttactaagaargagtaaggtcatggttgataaccttagttgaagataccccactgaatatgataaatcatgttgagccagttttgggaaacaatttgacaatttcttacagtgttaaaatatgtacagtcaccatatgatccagcagttactaagacaaaggaaagcatacgccagtgttcacatgagtgttcaagcagcattattcataatactgcaaaacaaaaatgcatttacctttattcatagtagtgaaagaataaaaacccattcacgactgaaaaaatgaaaatcagcttaaactaaaaaaga

SEQ ID NO: 21695 - DNA, 601 bp, Human
aaataaacagatttgtttggaaaaatcaacagtgcagttaaatatgtgttgacccttatttttaaaatgtaagtaggagcagatgaaggggaatacaattaaatttgttaaggagttactaagaaagagtaaggtcatggttgataaccttagttgaagataccccactgaatatgataaatcatgttgagccagttttgggaaacaatttgacaatttcttacagtgttaaaatatgtacagtcaccatatgatccagcagttactaagacaaaggaaagcatacgccagtgttcacatragtgttcaagcagcattattcataatactgcaaaacaaaaatgcatttacctttattcatagtagtgaaagaataaaaacccattcacgactgaaaaaatgaaaatcagcttaaactaaaaaagaaaaaagtcttgacgtttatcagccggaaggacagatacagattaaagtcagccacagagtttatagaaaacattgtctctcccaaggttatagagtagtagtaaagcatagactattgctgtcttttctagtgttgcccgcagacccacatttctctacccatcctttactggaa

SEQ ID NO: 21696 - DNA, 601 bp, Human
cttaaactaaaaaagaaaaaagtcttgacgtttatcagccggaaggacagatacagattaaagtcagccacagagtttatagaaaacattgtctctcccaaggttatagagtagtagtaaagcatagactattgctgtcttttctagtgttgcccgcagacccacatttctctacccatcctttactggaatactcaattactaaatggccccacctcctcacagctcccacttcctgtttaatcctcatttttcctaatctcagaaacagctgattgacagctgatggctacttccttamaacctcctgagaatccttcagcatccctgctcttgtccagtggcattccgtggttcctcgtaatgccgtcctcactagtcaatctgattttgatagaccacacacttgctccttgtcagtttggctgactgggctttgacagtagccccaaactggaaacacagtattcattaacaggtgactggataagcaaacttgtgttatagtccattgaaatactaaaataactatatatacaataacggctcaatctcagaaatgttatgctgaataaaagaagacaagaaaatacatactgta

SEQ ID NO: 21697 - DNA, 601 bp, Human
cccaaggttatagagtagtagtaaagcatagactattgctgtcttttctagtgttgcccgcagacccacatttctctacccatcctttactggaatactcaattactaaatggccccacctcctcacagctcccacttcctgtttaatcctcatttttcctaatctcagaaacagctgattgacagctgatggctacttccttacaacctcctgagaatccttcagcatccctgctcttgtccagtggcattccgtggttcctcgtaatgccgtcctcactagtcaatctgattttgataraccacacacttgctccttgtcagtttggctgactgggctttgacagtagccccaaactggaaacacagtattcattaacaggtgactggataagcaaacttgtgttatagtccattgaaatactaaaataactatatatacaataacggctcaatctcagaaatgttatgctgaataaaagaagacaagaaaatacatactgtagtattctattcatgtggttccagaagaagagctaatctacagtggtagaatctgatcagtggcttcctgggtccagggttttggagtcccatctat

SEQ ID NO: 21698 - DNA, 601 bp, Human
ctcatttttcctaatctcagaaacagctgattgacagctgatggctacttccttacaacctcctgagaatccttcagcatccctgctcttgtccagtggcattccgtggttcctcgtaatgccgtcctcactagtcaatctgattttgatagaccacacacttgctccttgtcagtttggctgactgggctttgacagtagccccaaactggaaacacagtattcattaacaggtgactggataagcaaacttgtgttatagtccattgaaatactaaaataactatatatacaataacgrctcaatctcagaaatgttatgctgaataaaagaagacaagaaaatacatactgtagtattctattcatgtggttccagaagaagagctaatctacagtggtagaatctgatcagtggcttcctgggtccagggttttggagtcccatctattgtaaccagcatgagggaacttccttgggagagggttggagtggtgcttaatggatatagacacatttattaaaagtgatcagcccacgtgattaacatgttaactttattgtgtgaatattataccttattaaagttcagcagaagag

SEQ ID NO: 21699 - DNA, 601 bp, Human
gataagcaaacttgtgttatagtccattgaaatactaaaataactatatatacaataacggctcaatctcagaaatgttatgctgaataaaagaagacaagaaaatacatactgtagtattctattcatgtggttccagaagaagagctaatctacagtggtagaatctgatcagtggcttcctgggtccagggttttggagtcccatctattgtaaccagcatgagggaacttccttgggagagggttggagtggtgcttaatggatatagacacatttattaaaagtgatcagcccacrtgattaacatgttaactttattgtgtgaatattataccttattaaagttcagcagaagagtatgcaatgccaaggtgttaatccaggattggggtgagttgcaggtaatggagttagtagttgttctaaacagttacccagaaacacctggaatataacctcagatttcctttttttttttttaattaaatattcttttttacacatgaatttccaggctgtgaatatctttttgattcagggtctggttctgtcacctaggctggagtgcagtgacatgatcaaagcttcactgcagcc

SEQ ID NO: 21700 - DNA, 601 bp, Human
tgggtccagggttttggagtcccatctattgtaaccagcatgagggaacttccttgggagagggttggagtggtgcttaatggatatagacacatttattaaaagtgatcagcccacgtgattaacatgttaactttattgtgtgaatattataccttattaaagttcagcagaagagtatgcaatgccaaggtgttaatccaggattggggtgagttgcaggtaatggagttagtagttgttctaaacagttacccagaaacacctggaatataacctcagatttccttttttttttttwaattaaatattcttttttacacatgaatttccaggctgtgaatatctttttgattcagggtctggttctgtcacctaggctggagtgcagtgacatgatcaaagcttcactgcagcctcaaaatcctggtctcaagtcatcctcctaccccagcctcccaagtagctacgaccacaggcacacatcaccacacccagctaatttttcgaagtttttattatgacagagtctcgctatgttacccaggctggtctcaaacccctgacctcaagtgatccccccactgtcttggcctccaaa

SEQ ID NO: 21701 - DNA, 601 bp, Human
ccatctattgtaaccagcatgagggaacttccttgggagagggttggagtggtgcttaatggatatagacacatttattaaaagtgatcagcccacgtgattaacatgttaactttattgtgtgaatattataccttattaaagttcagcagaagagtatgcaatgccaaggtgttaatccaggattggggtgagttgcaggtaatggagttagtagttgttctaaacagttacccagaaacacctggaatataacctcagatttcctttttttttttttaattaaatattcttttttacrcatgaatttccaggctgtgaatatctttttgattcagggtctggttctgtcacctaggctggagtgcagtgacatgatcaaagcttcactgcagcctcaaaatcctggtctcaagtcatcctcctaccccagcctcccaagtagctacgaccacaggcacacatcaccacacccagctaatttttcgaagtttttattatgacagagtctcgctatgttacccaggctggtctcaaacccctgacctcaagtgatccccccactgtcttggcctccaaagtgctgagattacactatgcc

SEQ ID NO: 21702 - DNA, 601 bp, Human
acaattggtagtataatttttattttccttaaatattctaaatcagtaggtcttaacgagaagtgtgcatattagataatagaattttagaagtaataacacatgacttcacaccctagaaattgacatttggcaggtctagggtggggtctggacacttgtacaggcacacttcagagttatcgcacactgcgataaatcacatgaatttttttgtttttccagtgcataaaaggttatgtttatactatattgtagtctaaaatgtgcagtagcattatgtgtaaaaaaacagtgtagwtaccccaattaaaaaaatattgctaaaaaatgctaatgattatctgagccctcagtgagtcttaatctctctgctggtgaaaggtcatgcctcactgttgatgactggtggctgatcaggatggtagttgctgaaggttgcagtggctatggcaatttctttctttggttgttgggttttttgttgtttgttttctgagacaaggtctcgctctctgttgcccaggctggagtggagtgatacaattatggcccactgcaacctctgccccctgggttcaagtgatcctcccacctcagc

SEQ ID NO: 21703 - DNA, 601 bp, Human
agaattttagaagtaataacacatgacttcacaccctagaaattgacatttggcaggtctagggtggggtctggacacttgtacaggcacacttcagagttatcgcacactgcgataaatcacatgaatttttttgtttttccagtgcataaaaggttatgtttatactatattgtagtctaaaatgtgcagtagcattatgtgtaaaaaaacagtgtagataccccaattaaaaaaatattgctaaaaaatgctaatgattatctgagccctcagtgagtcttaatctctctgctggtgraaggtcatgcctcactgttgatgactggtggctgatcaggatggtagttgctgaaggttgcagtggctatggcaatttctttctttggttgttgggttttttgttgtttgttttctgagacaaggtctcgctctctgttgcccaggctggagtggagtgatacaattatggcccactgcaacctctgccccctgggttcaagtgatcctcccacctcagctttccgagtatctgggactacaggcataagccaccacacctgactaattcttgtattttttgtagagatggggtttcacc

SEQ ID NO: 21704 - DNA, 601 bp, Human
gaagtaataacacatgacttcacaccctagaaattgacatttggcaggtctagggtggggtctggacacttgtacaggcacacttcagagttatcgcacactgcgataaatcacatgaatttttttgtttttccagtgcataaaaggttatgtttatactatattgtagtctaaaatgtgcagtagcattatgtgtaaaaaaacagtgtagataccccaattaaaaaaatattgctaaaaaatgctaatgattatctgagccctcagtgagtcttaatctctctgctggtgaaaggtcatkcctcactgttgatgactggtggctgatcaggatggtagttgctgaaggttgcagtggctatggcaatttctttctttggttgttgggttttttgttgtttgttttctgagacaaggtctcgctctctgttgcccaggctggagtggagtgatacaattatggcccactgcaacctctgccccctgggttcaagtgatcctcccacctcagctttccgagtatctgggactacaggcataagccaccacacctgactaattcttgtattttttgtagagatggggtttcaccatgttgcca

SEQ ID NO: 21705 - DNA, 601 bp, Human
taaatcacatgaatttttttgtttttccagtgcataaaaggttatgtttatactatattgtagtctaaaatgtgcagtagcattatgtgtaaaaaaacagtgtagataccccaattaaaaaaatattgctaaaaaatgctaatgattatctgagccctcagtgagtcttaatctctctgctggtgaaaggtcatgcctcactgttgatgactggtggctgatcaggatggtagttgctgaaggttgcagtggctatggcaatttctttctttggttgttgggttttttgttgtttgttttctgagacaaggtctcgctctctgttgcccaggctggagtggagtgatacaattatggcccactgcaacctctgccccctgggttcaagtgatcctcccacctcagctttccgagtatctgggactacaggcataagccaccacacctgactaattcttgtattttttgtagagatggggtttcaccatgttgccaagggtggtctcgaactcctgggctgcattggctcctgccaagatgtcaacctgtcctttaaagctttgaagccagacattgacatctttagccactaaaggcctag

SEQ ID NO: 21706 - DNA, 601 bp, Human
ttgtatttttatgttatggaaatggcctttttccctaaactcattaaccagcctctgttagcttccaacttttcttctgcagctgccttagctctctcagccttgatagaattgaatagagttagggccttgctctggattgggctttggtgtaagggaatgttgtgactattttgatcctctatccagaccactaaactttctccatatcagcaataagactgcttcactttcttatcgttcacgtgttcactggagtaacactttgactttactttaagaactttttctttgcatttayaatttggtttggctgtttggtgcaagatactagctttcaaccagtgttggttttcaacatgctgtcctcactaaggttaattatttctgggttttgatttaaagagagccttgctgatgattgcttgactccaggagtttgagcttgcagtgagctaggatcgcaccactgcaccctagcctggttgacagtctcaaaataaataagatatttttttaaaaagtagagccatgataactattccttttacttgaacacttagaggtcattgtagggttattaagtggcctaatttcaata

SEQ ID NO: 21707 - DNA, 601 bp, Human
tggcctaatttcaatatcattgtgtctcagggaatagggaggcctgagggaggggtgagagatggggaggatgttgggggggatggccagaacacacacaacatttattaagtttgctgtctcttatgggcatcattcatggtgccccaaaacagttaaaatagtaacatcaaagatcactgatcacagatcaccctaacaggtatgattatgagaaagtttgaactgttgtgagaatttccaaaatgcaacacagacatgaagtgagcacatgctgttggaaaaatggtactggtggccrggcacggtggctcacacctgtaatcccagcacttagggaggccgatatgggtggatcacgaggtcaggagatagagaccatcctggctaacacggtgaaaccccgtctctactaaaaatacaaaaaattagccgggtgcagtggcgggcgcctgtagtcccagccactcgggaggctgaggcaagagaatggcgtgaacccgggaggtggagcttgcagtgagctgagatcacgccactgcactccagcctgggcaacagagcaagactctgtctcaaaaaaaaaaaaaaaaaaaaaggt

SEQ ID NO: 21708 - DNA, 601 bp, Human
catggtgccccaaaacagttaaaatagtaacatcaaagatcactgatcacagatcaccctaacaggtatgattatgagaaagtttgaactgttgtgagaatttccaaaatgcaacacagacatgaagtgagcacatgctgttggaaaaatggtactggtggccgggcacggtggctcacacctgtaatcccagcacttagggaggccgatatgggtggatcacgaggtcaggagatagagaccatcctggctaacacggtgaaaccccgtctctactaaaaatacaaaaaattagccgggygcagtggcgggcgcctgtagtcccagccactcgggaggctgaggcaagagaatggcgtgaacccgggaggtggagcttgcagtgagctgagatcacgccactgcactccagcctgggcaacagagcaagactctgtctcaaaaaaaaaaaaaaaaaaaaaggtattgatacatttgcttgacacaaggttaccacaaaccttcaatttgtaaagaaaaaacaaaacaaaacaaaaatgcagtaagtatctatgaagtgtaataaaagcaaggcacaatgaaacgagtatggctgtatttt

SEQ ID NO: 21709 - DNA, 601 bp, Human
aacatcaaagatcactgatcacagatcaccctaacaggtatgattatgagaaagtttgaactgttgtgagaatttccaaaatgcaacacagacatgaagtgagcacatgctgttggaaaaatggtactggtggccgggcacggtggctcacacctgtaatcccagcacttagggaggccgatatgggtggatcacgaggtcaggagatagagaccatcctggctaacacggtgaaaccccgtctctactaaaaatacaaaaaattagccgggtgcagtggcgggcgcctgtagtcccagcyactcgggaggctgaggcaagagaatggcgtgaacccgggaggtggagcttgcagtgagctgagatcacgccactgcactccagcctgggcaacagagcaagactctgtctcaaaaaaaaaaaaaaaaaaaaaggtattgatacatttgcttgacacaaggttaccacaaaccttcaatttgtaaagaaaaaacaaaacaaaacaaaaatgcagtaagtatctatgaagtgtaataaaagcaaggcacaatgaaacgagtatggctgtattttttaaatgcaccaaagataactcatatac

SEQ ID NO: 21710 - DNA, 601 bp, Human
caaaacaaaacaaaaatgcagtaagtatctatgaagtgtaataaaagcaaggcacaatgaaacgagtatggctgtattttttaaatgcaccaaagataactcatatacatagttattcttcggtatccatggaggacctcctgcagataccaaaatccaaggatgctcaagtccctgatataaaatggcggccaggcgcagtgactcacgcctgtaatcccagcactttgggaggcggagatgggaggatcatttgagcccaggagttcaagacaccaacctgagcaagatgtctctattaaaaaaaaaaaaaggaaaaagaaaaagatacaatgtatataacctgcacacattcttctgtatacttcgagtcatctctagattacttataatacctaatataatgtaaatactatgtaaataattgttataatgtattgtttagggaataatgacaagaaaaaagctgtacatgttaggtattttaaaaatattaaaacaaaattttctatacatggtttgttggcttcacagatgtggaacccgtggatgtggagggccagttgagctctctgtcagtgtttggtatgaaaattcttat

SEQ ID NO: 21711 - DNA, 601 bp, Human
gacctcctgcagataccaaaatccaaggatgctcaagtccctgatataaaatggcggccaggcgcagtgactcacgcctgtaatcccagcactttgggaggcggagatgggaggatcatttgagcccaggagttcaagacaccaacctgagcaagatgtctctattaaaaaaaaaaaaaggaaaaagaaaaagatacaatgtatataacctgcacacattcttctgtatacttcgagtcatctctagattacttataatacctaatataatgtaaatactatgtaaataattgttataatrtattgtttagggaataatgacaagaaaaaagctgtacatgttaggtattttaaaaatattaaaacaaaattttctatacatggtttgttggcttcacagatgtggaacccgtggatgtggagggccagttgagctctctgtcagtgtttggtatgaaaattcttatgcctaaattcccagcaaacttaaatctgtagtgttttcagctaaggttttagataactttaatataaaaagaattttttcttttccttttttaaaaaattttaaaatttattatttatttctctttttttgaga

SEQ ID NO: 21712 - DNA, 601 bp, Human
taatcccagcactttgggaggcggagatgggaggatcatttgagcccaggagttcaagacaccaacctgagcaagatgtctctattaaaaaaaaaaaaaggaaaaagaaaaagatacaatgtatataacctgcacacattcttctgtatacttcgagtcatctctagattacttataatacctaatataatgtaaatactatgtaaataattgttataatgtattgtttagggaataatgacaagaaaaaagctgtacatgttaggtattttaaaaatattaaaacaaaattttctatacrtggtttgttggcttcacagatgtggaacccgtggatgtggagggccagttgagctctctgtcagtgtttggtatgaaaattcttatgcctaaattcccagcaaacttaaatctgtagtgttttcagctaaggttttagataactttaatataaaaagaattttttcttttccttttttaaaaaattttaaaatttattatttatttctctttttttgagacagagtctcactctggcgcccaggctggagtgctgtggcgcaatcttggctcactgcaactttggcctcctgggttcaag

SEQ ID NO: 21713 - DNA, 601 bp, Human
accaacctgagcaagatgtctctattaaaaaaaaaaaaaggaaaaagaaaaagatacaatgtatataacctgcacacattcttctgtatacttcgagtcatctctagattacttataatacctaatataatgtaaatactatgtaaataattgttataatgtattgtttagggaataatgacaagaaaaaagctgtacatgttaggtattttaaaaatattaaaacaaaattttctatacatggtttgttggcttcacagatgtggaacccgtggatgtggagggccagttgagctctctstcagtgtttggtatgaaaattcttatgcctaaattcccagcaaacttaaatctgtagtgttttcagctaaggttttagataactttaatataaaaagaattttttcttttccttttttaaaaaattttaaaatttattatttatttctctttttttgagacagagtctcactctggcgcccaggctggagtgctgtggcgcaatcttggctcactgcaactttggcctcctgggttcaagcgattctcctgcctcagcctcccgagtagctgggattacaggcacctgccaccaagcccg

SEQ ID NO: 21714 - DNA, 601 bp, Human
aattttttcttttccttttttaaaaaattttaaaatttattatttatttctctttttttgagacagagtctcactctggcgcccaggctggagtgctgtggcgcaatcttggctcactgcaactttggcctcctgggttcaagcgattctcctgcctcagcctcccgagtagctgggattacaggcacctgccaccaagcccggctaatttttgtatttttagtagagatggggttttgccatattggccaggctagtcttgaactcctgatctcaagtgatctgcccacctcagcttccsaaagtgctgggattacaggtgtgattaagatagaaatatacctgtaggtgttagtgttttctcaactataaagtgttacatggctttaactagattgtcttgaccagtgatactagaatatgaaactatttgagatttgtgttttgtaagacaacattctagaatcatctacatttgtgtaaataccatatttcattaagtgtgaagttataactctttaatcagaatgacagattggagacatacacaatttatgacgttatggcttgtgctttttgcttttttgtgacacacacacac

SEQ ID NO: 21715 - DNA, 601 bp, Human
tggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagcycttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgct

SEQ ID NO: 21716 - DNA, 601 bp, Human
gtactatgaaaacaaaagcagcacaccaaagtaacacattattattatgatcacttatagaaccattacccgctaggatgaaactccccacacaagagatgaagcccgagagaaaagagttgaaggggaaggtccccacgaggagacagtaaccgaactgcagcgccccggtcagcagtatatacagcaggtacgcgtccagcaacttcagacgctgcggagtggagctcaagtactcttctaagaaccgcgaaatgacagacactaccgacgccgacataactgcacgcaaggtactccrgtccgcgccccaaactcttggaggacccgtcgaccacaccggatgtgctgtttgcgcatgcgcaccctcgtgacctaactccgccctccccggtgtgccaatttgcgcaggcgctgaggccggccagggcgcgtaacaactaatgcgcagacgcggactgcatcaacagactcaactacaactcagaaaagttaatgcgtctgcgcaatggccctatcaatgagctggggacgtgtactctttctgttctgtttccgcccgtcagctcggtgacgcccacagttgctctggcaacaagac

SEQ ID NO: 21717 - DNA, 601 bp, Human
aaattattgtactagctacaaacattaattttctattaccttaatgatttgaagaacagaaagacaaggcaatgaccaagagcagtagcactgatgaattatgatgatattaatgcatactttgcagaccaatggaaaattctgcaaatgtcaatagcagtatgggagcctggccaaccatgatcaaaaccagtcccatccaatttctcttcctaaaatcaacattataggacaaggactatgatcatcacttacattcttttagtctcctactcctcaattaagtaaatgagaatgattyagccaacaaagttcatgacaacaaggtgcaggatggtgctggcaaagagaaaatcagcaaaggctcgctctggggagatgccttggaaatccgctttgttctgtgggttgatctgtattctcaggcaaactgcacaagaagcaaaacacaaaaaaatgattatatagaagtataaaataaatatgctaatgaacacagacatacccgaggacccaacaattctactctaacagaaatgaatgcatatatacatcaaagggcatacacagaaatgatacccagatagccccaaactggaaa

SEQ ID NO: 21718 - DNA, 601 bp, Human
agaaattattgtactagctacaaacattaattttctattaccttaatgatttgaagaacagaaagacaaggcaatgaccaagagcagtagcactgatgaattatgatgatattaatgcatactttgcagaccaatggaaaattctgcaaatgtcaatagcagtatgggagcctggccaaccatgatcaaaaccagtcccatccaatttctcttcctaaaatcaacattataggacaaggactatgatcatcacttacattcttttagtctcctactcctcaattaagtaaatgagaatgaktcagccaacaaagttcatgacaacaaggtgcaggatggtgctggcaaagagaaaatcagcaaaggctcgctctggggagatgccttggaaatccgctttgttctgtgggttgatctgtattctcaggcaaactgcacaagaagcaaaacacaaaaaaatgattatatagaagtataaaataaatatgctaatgaacacagacatacccgaggacccaacaattctactctaacagaaatgaatgcatatatacatcaaagggcatacacagaaatgatacccagatagccccaaactgga

SEQ ID NO: 21719 - DNA, 601 bp, Human
taaaagtcatctgagatcaaaatcagaaaaaaattaactaacaaatctaaaggcaaaacctaccatttatgtctcttccaaaatctccgagttattttcgtggagttattggtacagaaattattgtactagctacaaacattaattttctattaccttaatgatttgaagaacagaaagacaaggcaatgaccaagagcagtagcactgatgaattatgatgatattaatgcatactttgcagaccaatggaaaattctgcaaatgtcaatagcagtatgggagcctggccaaccatgawcaaaaccagtcccatccaatttctcttcctaaaatcaacattataggacaaggactatgatcatcacttacattcttttagtctcctactcctcaattaagtaaatgagaatgattcagccaacaaagttcatgacaacaaggtgcaggatggtgctggcaaagagaaaatcagcaaaggctcgctctggggagatgccttggaaatccgctttgttctgtgggttgatctgtattctcaggcaaactgcacaagaagcaaaacacaaaaaaatgattatatagaagtataaaataaata

SEQ ID NO: 21720 - DNA, 601 bp, Human
ttctactttaaggcacatattagcaaatgcccacagtcattcattcaacatacactggatgctatcaaatttaagtgctatgaaaacaatggtccagcattaaaagtcatctgagatcaaaatcagaaaaaaattaactaacaaatctaaaggcaaaacctaccatttatgtctcttccaaaatctccgagttattttcgtggagttattggtacagaaattattgtactagctacaaacattaattttctattaccttaatgatttgaagaacagaaagacaaggcaatgaccaagagcrgtagcactgatgaattatgatgatattaatgcatactttgcagaccaatggaaaattctgcaaatgtcaatagcagtatgggagcctggccaaccatgatcaaaaccagtcccatccaatttctcttcctaaaatcaacattataggacaaggactatgatcatcacttacattcttttagtctcctactcctcaattaagtaaatgagaatgattcagccaacaaagttcatgacaacaaggtgcaggatggtgctggcaaagagaaaatcagcaaaggctcgctctggggagatgcct

SEQ ID NO: 21721 - DNA, 601 bp, Human
actgctaaaaaagtgaaaatggcaaatgaaccaagcagcatcccatcttatattttaaagtcttctcccaagttaacccaatttccccatttatttctactttaaggcacatattagcaaatgcccacagtcattcattcaacatacactggatgctatcaaatttaagtgctatgaaaacaatggtccagcattaaaagtcatctgagatcaaaatcagaaaaaaattaactaacaaatctaaaggcaaaacctaccatttatgtctcttccaaaatctccgagttattttcgtggagtyattggtacagaaattattgtactagctacaaacattaattttctattaccttaatgatttgaagaacagaaagacaaggcaatgaccaagagcagtagcactgatgaattatgatgatattaatgcatactttgcagaccaatggaaaattctgcaaatgtcaatagcagtatgggagcctggccaaccatgatcaaaaccagtcccatccaatttctcttcctaaaatcaacattataggacaaggactatgatcatcacttacattcttttagtctcctactcctcaattaagtaaat

SEQ ID NO: 21722 - DNA, 601 bp, Human
agaaagaactctactgctaaaaaagtgaaaatggcaaatgaaccaagcagcatcccatcttatattttaaagtcttctcccaagttaacccaatttccccatttatttctactttaaggcacatattagcaaatgcccacagtcattcattcaacatacactggatgctatcaaatttaagtgctatgaaaacaatggtccagcattaaaagtcatctgagatcaaaatcagaaaaaaattaactaacaaatctaaaggcaaaacctaccatttatgtctcttccaaaatctccgagttattttcgtggagttattggtacagaaattattgtactagctacaaacattaattttctattaccttaatgatttgaagaacagaaagacaaggcaatgaccaagagcagtagcactgatgaattatgatgatattaatgcatactttgcagaccaatggaaaattctgcaaatgtcaatagcagtatgggagcctggccaaccatgatcaaaaccagtcccatccaatttctcttcctaaaatcaacattataggacaaggactatgatcatcacttacattcttttagtctcctactcctc

SEQ ID NO: 21723 - DNA, 601 bp, Human
agaagggagaaagaactctactgctaaaaaagtgaaaatggcaaatgaaccaagcagcatcccatcttatattttaaagtcttctcccaagttaacccaatttccccatttatttctactttaaggcacatattagcaaatgcccacagtcattcattcaacatacactggatgctatcaaatttaagtgctatgaaaacaatggtccagcattaaaagtcatctgagatcaaaatcagaaaaaaattaactaacaaatctaaaggcaaaacctaccatttatgtctcttccaaaatctcygagttattttcgtggagttattggtacagaaattattgtactagctacaaacattaattttctattaccttaatgatttgaagaacagaaagacaaggcaatgaccaagagcagtagcactgatgaattatgatgatattaatgcatactttgcagaccaatggaaaattctgcaaatgtcaatagcagtatgggagcctggccaaccatgatcaaaaccagtcccatccaatttctcttcctaaaatcaacattataggacaaggactatgatcatcacttacattcttttagtctcct

SEQ ID NO: 21724 - DNA, 601 bp, Human
gggagggagcgatttaggggagggcgtaccatatgtgatgaaggccaagcagagagggcttttcaatttctgtccatcaaaaaaaactccaattctacttctgctttatataccaagattctttttgtaagagtttgtttgggagaagggagaaagaactctactgctaaaaaagtgaaaatggcaaatgaaccaagcagcatcccatcttatattttaaagtcttctcccaagttaacccaatttccccatttatttctactttaaggcacatattagcaaatgcccacagtcattcatycaacatacactggatgctatcaaatttaagtgctatgaaaacaatggtccagcattaaaagtcatctgagatcaaaatcagaaaaaaattaactaacaaatctaaaggcaaaacctaccatttatgtctcttccaaaatctccgagttattttcgtggagttattggtacagaaattattgtactagctacaaacattaattttctattaccttaatgatttgaagaacagaaagacaaggcaatgaccaagagcagtagcactgatgaattatgatgatattaatgcatactttgcaga

SEQ ID NO: 21725 - DNA, 601 bp, Human
caatgttggtgggtcagttttctacctgcattcaaggttatccactggtaacagttcattttaactagcaatagctgttatccattgctcagataactcatctgctgtccctgctcccagatggtacagctgctctcttctctggatttttgcagcactttgttcaaacctatagcgaggccctaaatgggctgtattttaactgttatgtttacgtattctcccctactagactgtacatgtcttgaaggcagaagccacacttttgggtttttttttttaattgagatagggtcttgcyatgttgcccatgctggtctcaaattcttgagctcaagcaatcgcccacctcgccttccgaaagtgctgggattataggcatgaaccaccacgcccagccaacaatattgtttatattcccaacaacaagacattggctggcacatagaaggggagggaggaagggaggaagaggataactcaagtcttaatcaggtgtctaatgagttaaattgtattaaaataacagaacaaagtggttcttaaaagtttttcactgttgggaggccaaggcgggcggatcaccaggtcaggagatcga

SEQ ID NO: 21726 - DNA, 601 bp, Human
ggttactcatatttgcaagcgtgagaaggtcaatgttggtgggtcagttttctacctgcattcaaggttatccactggtaacagttcattttaactagcaatagctgttatccattgctcagataactcatctgctgtccctgctcccagatggtacagctgctctcttctctggatttttgcagcactttgttcaaacctatagcgaggccctaaatgggctgtattttaactgttatgtttacgtattctcccctactagactgtacatgtcttgaaggcagaagccacacttttgggtttttttttttaattgagatagggtcttgctatgttgcccatgctggtctcaaattcttgagctcaagcaatcgcccacctcgccttccgaaagtgctgggattataggcatgaaccaccacgcccagccaacaatattgtttatattcccaacaacaagacattggctggcacatagaaggggagggaggaagggaggaagaggataactcaagtcttaatcaggtgtctaatgagttaaattgtattaaaataacagaacaaagtggttcttaaaagtttttcactgttgggaggccaa

SEQ ID NO: 21727 - DNA, 601 bp, Human
aagggttactcatatttgcaagcgtgagaaggtcaatgttggtgggtcagttttctacctgcattcaaggttatccactggtaacagttcattttaactagcaatagctgttatccattgctcagataactcatctgctgtccctgctcccagatggtacagctgctctcttctctggatttttgcagcactttgttcaaacctatagcgaggccctaaatgggctgtattttaactgttatgtttacgtattctcccctactagactgtacatgtcttgaaggcagaagccacacttttrggtttttttttttaattgagatagggtcttgctatgttgcccatgctggtctcaaattcttgagctcaagcaatcgcccacctcgccttccgaaagtgctgggattataggcatgaaccaccacgcccagccaacaatattgtttatattcccaacaacaagacattggctggcacatagaaggggagggaggaagggaggaagaggataactcaagtcttaatcaggtgtctaatgagttaaattgtattaaaataacagaacaaagtggttcttaaaagtttttcactgttgggaggc

SEQ ID NO: 21728 - DNA, 601 bp, Human
atcccccagagagaaagatttttctatgaacatactctccatagaaagatttaacactgcaatctgggattgaggattttgctatgctttgggcccataattcccagctgagcaggtggtcctaggttgttaatatggtctgcagtacacagtttctgctgagactgcttttttgtctttgcttttgtcataattttgaaatactaagctctctgcagtagagtcctcctccaatcatgacagccctaagaaataattttccatgatttggtatctccctgagcctagaaaacatccttgraatgtttgctgtgtccccttcctaagtacacaccatgactcatctagaaaaaaagaacttcagaaatctagagtaagcaatcagaagacatgacctttccagaaggctctatcaggaagcccaagggttactcatatttgcaagcgtgagaaggtcaatgttggtgggtcagttttctacctgcattcaaggttatccactggtaacagttcattttaactagcaatagctgttatccattgctcagataactcatctgctgtccctgctcccagatggtacagctgctctcttctctgg

SEQ ID NO: 21729 - DNA, 601 bp, Human
atatttttaaaaactgagagcaggacagtatagtataattcaaatgaaggatctctatgaaaaacaatctgggcaatcccccagagagaaagatttttctatgaacatactctccatagaaagatttaacactgcaatctgggattgaggattttgctatgctttgggcccataattcccagctgagcaggtggtcctaggttgttaatatggtctgcagtacacagtttctgctgagactgcttttttgtctttgcttttgtcataattttgaaatactaagctctctgcagtagagtcstcctccaatcatgacagccctaagaaataattttccatgatttggtatctccctgagcctagaaaacatccttgaaatgtttgctgtgtccccttcctaagtacacaccatgactcatctagaaaaaaagaacttcagaaatctagagtaagcaatcagaagacatgacctttccagaaggctctatcaggaagcccaagggttactcatatttgcaagcgtgagaaggtcaatgttggtgggtcagttttctacctgcattcaaggttatccactggtaacagttcattttaactagca

SEQ ID NO: 21730 - DNA, 601 bp, Human
aagtgctgtggcacagtgcacatatagctgagttagaagcacataaaaggagcaaataaatgtatatttttaaaaactgagagcaggacagtatagtataattcaaatgaaggatctctatgaaaaacaatctgggcaatcccccagagagaaagatttttctatgaacatactctccatagaaagatttaacactgcaatctgggattgaggattttgctatgctttgggcccataattcccagctgagcaggtggtcctaggttgttaatatggtctgcagtacacagtttctgctgaractgcttttttgtctttgcttttgtcataattttgaaatactaagctctctgcagtagagtcctcctccaatcatgacagccctaagaaataattttccatgatttggtatctccctgagcctagaaaacatccttgaaatgtttgctgtgtccccttcctaagtacacaccatgactcatctagaaaaaaagaacttcagaaatctagagtaagcaatcagaagacatgacctttccagaaggctctatcaggaagcccaagggttactcatatttgcaagcgtgagaaggtcaatgtt

SEQ ID NO: 21731 - DNA, 601 bp, Human
tattgagaatttacttggaactatttttaaagtgctgtggcacagtgcacatatagctgagttagaagcacataaaaggagcaaataaatgtatatttttaaaaactgagagcaggacagtatagtataattcaaatgaaggatctctatgaaaaacaatctgggcaatcccccagagagaaagatttttctatgaacatactctccatagaaagatttaacactgcaatctgggattgaggattttgctatgctttgggcccataattcccagctgagcaggtggtcctaggttgttaayatggtctgcagtacacagtttctgctgagactgcttttttgtctttgcttttgtcataattttgaaatactaagctctctgcagtagagtcctcctccaatcatgacagccctaagaaataattttccatgatttggtatctccctgagcctagaaaacatccttgaaatgtttgctgtgtccccttcctaagtacacaccatgactcatctagaaaaaaagaacttcagaaatctagagtaagcaatcagaagacatgacctttccagaaggctctatcaggaagcccaagggttactc

SEQ ID NO: 21732 - DNA, 601 bp, Human
tttttttaatatcaaactctcaacttagttggaaaatataaagacattcaatctgttttgttctaccttctgagctggtataaatattgagaatttacttggaactatttttaaagtgctgtggcacagtgcacatatagctgagttagaagcacataaaaggagcaaataaatgtatatttttaaaaactgagagcaggacagtatagtataattcaaatgaaggatctctatgaaaaacaatctgggcaatcccccagagagaaagatttttctatgaacatactctccatagaaagayttaacactgcaatctgggattgaggattttgctatgctttgggcccataattcccagctgagcaggtggtcctaggttgttaatatggtctgcagtacacagtttctgctgagactgcttttttgtctttgcttttgtcataattttgaaatactaagctctctgcagtagagtcctcctccaatcatgacagccctaagaaataattttccatgatttggtatctccctgagcctagaaaacatccttgaaatgtttgctgtgtccccttcctaagtacacaccatgactcatctagaa

SEQ ID NO: 21733 - DNA, 601 bp, Human
tacttccccttgaattgtttatttttttaacccaatgccattttcttttgacctgcctctttcagagtaggttagagtttgtcacccccaaattcatgtaagatcagctatattacagaattttttttttaatatcaaactctcaacttagttggaaaatataaagacattcaatctgttttgttctaccttctgagctggtataaatattgagaatttacttggaactatttttaaagtgctgtggcacagtgcacatatagctgagttagaagcacataaaaggagcaaataaatgtatatttttaaaaactgagagcaggacagtatagtataattcaaatgaaggatctctatgaaaaacaatctgggcaatcccccagagagaaagatttttctatgaacatactctccatagaaagatttaacactgcaatctgggattgaggattttgctatgctttgggcccataattcccagctgagcaggtggtcctaggttgttaatatggtctgcagtacacagtttctgctgagactgcttttttgtctttgcttttgtcataattttgaaatactaagctctctgcagtagagtcct

SEQ ID NO: 21734 - DNA, 601 bp, Human
aaataaaatgatatagaacaagaagtacttaaagcatagcacacactgagcactcattatctgttaacttccttacttccccttgaattgtttatttttttaacccaatgccattttcttttgacctgcctctttcagagtaggttagagtttgtcacccccaaattcatgtaagatcagctatattacagaattttttttttaatatcaaactctcaacttagttggaaaatataaagacattcaatctgttttgttctaccttctgagctggtataaatattgagaatttacttggaaytatttttaaagtgctgtggcacagtgcacatatagctgagttagaagcacataaaaggagcaaataaatgtatatttttaaaaactgagagcaggacagtatagtataattcaaatgaaggatctctatgaaaaacaatctgggcaatcccccagagagaaagatttttctatgaacatactctccatagaaagatttaacactgcaatctgggattgaggattttgctatgctttgggcccataattcccagctgagcaggtggtcctaggttgttaatatggtctgcagtacacagtt

SEQ ID NO: 21735 - DNA, 601 bp, Human
ttacaggcatcagccaccgtgctcagccatcctagccaggctctctcaacttcagttcctcatctgtaaatgagaacagcaagcctatcctcgtgaaattattctgaaaataaaatgatatagaacaagaagtacttaaagcatagcacacactgagcactcattatctgttaacttccttacttccccttgaattgtttatttttttaacccaatgccattttcttttgacctgcctctttcagagtaggttagagtttgtcacccccaaattcatgtaagatcagctatattacagaattttttttttaatatcaaactctcaacttagttggaaaatataaagacattcaatctgttttgttctaccttctgagctggtataaatattgagaatttacttggaactatttttaaagtgctgtggcacagtgcacatatagctgagttagaagcacataaaaggagcaaataaatgtatatttttaaaaactgagagcaggacagtatagtataattcaaatgaaggatctctatgaaaaacaatctgggcaatcccccagagagaaagatttttctatgaacatactctccatagaaa

SEQ ID NO: 21736 - DNA, 601 bp, Human
cacctacacaccaaaaactgatcatttcaggtgtgcatggatttctgggggtcagaagctcactgggagaatttttgcttttgtattttcatttgtatagtctaaaaaataaaaaatattgagtctttcttgatcacctggatagatacattagttgtaagatttctagcaaggggctcttttttttttttttttttttttttagaaaacagagtcttactcttgccaggctggagtgcaatggtgcaattcgggctcactgcaacctccgcctcatgggttcaaacgattctcctgcctyagcctcccgagtagctgggattacaggcaccggccaccacgcccagctaatttttgtctttttagtagagacgaggtttcaccatgttggccaggctggtctcgaactcctgacctcaggtgatccacccacctcggcctcccaaaatgctgggattacaggcatcagccaccgtgctcagccatcctagccaggctctctcaacttcagttcctcatctgtaaatgagaacagcaagcctatcctcgtgaaattattctgaaaataaaatgatatagaacaagaagtacttaaagcata

SEQ ID NO: 21737 - DNA, 601 bp, Human
cccttgttccagctaggatcaaacactgaattttttaagacttgtgagagaatggtctccattataaaaacaaaacaatgctaacaaggcacaggcatttggcaactatctccctgggagctgagcacattttcaagcaaggttttgtccctttgggcccagttcacccttccttctgacccagggcccaattcatcaggaactttaattctcaaactgtgatccaatacagttctgtccttcttttcctcattacccttcagaacacctgagatggactgagatttttttttttttttawaaaaaagagtttcacaggccaggtgcagtggctcacgcctgtaatcccagcactttgggaggccaaggcgagtggatcacgaggacaggagttcaacaccagcctagccaacagagtgaaaccccatctctactaaaaatacaaaaactagccgggcaagtgcctgtagtcccagctactcggggaggctgcggcaggaattgcttgaacccgggaggcagggttgcagtgagccaagactgcaccactgcactctagcctgggtaagacagtaagactctgtctcaaaaaaaaaaaaaa

SEQ ID NO: 21738 - DNA, 601 bp, Human
ccccttgttccagctaggatcaaacactgaattttttaagacttgtgagagaatggtctccattataaaaacaaaacaatgctaacaaggcacaggcatttggcaactatctccctgggagctgagcacattttcaagcaaggttttgtccctttgggcccagttcacccttccttctgacccagggcccaattcatcaggaactttaattctcaaactgtgatccaatacagttctgtccttcttttcctcattacccttcagaacacctgagatggactgagatttttttttttttttwaaaaaaagagtttcacaggccaggtgcagtggctcacgcctgtaatcccagcactttgggaggccaaggcgagtggatcacgaggacaggagttcaacaccagcctagccaacagagtgaaaccccatctctactaaaaatacaaaaactagccgggcaagtgcctgtagtcccagctactcggggaggctgcggcaggaattgcttgaacccgggaggcagggttgcagtgagccaagactgcaccactgcactctagcctgggtaagacagtaagactctgtctcaaaaaaaaaaaaa

SEQ ID NO: 21739 - DNA, 601 bp, Human
gcccaaccctgtagcccccttgttccagctaggatcaaacactgaattttttaagacttgtgagagaatggtctccattataaaaacaaaacaatgctaacaaggcacaggcatttggcaactatctccctgggagctgagcacattttcaagcaaggttttgtccctttgggcccagttcacccttccttctgacccagggcccaattcatcaggaactttaattctcaaactgtgatccaatacagttctgtccttcttttcctcattacccttcagaacacctgagatggactgagatttttttttttttttaaaaaaaagagtttcacaggccaggtgcagtggctcacgcctgtaatcccagcactttgggaggccaaggcgagtggatcacgaggacaggagttcaacaccagcctagccaacagagtgaaaccccatctctactaaaaatacaaaaactagccgggcaagtgcctgtagtcccagctactcggggaggctgcggcaggaattgcttgaacccgggaggcagggttgcagtgagccaagactgcaccactgcactctagcctgggtaagacagtaagactctgtc

SEQ ID NO: 21740 - DNA, 601 bp, Human
cccagcatctaaacccacctggacctctgctgccccccaatgactggaaagaaactaggttttttaacacaggtatcagtagcttcttcccccaaactcaactcctcatgttttgtagtagccgctcaacacatgaaacataccatccactaggtggcagcaaagcccacagaataacatcaagttccccttcccgaggtaattttctagattactatactttaactgaattcgaaaagccaacataatttcatgtttgtaaacagtgctgccagtcagagtttaaaatgttctgcccaascctgtagcccccttgttccagctaggatcaaacactgaattttttaagacttgtgagagaatggtctccattataaaaacaaaacaatgctaacaaggcacaggcatttggcaactatctccctgggagctgagcacattttcaagcaaggttttgtccctttgggcccagttcacccttccttctgacccagggcccaattcatcaggaactttaattctcaaactgtgatccaatacagttctgtccttcttttcctcattacccttcagaacacctgagatggactgagattttttt

SEQ ID NO: 21741 - DNA, 601 bp, Human
tttgttcctaactcgacattgcccacttctggccagaatgtaaagcaacccccaacccagcatctaaacccacctggacctctgctgccccccaatgactggaaagaaactaggttttttaacacaggtatcagtagcttcttcccccaaactcaactcctcatgttttgtagtagccgctcaacacatgaaacataccatccactaggtggcagcaaagcccacagaataacatcaagttccccttcccgaggtaattttctagattactatactttaactgaattcgaaaagccaacayaatttcatgtttgtaaacagtgctgccagtcagagtttaaaatgttctgcccaaccctgtagcccccttgttccagctaggatcaaacactgaattttttaagacttgtgagagaatggtctccattataaaaacaaaacaatgctaacaaggcacaggcatttggcaactatctccctgggagctgagcacattttcaagcaaggttttgtccctttgggcccagttcacccttccttctgacccagggcccaattcatcaggaactttaattctcaaactgtgatccaatacagttct

SEQ ID NO: 21742 - DNA, 601 bp, Human
gaagctctcaaactaaggaggtgaaaaaaagaaatcaaacgggaaacctgcgggtctatgtgcacagtcttggtcttcccccacacaacaaaatctagggccactttagggttctatgcccttttgttcctaactcgacattgcccacttctggccagaatgtaaagcaacccccaacccagcatctaaacccacctggacctctgctgccccccaatgactggaaagaaactaggttttttaacacaggtatcagtagcttcttcccccaaactcaactcctcatgttttgtagtagcckctcaacacatgaaacataccatccactaggtggcagcaaagcccacagaataacatcaagttccccttcccgaggtaattttctagattactatactttaactgaattcgaaaagccaacataatttcatgtttgtaaacagtgctgccagtcagagtttaaaatgttctgcccaaccctgtagcccccttgttccagctaggatcaaacactgaattttttaagacttgtgagagaatggtctccattataaaaacaaaacaatgctaacaaggcacaggcatttggcaactatctccc

SEQ ID NO: 21743 - DNA, 601 bp, Human
aaaaagaagctctcaaactaaggaggtgaaaaaaagaaatcaaacgggaaacctgcgggtctatgtgcacagtcttggtcttcccccacacaacaaaatctagggccactttagggttctatgcccttttgttcctaactcgacattgcccacttctggccagaatgtaaagcaacccccaacccagcatctaaacccacctggacctctgctgccccccaatgactggaaagaaactaggttttttaacacaggtatcagtagcttcttcccccaaactcaactcctcatgttttgtagyagccgctcaacacatgaaacataccatccactaggtggcagcaaagcccacagaataacatcaagttccccttcccgaggtaattttctagattactatactttaactgaattcgaaaagccaacataatttcatgtttgtaaacagtgctgccagtcagagtttaaaatgttctgcccaaccctgtagcccccttgttccagctaggatcaaacactgaattttttaagacttgtgagagaatggtctccattataaaaacaaaacaatgctaacaaggcacaggcatttggcaactat

SEQ ID NO: 21744 - DNA, 601 bp, Human
agaaaatgaaataaaaactaaatgggcccctccaccaacaaaaaattaaagattattgcgtgggaggtcaccattgagaataaaagacgtagaacaaaccaaaaaaagaagctctcaaactaaggaggtgaaaaaaagaaatcaaacgggaaacctgcgggtctatgtgcacagtcttggtcttcccccacacaacaaaatctagggccactttagggttctatgcccttttgttcctaactcgacattgcccacttctggccagaatgtaaagcaacccccaacccagcatctaaacccwcctggacctctgctgccccccaatgactggaaagaaactaggttttttaacacaggtatcagtagcttcttcccccaaactcaactcctcatgttttgtagtagccgctcaacacatgaaacataccatccactaggtggcagcaaagcccacagaataacatcaagttccccttcccgaggtaattttctagattactatactttaactgaattcgaaaagccaacataatttcatgtttgtaaacagtgctgccagtcagagtttaaaatgttctgcccaaccctgtagcccccttgt

SEQ ID NO: 21745 - DNA, 601 bp, Human
cttgaccccagggagttcctagcttgggcaacatagcgagaccccagcacataaaaaaatatataattaatctcaccttctaaacagagaaaaatgagttgaaaaaagttatgatgtgactacctcagatttcctacaaatgtaggacagttccctctgagagagcttatttggcggcaggacctaattcaatataaggtggaaatatcaaagagaaaatgaaataaaaactaaatgggcccctccaccaacaaaaaattaaagattattgcgtgggaggtcaccattgagaataaaagamgtagaacaaaccaaaaaaagaagctctcaaactaaggaggtgaaaaaaagaaatcaaacgggaaacctgcgggtctatgtgcacagtcttggtcttcccccacacaacaaaatctagggccactttagggttctatgcccttttgttcctaactcgacattgcccacttctggccagaatgtaaagcaacccccaacccagcatctaaacccacctggacctctgctgccccccaatgactggaaagaaactaggttttttaacacaggtatcagtagcttcttcccccaaactcaactc

SEQ ID NO: 21746 - DNA, 601 bp, Human
tacacagaagcctcaggcaggaggatcacttgaccccagggagttcctagcttgggcaacatagcgagaccccagcacataaaaaaatatataattaatctcaccttctaaacagagaaaaatgagttgaaaaaagttatgatgtgactacctcagatttcctacaaatgtaggacagttccctctgagagagcttatttggcggcaggacctaattcaatataaggtggaaatatcaaagagaaaatgaaataaaaactaaatgggcccctccaccaacaaaaaattaaagattattgcatgggaggtcaccattgagaataaaagacgtagaacaaaccaaaaaaagaagctctcaaactaaggaggtgaaaaaaagaaatcaaacgggaaacctgcgggtctatgtgcacagtcttggtcttcccccacacaacaaaatctagggccactttagggttctatgcccttttgttcctaactcgacattgcccacttctggccagaatgtaaagcaacccccaacccagcatctaaacccacctggacctctgctgccccccaatgactggaaagaaactaggttttttaacacaggtat

SEQ ID NO: 21747 - DNA, 601 bp, Human
cccacagcctctcctatgaatctttgccttggctttttttctttcgtaccactttccatgttttagcatccaagtaacttaataacataactttttcttgcagttaaaaagtgtttatttggccgggcacagtggctcatgcctgtaattccagcactttgggaggctaaggtaggcagatcacaaagtcaaaagatagagaccatactggccaacatggtgaaaccatgtctctcctaaaaatacaaaaattagccaggcgtgggagcacacacttgtagtcccagctactcaagaggcygaggcaggagaactgcttaaacccaggaggcggaggttatagtgagccaagatcatgccactgcactacagcctggacaacaaagcgagactccgtctcaaaaaaaaaaaaaaggtttattcattcatacactcattcaacaaacacacactgttactgttcacaattgagtccagtgggagagagaagaaagtgaatgaatagtttcataacaatgtgataagtgcagcactggaggaatgcagtagactaagggctcctatgcaacctgaggggtgggaatgacttggaataggagtc

SEQ ID NO: 21748 - DNA, 601 bp, Human
agccaccgcaccagcccctcctctgacttcttgtctcatgctcttccccaccccacagcctctcctatgaatctttgccttggctttttttctttcgtaccactttccatgttttagcatccaagtaacttaataacataactttttcttgcagttaaaaagtgtttatttggccgggcacagtggctcatgcctgtaattccagcactttgggaggctaaggtaggcagatcacaaagtcaaaagatagagaccatactggccaacatggtgaaaccatgtctctcctaaaaatacaaawattagccaggcgtgggagcacacacttgtagtcccagctactcaagaggctgaggcaggagaactgcttaaacccaggaggcggaggttatagtgagccaagatcatgccactgcactacagcctggacaacaaagcgagactccgtctcaaaaaaaaaaaaaaggtttattcattcatacactcattcaacaaacacacactgttactgttcacaattgagtccagtgggagagagaagaaagtgaatgaatagtttcataacaatgtgataagtgcagcactggaggaatgcagtaga

SEQ ID NO: 21749 - DNA, 601 bp, Human
acacgccaccacgcccctctaattcttttgatttttggtagagacaaggtcttgctatatcacccatgctggtctcaaactcctgggctcaagcgatcctcccaccttggcctccccaagtgctgggattacaggcctaagccaccgcaccagcccctcctctgacttcttgtctcatgctcttccccaccccacagcctctcctatgaatctttgccttggctttttttctttcgtaccactttccatgttttagcatccaagtaacttaataacataactttttcttgcagttaaaaaktgtttatttggccgggcacagtggctcatgcctgtaattccagcactttgggaggctaaggtaggcagatcacaaagtcaaaagatagagaccatactggccaacatggtgaaaccatgtctctcctaaaaatacaaaaattagccaggcgtgggagcacacacttgtagtcccagctactcaagaggctgaggcaggagaactgcttaaacccaggaggcggaggttatagtgagccaagatcatgccactgcactacagcctggacaacaaagcgagactccgtctcaaaaaaaaaaa

SEQ ID NO: 21750 - DNA, 601 bp, Human
acaacacagacagagaaactgaggctcagaggtaagtttatttgtccattcaactagttaacagagcaaagcctacaatacaagtcttctgatttttttttttttttttttgagacaggttctcactctgtcactcaggctggagtgcaagtggcatgatcacagttcactgcagccgtgacctcccacgctcaagcaatccttccacctcagccttctgagtagctgggaccacaggcacacgccaccacgcccctctaattcttttgatttttggtagagacaaggtcttgctatatcrcccatgctggtctcaaactcctgggctcaagcgatcctcccaccttggcctccccaagtgctgggattacaggcctaagccaccgcaccagcccctcctctgacttcttgtctcatgctcttccccaccccacagcctctcctatgaatctttgccttggctttttttctttcgtaccactttccatgttttagcatccaagtaacttaataacataactttttcttgcagttaaaaagtgtttatttggccgggcacagtggctcatgcctgtaattccagcactttgggaggctaagg

SEQ ID NO: 21751 - DNA, 601 bp, Human
atgtatgtgaatcctacaagcctgttaacgtgggaactagaagacattttacaaatgtttactttttgtaaaaggcttcatacaaatatgtgcatcttgttataatcatttaactttctgcctcctataaatggataatgggaatctgaaaatatgaataaaaagcaacgattaaggagaaaacagaaagcaaagcccaaatgaggatccacaaaaacagtacaatcctcctcaaacacaaaagaaccatcaagaatcatgctgagaggcattaacagtggcaagagactttgatgaacayccagaccaatcctctcacaacacagacagagaaactgaggctcagaggtaagtttatttgtccattcaactagttaacagagcaaagcctacaatacaagtcttctgatttttttttttttttttttgagacaggttctcactctgtcactcaggctggagtgcaagtggcatgatcacagttcactgcagccgtgacctcccacgctcaagcaatccttccacctcagccttctgagtagctgggaccacaggcacacgccaccacgcccctctaattcttttgatttttggtagagac

SEQ ID NO: 21752 - DNA, 601 bp, Human
aaatgtctgttatccagttccccctcagtcacttattagttccagggcctggatacatcaactaaagtttcaccaaggtgtaattacctcaagtgtaaaataggaatactactatttgtctgtctccacatcactgggtaggaaggaaggatcacatgagctgatgtatgtaaaagtatatgtggaatgtatgtgaatcctacaagcctgttaacgtgggaactagaagacattttacaaatgtttactttttgtaaaaggcttcatacaaatatgtgcatcttgttataatcatttaackttctgcctcctataaatggataatgggaatctgaaaatatgaataaaaagcaacgattaaggagaaaacagaaagcaaagcccaaatgaggatccacaaaaacagtacaatcctcctcaaacacaaaagaaccatcaagaatcatgctgagaggcattaacagtggcaagagactttgatgaacatccagaccaatcctctcacaacacagacagagaaactgaggctcagaggtaagtttatttgtccattcaactagttaacagagcaaagcctacaatacaagtcttctgatttttt

SEQ ID NO: 21753 - DNA, 601 bp, Human
actgtgtatttctaaaaaatgaaaggagctttagagatcagcttctttaatcctttcattacagagatgagaaaactgtaacctgatagtgttgacaaatctgtccagagctgtgctgtccaacaccacagccactagacacaggtgactatttaaacttagtcaaagttaaattaaaaattcagttcttcagtctgttagccacatttcaaatgttcaataaccacatgtggctagtggttaccataatgggcggtgcagaccctgaatgtttccccactgcaaaaagctctgttggacrgtgctggtccaggatcaccctccctagccaaagtcaggtctcctgacctgcattctcctccatttctcctggaccatattaagtatggccaactatgcagaaacatttgagatagccggccttcatcctttcctatcaatctctgccaaatttttcccatttaaaaaagaaaagaatccagtctgatggctctgatgaaaatttaaaataaataaaaatttcttaaaaagaaaagtttaatatttttaatgaaaaccctctaacatgacatatatataaagccatcatctgagagtccta

SEQ ID NO: 21754 - DNA, 601 bp, Human
gttttagaaggcacagactgtgtatttctaaaaaatgaaaggagctttagagatcagcttctttaatcctttcattacagagatgagaaaactgtaacctgatagtgttgacaaatctgtccagagctgtgctgtccaacaccacagccactagacacaggtgactatttaaacttagtcaaagttaaattaaaaattcagttcttcagtctgttagccacatttcaaatgttcaataaccacatgtggctagtggttaccataatgggcggtgcagaccctgaatgtttccccactgcaraaagctctgttggacagtgctggtccaggatcaccctccctagccaaagtcaggtctcctgacctgcattctcctccatttctcctggaccatattaagtatggccaactatgcagaaacatttgagatagccggccttcatcctttcctatcaatctctgccaaatttttcccatttaaaaaagaaaagaatccagtctgatggctctgatgaaaatttaaaataaataaaaatttcttaaaaagaaaagtttaatatttttaatgaaaaccctctaacatgacatatatataaagcca

SEQ ID NO: 21755 - DNA, 601 bp, Human
agcttttttttttttcaagacagagttttgtgcttgttgtccaggctggagtgcaatggcgtgatctcgggtcaccgcaacctccgcctcccgggttcaggcgattctctgcttcaacctgctgagtagctgggattacaggcgtgtgccaccacacccagctaatttttgcatttttagtagagatggggtttcaccatgttggtcaggctggtctcgaactcctgacctcaggtgatccacccgccccagcctcccaaagtgctgggatcacaggccaccatgcctggctacattacakttctaatggccaaggtgagagaggactagatcataatgccattttcagtgaacaaagccttgacacttttagaaatataaaagaaatcctagtttagtacaaaatcaaagtttaaagattttattatattaaaacatttaaatctaagatgctgaggccagtccacgtgaaaggcaaaaattgactcatgagagtaagtctctttgatagtggttttcagaaaattctgtttacaaagatctgcttcccctcttttaaagcagatctatttaccagacactattctaaaagcagaggttc

SEQ ID NO: 21756 - DNA, 601 bp, Human
ctattcaaactcacctattcattccatcaaatttcttaaagcaaactctctggcaatagactatcagccaatataacattacagcttttttttttttcaagacagagttttgtgcttgttgtccaggctggagtgcaatggcgtgatctcgggtcaccgcaacctccgcctcccgggttcaggcgattctctgcttcaacctgctgagtagctgggattacaggcgtgtgccaccacacccagctaatttttgcatttttagtagagatggggtttcaccatgttggtcaggctggtctcraactcctgacctcaggtgatccacccgccccagcctcccaaagtgctgggatcacaggccaccatgcctggctacattacatttctaatggccaaggtgagagaggactagatcataatgccattttcagtgaacaaagccttgacacttttagaaatataaaagaaatcctagtttagtacaaaatcaaagtttaaagattttattatattaaaacatttaaatctaagatgctgaggccagtccacgtgaaaggcaaaaattgactcatgagagtaagtctctttgatagtggttttc

SEQ ID NO: 21757 - DNA, 601 bp, Human
cagtgccaaacaaaaccaaacagacctattcaaactcacctattcattccatcaaatttcttaaagcaaactctctggcaatagactatcagccaatataacattacagcttttttttttttcaagacagagttttgtgcttgttgtccaggctggagtgcaatggcgtgatctcgggtcaccgcaacctccgcctcccgggttcaggcgattctctgcttcaacctgctgagtagctgggattacaggcgtgtgccaccacacccagctaatttttgcatttttagtagagatggggttycaccatgttggtcaggctggtctcgaactcctgacctcaggtgatccacccgccccagcctcccaaagtgctgggatcacaggccaccatgcctggctacattacatttctaatggccaaggtgagagaggactagatcataatgccattttcagtgaacaaagccttgacacttttagaaatataaaagaaatcctagtttagtacaaaatcaaagtttaaagattttattatattaaaacatttaaatctaagatgctgaggccagtccacgtgaaaggcaaaaattgactcatgaga

SEQ ID NO: 21758 - DNA, 601 bp, Human
aatgctacataattgcagaacattcctgaatcagtggtattataagaaatgtataaaagaaagagcaataacaggaagcaaaaggtgttcacagtgccaaacaaaaccaaacagacctattcaaactcacctattcattccatcaaatttcttaaagcaaactctctggcaatagactatcagccaatataacattacagcttttttttttttcaagacagagttttgtgcttgttgtccaggctggagtgcaatggcgtgatctcgggtcaccgcaacctccgcctcccgggttcaggcrattctctgcttcaacctgctgagtagctgggattacaggcgtgtgccaccacacccagctaatttttgcatttttagtagagatggggtttcaccatgttggtcaggctggtctcgaactcctgacctcaggtgatccacccgccccagcctcccaaagtgctgggatcacaggccaccatgcctggctacattacatttctaatggccaaggtgagagaggactagatcataatgccattttcagtgaacaaagccttgacacttttagaaatataaaagaaatcctagtttagtacaa

SEQ ID NO: 21759 - DNA, 601 bp, Human
ctggactccagcacagctctggttggaaagtgacctccagccttaggggctccaatgtctccagctataagcaactgattttcccagtgtgccataaaaatactgcaatctcctacgtgtaccatgactcaaaagaggctgggaaatactacctttcagaagaaccgggctgccccaggaggaaaaagggcactaccttatttggtatattgggtcaagtaagtaacctggagattctggcatcagaacttaaaggagagattttggactttcagccagaatgcttttatttcactaacamtggtatttacagaaatgctacataattgcagaacattcctgaatcagtggtattataagaaatgtataaaagaaagagcaataacaggaagcaaaaggtgttcacagtgccaaacaaaaccaaacagacctattcaaactcacctattcattccatcaaatttcttaaagcaaactctctggcaatagactatcagccaatataacattacagcttttttttttttcaagacagagttttgtgcttgttgtccaggctggagtgcaatggcgtgatctcgggtcaccgcaacctccgcct

SEQ ID NO: 21760 - DNA, 601 bp, Human
ttcatttaaagataagtttatttttggcaagaaaaaggtgaagaaagagtaaccgcaacagaagtggccacattgctgctagagccaaatggaactgagatctgtaacttgtgaggtggaaccctcaccacaagatacaggcttcctttagtccctcaaagcacagcctcccacctactggactccagcacagctctggttggaaagtgacctccagccttaggggctccaatgtctccagctataagcaactgattttcccagtgtgccataaaaatactgcaatctcctacgtgtaccrtgactcaaaagaggctgggaaatactacctttcagaagaaccgggctgccccaggaggaaaaagggcactaccttatttggtatattgggtcaagtaagtaacctggagattctggcatcagaacttaaaggagagattttggactttcagccagaatgcttttatttcactaacactggtatttacagaaatgctacataattgcagaacattcctgaatcagtggtattataagaaatgtataaaagaaagagcaataacaggaagcaaaaggtgttcacagtgccaaacaaaaccaa

SEQ ID NO: 21761 - DNA, 601 bp, Human
tttagttttcatttaaagataagtttatttttggcaagaaaaaggtgaagaaagagtaaccgcaacagaagtggccacattgctgctagagccaaatggaactgagatctgtaacttgtgaggtggaaccctcaccacaagatacaggcttcctttagtccctcaaagcacagcctcccacctactggactccagcacagctctggttggaaagtgacctccagccttaggggctccaatgtctccagctataagcaactgattttcccagtgtgccataaaaatactgcaatctcctacgtgtaccatgactcaaaagaggctgggaaatactacctttcagaagaaccgggctgccccaggaggaaaaagggcactaccttatttggtatattgggtcaagtaagtaacctggagattctggcatcagaacttaaaggagagattttggactttcagccagaatgcttttatttcactaacactggtatttacagaaatgctacataattgcagaacattcctgaatcagtggtattataagaaatgtataaaagaaagagcaataacaggaagcaaaaggtgttcacagtgccaaaca

SEQ ID NO: 21762 - DNA, 601 bp, Human
ctcactgcagcctcctccaactcctgggctcaagccatcctcccgtctcagcttccctagtagctgggactacaggcatgagctaccacacctggttaattttttttcatttttattttttgtagggatggagtcttgctatgttgcccaggcagaagacacatcttttaataacaaaagcagctggcatctgttgctctggtgccccatgccaggcacggtcttggctgctgtaacggctcaattacttttctccccacaggaaacacacagaggattcccaagcaggaattcacagccrgggctgtctgactccacggcccaaattcgttcccccaccgcatgatactgactcattccttctcagcatacaggataaagaacaggaaaggagagctgctgttcagaaaaccccacagcgcctctctcctatccctggagcccagccgtgcgggcagacagctcacctgcccagctcctcccccatctcataatggtcctccacgtcctcctgcctgaacgtggacatggcggccggtccgccttccagcagcttccactccagggaaagtgcagtcaccgcagcctggagataggacct

SEQ ID NO: 21763 - DNA, 601 bp, Human
caacatggtgaaatcctgtctctactaaaaatacaaaaattagccaggggtggtggcgggctcctgtaatcccagctactcgggaggctaggctggaggccgaggctgcaatgagtcgagatcgcatcactgcactccagcctgggcgacagaatgagatagtgtcaaggaaaaaaaaaaaaggctgttattctggtaaacgttctagcaactaccccagtcttaagtcattccatccatgtatgtacagttttccaatgaattaattcctagaggtgaaatcggcgagttaaaagaaatktggctgaattttgctgacttttgccaaacgacccctagcaggaggggtcaacactgaagcatgagaagggggaggagggagcatgctttctctgccactaacgaggaaattcctgaaggagggacctcaggatcccaaaagagcctgcagcactctccctagcctgacacagagctcacttatttacattcccttctggtgacatcatggggaggctccagggaggctggccagtagcaaactcaccaaataaggctggaggctctacaaaaggaggcagggcctagtggtgcctggcta

SEQ ID NO: 21764 - DNA, 601 bp, Human
cgcacctggccctgcctggttctttttacaagctgcatcctattccagccctgatgcagtggtttggggaaggccatttaagaggctgctgttcccagcggggtgcggtggctcacgcctgtgatcccagcactttgggaggccgaggcaggtgaatcacctgaggtcagtagttcgagaccagcctggccaacatggtgaaatcctgtctctactaaaaatacaaaaattagccaggggtggtggcgggctcctgtaatcccagctactcgggaggctaggctggaggccgaggctgcartgagtcgagatcgcatcactgcactccagcctgggcgacagaatgagatagtgtcaaggaaaaaaaaaaaaggctgttattctggtaaacgttctagcaactaccccagtcttaagtcattccatccatgtatgtacagttttccaatgaattaattcctagaggtgaaatcggcgagttaaaagaaatgtggctgaattttgctgacttttgccaaacgacccctagcaggaggggtcaacactgaagcatgagaagggggaggagggagcatgctttctctgccactaacgaggaaat

SEQ ID NO: 21765 - DNA, 601 bp, Human
tcacgcctgtaatcccagcactttgggaggcaaaagcgtgcagatcacgatgtcaggagttcaagactagcctgaccaacatagtgaaagccacgtctctactaaaaatacaaaaacattagccgggcgtgctggcaggcatctataatcccagctactcgggaggctgaggcaaggagaatcgcttgaacctgggagacggaggttgcagtgagctgagattgcggcattgcactccagcccgggcgacactgcaagactccgtctcaaaaaaaaagtgtgggctggggccaggcacagwggctcacacctgtaatcccagcactttgggaggcagaggcgggcagatcatttgaggtcaggagttcaagaccagcctggccaacatggcaaaaccccgtctctactaaaaatacaaaaattagctgagcacgttggtgggcgcctgtaattccagctacttggaaggctgaagcaggagaatcacttgaacccgggaggcgaagattgcagtgagccaagatggcaccactgcactccagtctcggcaacagagccagacaccgtctcaaacaaacaaacaaaaattgctacattctgg

SEQ ID NO: 21766 - DNA, 601 bp, Human
ccgctgcacacctggacaacctggttctgtaaaccacgcctttccctgttttgctattgccaaccagatttcaggttctgccactgagtcctcctacagcaacagcagaccacagccgcccacctccagacagcccccggtctcactggccacagacttgctccttagaggcaaggccactggcaggctctcagttcctctacggaatgtgaaacgtgcctcatctccccagccgggaaagaaactccccaagagctgagcccaccctcttcgcttctctgtaacttccccagcccccagygcaggtgggggcacagcaagccctcctcagtgatggtctcaggtgtcactcccaacccacttcctaagtgcctgccacaacccagacacgacccaagcgtggcctacacaccgacaatttctactgatagagttcatgatgtttaaaaatgcgggctgggaagccgggcacagtggctcacgcctgtaatcccagcactttgggaggcaaaagcgtgcagatcacgatgtcaggagttcaagactagcctgaccaacatagtgaaagccacgtctctactaaaaatacaaaaacattagc

SEQ ID NO: 21767 - DNA, 601 bp, Human
gcagacagctgctgctgggtaccgggttcctgcgtgcctacctcccggctccacgctgtctcctgctaacagacccagctgtcccagggcagcctttgccgctcactctcagtctgtgggactcagtggcccaggaaaggggtggaaggggacacgactggacctgggcaagcagaaaaccacgccttccagcccaaagagaccggtccagtccacagggctctgaacgcctgctgggaagagaggatctctctctccctctgctgggcttggatccaggctcgcggcaggggccaccacrtagaaggctacctaagaagcctgcctaagaacagaccaggccaggagaggggagccaccaggcactgcgggtggcacataagccccgtcattcactctgccagggcgcctcctccatgctggagtggacttcggccccggggacacagggcaccatatgcaccagcacccagtcacacctgcggccgctgcacacctggacaacctggttctgtaaaccacgcctttccctgttttgctattgccaaccagatttcaggttctgccactgagtcctcctacagcaacagcagaccacagc

SEQ ID NO: 21768 - DNA, 601 bp, Human
cctgccttcagaactctccagaagcctctgtgacagcagccacagagaatcactcatccgttcacccggtatcccctgagtacccgcgatgggtcacagccaggctggggacccctggcgtccacatgagacacacggagccggggacccatgccagctgtgttgcacagccgagggggcccccgccaggtactcacaggatataggtgatgacaccgatgctcctggggacagacaagaggcaagggtcagcgcagcgtggggccgcccaccctcccaggaccgtggcgtccagcgcccstgttctagggcaacggtccccccataccccaacagcagcaaggccccgcttcatccccagctgcagcactggcctgcgctccaggaatgcagggaggcccggtgggagcaggtggtacactcaccacatgtccgcctccaggcccagcggctcatagttcacaatctctggggctgcagaacagggagatgtgggtcaggcactggggacatgctggccaaggaagaggctcaagacacaggcatggggtcaaggttctcacatgtcgcagcccttgggggcatgaatgcggcagagctg

SEQ ID NO: 21769 - DNA, 601 bp, Human
ctcagccgctctgtgagtgtcctgccttcagaactctccagaagcctctgtgacagcagccacagagaatcactcatccgttcacccggtatcccctgagtacccgcgatgggtcacagccaggctggggacccctggcgtccacatgagacacacggagccggggacccatgccagctgtgttgcacagccgagggggcccccgccaggtactcacaggatataggtgatgacaccgatgctcctggggacagacaagaggcaagggtcagcgcagcgtggggccgcccaccctcccagraccgtggcgtccagcgcccctgttctagggcaacggtccccccataccccaacagcagcaaggccccgcttcatccccagctgcagcactggcctgcgctccaggaatgcagggaggcccggtgggagcaggtggtacactcaccacatgtccgcctccaggcccagcggctcatagttcacaatctctggggctgcagaacagggagatgtgggtcaggcactggggacatgctggccaaggaagaggctcaagacacaggcatggggtcaaggttctcacatgtcgcagcccttgggg

SEQ ID NO: 21770 - DNA, 601 bp, Human
ccagctgggtgcagcggcccacgcctgtaatcccagcactttgggaagccgaggcaggcagatcacctgaggtcaggagttcaaaaccagccttgatcaacatggtgaaaccccgtctcttctaaaaatacaaaaattagctgggcatggtggtgggcgcctgtaatcccagctactcaggagactgaggcaggagaatcgcttgaacctgggaggtgggggttgcagtgagcagctgagatcgcaccactgcactccaacctggacaacaagagcaaaactccatcaaaaaaaaaaaaaagtccgagcatgggagcatggttgtgtgcacatgtagtcccaggtactcaggaggctgaggtgggaggattgcttaagtctgggaggtggaggctgcagtgagctaggacagcactccagcctgggcaagagagtaagaccccgtctcaacaaataaaaataataaacaacagcaggcccacgtgtggcccagggacaggagccaaaacccagcgtggggtcggaccccttccttgcacttcgagaggaggctgggctccctagcagccagagggacaggagcacacacgacccccaaccc

SEQ ID NO: 21771 - DNA, 601 bp, Human
cccagctacttgggaggctaacgcaggagaatagcctgaacccgggaggcagaggctgcagtgagccgagatcacgccactgcactgcactccagcctgggagacagagcaagactccgtctcaaaaaaaaagactccgtctcaaaaaaaaaaaaaaaaaaaaaaccatggcaatggccagcttgggccaccagtttatcagtttactctctccagcccaaggggtaagcaatgtctgatccccagccgcagggaggtggcgctgggaggagagtcctctggagcctccgtgggtggagtrggcctgtgtcccatgtcccaccccgtgccccctgccggcccctcgtacttgggatctttgacgagcagccggcgaatgaagtccttggccagctcgctggtgttgctgaagtactcctcgtcgaagtcgtagttcacggctgagatgttggtgagcgtctcctgcttggtctcgcccaggaacggggatgcaccgctcaggctgcgagacaggcgtgggggctcagtggggtcctgggctcccaccacggccgcgccgcctctccggctgcccacgacaggcggagcacagaagacaggc

SEQ ID NO: 21772 - DNA, 601 bp, Human
aggggctcatccggcagcagagtcaacgcctcgtgacggagactgcccagcccgacgcaaagccgagagtgctctctcgagaaaaacgctgcggccctggccccaggagtcagccccgttggacacacaccagccaaggatgccaccaggtctgtcgggtgctggacatcccacgcccaggacccaacccccgccacacaggctcactcctctggggaccctccccagccactgggggttgtcacatccacaagccttaaatgctgaaggccccccgggaccccagcgagaaggccaaggygggaagcccagggagctcccccacctccccacttaccttaatccaggaatgttccaggctctgggcaatggtcattctccgcctggaagacccccgctctggttaggtacacctgcaccatctgtcccgtcctcccgtgaacaactgactcccgggacccccaaaagccctaaagtcgccccccagcctctgctcagccaaccacagaagctgaacaagggtactgcagggagcgtggggttttctggggggtggtggagagagctgagacctcaggctggagtcgcaaacccaggcgcc

SEQ ID NO: 21773 - DNA, 601 bp, Human
cagtggaagaccccaccaagcccggcgccacccagcagcgtggggactgcctgtccgccgtccatcccaccctccccgtcccacgacctcctcctgggctaatggcagcaacaggcagcaccccgccgaattgtccgtgcaactacccgcaaaccctcctccgggcctgaaccagggctgcattcgggccgcctctgcgcctcggtgggtcccaaccctcacggtgccacaggccacgctgcctggagggtcccagggtcaccgacgatgcaggggtgaaggtgaaggccagcgtggaggmtgtgtagagaagcagccccgtcccacacccacccctgcctgcgaacttacgggcctggctccagctcctcccactccgcctccagcctggtggcgctgggcaaggacaggcacccgggcgatgggaggcgcagcgtccacaggaagcgcccccaccgcaggccgagctccggctgtcctggggcctggcccaccccactgcgcctagcgcagcccgcactccacgccctgcagcttctcctgctccagggcgcgcacgaggtcctgcacgaagcgcatctcggaggctacttgcttggcc

SEQ ID NO: 21774 - DNA, 601 bp, Human
gcacacagtggaagaccccaccaagcccggcgccacccagcagcgtggggactgcctgtccgccgtccatcccaccctccccgtcccacgacctcctcctgggctaatggcagcaacaggcagcaccccgccgaattgtccgtgcaactacccgcaaaccctcctccgggcctgaaccagggctgcattcgggccgcctctgcgcctcggtgggtcccaaccctcacggtgccacaggccacgctgcctggagggtcccagggtcaccgacgatgcaggggtgaaggtgaaggccagcgtrgaggctgtgtagagaagcagccccgtcccacacccacccctgcctgcgaacttacgggcctggctccagctcctcccactccgcctccagcctggtggcgctgggcaaggacaggcacccgggcgatgggaggcgcagcgtccacaggaagcgcccccaccgcaggccgagctccggctgtcctggggcctggcccaccccactgcgcctagcgcagcccgcactccacgccctgcagcttctcctgctccagggcgcgcacgaggtcctgcacgaagcgcatctcggaggctacttgct

SEQ ID NO: 21775 - DNA, 601 bp, Human
gctggctgtcccctgccaaggcctgaggcacacaacacccgcgtatctggaagccagtattttatttctcttggctgcagagggccgctcttgcctaggcgtccacaggcgcgacgatggggctcgcggaggagtccgcagcagggcaccccacacccgggggaccggcctcggcgagaagggcacacagtggaagaccccaccaagcccggcgccacccagcagcgtggggactgcctgtccgccgtccatcccaccctccccgtcccacgacctcctcctgggctaatggcagcaacasgcagcaccccgccgaattgtccgtgcaactacccgcaaaccctcctccgggcctgaaccagggctgcattcgggccgcctctgcgcctcggtgggtcccaaccctcacggtgccacaggccacgctgcctggagggtcccagggtcaccgacgatgcaggggtgaaggtgaaggccagcgtggaggctgtgtagagaagcagccccgtcccacacccacccctgcctgcgaacttacgggcctggctccagctcctcccactccgcctccagcctggtggcgctgggcaaggacaggcac

SEQ ID NO: 21776 - DNA, 601 bp, Human
ccccacagggcttctccctagggcgtgcccttagaagattccaggcagcaggcggtaaggcactgcggcggtgtagcgctcccagtcccggccgtacttgctggcgcagcggtgctcgtcccggaggcagcggtgggtcagcaggatggccatgtagatgatgtagaagtagggcagcaggtggccaccgccacaggccaggcagtaggccaggctgcccatcaggtcgccgacgtagttgaagtggcgggccacgccccagaagcccgacaccagcagcttgctgtggtgcctctgcccrtcggcggatgtgtaggagcactcgatgaccttgggcttcctgccccagatgaggcagcgcccatccgtgcggcggaacaggtccttctggtggttggccacccggaagatgtagtagcccaccaggcccagcagcaggacgcccacggcgtgcggggtggacagctgcacggggtggtacaccaagtacagaccctggggggcgagggggaaggggtcaagcggtgctttgcccagggagaggacaggagtgtgggctcgagggcccagcggcctggggtcaaaccccagctctgcctct

SEQ ID NO: 21777 - DNA, 601 bp, Human
ggacacctgccaagtgctgggctctctccagtttacagatgaggaaactgaggctcctcgagttggagctgggatgccagcccccatggacctggcagaacacgctcttgacagccccacagggcttctccctagggcgtgcccttagaagattccaggcagcaggcggtaaggcactgcggcggtgtagcgctcccagtcccggccgtacttgctggcgcagcggtgctcgtcccggaggcagcggtgggtcagcaggatggccatgtagatgatgtagaagtagggcagcaggtggccrccgccacaggccaggcagtaggccaggctgcccatcaggtcgccgacgtagttgaagtggcgggccacgccccagaagcccgacaccagcagcttgctgtggtgcctctgcccgtcggcggatgtgtaggagcactcgatgaccttgggcttcctgccccagatgaggcagcgcccatccgtgcggcggaacaggtccttctggtggttggccacccggaagatgtagtagcccaccaggcccagcagcaggacgcccacggcgtgcggggtggacagctgcacggggtggtacaccaag

SEQ ID NO: 21778 - DNA, 601 bp, Human
accagtcagacctgcagtcaggcccattcacgagtcaggcccattcaccagtcagaaaccacacagccacttatttgaacaggggaagtttaatataaagatgaactctactcggagcatagagtttaaaaagagttctacacaacaccctagggatgaggaagaatgcctcagggaagaaagcacagaaaaggaggtgccctcccgaggctgggactgagacctcctcgctggagaaggtgtgggaggcccctgagggtgaagttccccgggttgctcgagccagagtctgcacagtcayagggcaagcagaaaattctttcgagagggtgggcgctcacagggaatcgggaagcagagcccacctgcctacacctgaaaggccacagccagtgctgggacctctctgaggtctgcagactccaggcagagcactcctggcagctgtgcagcaggagcaggaaggaaacgacatgaaagcccctttctccccagtgtcccagttcaacaccgtgcacgctaccaaggagaaacggcgcacgggccccacccacgactgcagagcaggcaggggagggggatctagagctgaaaggcaata

SEQ ID NO: 21779 - DNA, 601 bp, Human
aggccccagtgacactgatgtgctgagccaccatttcagactgagtctgcaccctcagccacatgaacaatctcccctacctccctgggactctgcttctgtaactgtctcattcacacctgcctggctcactggaaatcctcttttgagcgcgggatatggcttgcccttgtccgtgtgcccccaggactttgcctctacagcattttcttacaccccctccccagcgtgccctcagccaagtgctttggcccggtgcttcccgcagctgcacagagaccttggccacgcccgcgcgccmtgagcgcagctgggttccaggagactctcagctcagctgagctagttgcctggcacccacctgtcgcgcgcggagagggggttccctgttgcttttgtgtctgtttcctgtccctggtaggggaagtgatgtcgtggatggggaggggtgggcagggtagtttcccccgcttgttttgggtgcacaggagccccactgctgatgacgaactatctctaactggtcttgaccacgagctagttctgaattgcaggggcctcaaagcagcacctaaaccttgagggggagggtgctctgggt

SEQ ID NO: 21780 - DNA, 601 bp, Human
cagctgtgttcccttatctcctctcagtatatactgcatgtgtctgagaggagacagagagaaattaagtagaggttaaggatcaaaccgctcatctcagacacttttctgatttgaagggaaatgctcttgtatcttgttttacttttgctgccggtcagttgaagttgaaatcctggttaataaacactgggcaatgatgtcattcctgaatagttaatgatttcctgtggcccctgggcctgtggagactgcatttttgttctttgcttcataagaggaatgcgtgtgtggtggtggttttttttttttgagatggaggctcgctctgtcgcccgggctggagtatggtggtgcaatttcagctcactgcaacctctgcctcctgggttcaagggattctcctgcctcagcatcctgagtacctgggattgcaggtgcccaccaccatgcccagctgaggaatgtgttttttaaacagtggactcctcgggcatgtcagtggtccttgtaatacgtgtaacttcaaaaatatctgattgcaggcatttgactttttggctgacatcatgataagagatctacagtgaacattaatttt

SEQ ID NO: 21781 - DNA, 601 bp, Human
gtctgttgagtctccagtcaagagagtgaaatgagttcagttcatcataactgggtcttagcaaaacctttgccagagtcctggcagtttctgtcctcttttctggatatgcagaaaacagctggttagtcatcccttggggattctgctcatcttaacaccatcactttctggttcacaatcatccttttcatccctggttgtgaaaattttcaccttttgagagaggtggaggccagttgctgtgacaatggcccgttttcacatctgtctgatctttggttctgaggtttgccttttyaatagtgtaaagaaacccagtatttggttattctctgggaatttacccagctcacgttttccaagtgccctctgtcactctctgacagggtcctttgttcctatggggcagagttgggatttgtctttaagctttttttttttgagatagagtcttgctctctcatccaggctggagtgcagtggcatgatcttagctcactgcaacctctgcctctcgggtttaagcaattctcctgcctcagcctcctgagtagctgtgatcataggggcttaccaccatgcttggctaatttttgta

SEQ ID NO: 21782 - DNA, 601 bp, Human
ctcatgcatgctgtttccctcttgcatataactgtttttactctgcctaagtcaagctgtgaaaaaaggagttctgctctcctagagcagtttgcatgagtggttgtttgaatttctgaaactaagacatgtaattacacctcggatcattgtggtgggcactcccatacacaattctgttgtggctttaacattcttagcttcatggaacctaattatggctcttctgtttcattctacgatgttaagattttgaagtaacctctattctaagctgtggttgggctgtccacgttacccratatgttttaatatctaattatgtttgacccgatgtgttttaatatctaattatgtttgacggatggttcattttacttttgtgtcctaaatttacctctcattatctccttattgggctggactctggattgtggtcctgagcctgtaataagtcctccaaagtctagtggcccaagtgccagggtccttccactctgccttccccagagcccctaacccaggctttgctgagcaggtcagaatgggtcatcctctcgcaacaccagcacttgggaagggtccagggtggtccctatgg

SEQ ID NO: 21783 - DNA, 601 bp, Human
gactgggctacaggtctctacacatcagtgacctatagccttgaagtttgcacaagatcgatttcaatccagtggatggtggaatagatttctccaaggaaagttctattttcacattggttttcccttccccaatcaagagtgaattccagccaggcccaaagatatgcacctgtaggcccagctacttgagagactgaagtgggaggattgcttgagctcaggagattgagaccagcctctgctggtcataatgagtgagatctatccctaaaaaaatagtgtgtatctgcagatgaarctctgaatttaggaaagctgcagttgaaacctttagtaataagagattaagatcatggactaatatgcccctcccccatcacattcctacataggacacaactgccacatcctgggctggatgtgccccaggcaagctgttcctttttctttgaatcttacttggtatttgttatcaccttccccaatttgagatctcttccattcccacaatgcctcctgaaaccacagtatttctgcactacacctgggcacctagacatcataactcattcataactcatcaacacagtagcgctgg

SEQ ID NO: 21784 - DNA, 601 bp, Human
tatgcccctcccccatcacattcctacataggacacaactgccacatcctgggctggatgtgccccaggcaagctgttcctttttctttgaatcttacttggtatttgttatcaccttccccaatttgagatctcttccattcccacaatgcctcctgaaaccacagtatttctgcactacacctgggcacctagacatcataactcattcataactcatcaacacagtagcgctgggtagggcatagctatttttccatctaagatctccactggtagatgaataaatccaagctttacwgagattataaatttgtaaggggcctcctaggcagtagcagaaaagggatgtgggccctaggaatcctggcaccacgtgtctgtaaacaactttcctgtagttataagtgtgcagttgattggggtggtgctgagcaggcccagcggaagttgcgcatttcaaacctgcaggtgtgtccagcctcactcagtcattatccttcctgtggcttcatgattctccagtgggtttgctgagattgagggttgtctccgcctgtggacatggacaagactgggactggttttttgtttttctccc

SEQ ID NO: 21785 - DNA, 601 bp, Human
cacaatgcctcctgaaaccacagtatttctgcactacacctgggcacctagacatcataactcattcataactcatcaacacagtagcgctgggtagggcatagctatttttccatctaagatctccactggtagatgaataaatccaagctttactgagattataaatttgtaaggggcctcctaggcagtagcagaaaagggatgtgggccctaggaatcctggcaccacgtgtctgtaaacaactttcctgtagttataagtgtgcagttgattggggtggtgctgagcaggcccagyggaagttgcgcatttcaaacctgcaggtgtgtccagcctcactcagtcattatccttcctgtggcttcatgattctccagtgggtttgctgagattgagggttgtctccgcctgtggacatggacaagactgggactggttttttgtttttctcccccatctgggtggacacctattgctatcatggaaagaaacccaggagggtgtacctgggatttggaggtgtcccggataaccaggacctgaacacagcaacccagcgttgggtcccttcagacttctgttttttttaagttaatg

SEQ ID NO: 21786 - DNA, 601 bp, Human
ttccatctaagatctccactggtagatgaataaatccaagctttactgagattataaatttgtaaggggcctcctaggcagtagcagaaaagggatgtgggccctaggaatcctggcaccacgtgtctgtaaacaactttcctgtagttataagtgtgcagttgattggggtggtgctgagcaggcccagcggaagttgcgcatttcaaacctgcaggtgtgtccagcctcactcagtcattatccttcctgtggcttcatgattctccagtgggtttgctgagattgagggttgtctccrcctgtggacatggacaagactgggactggttttttgtttttctcccccatctgggtggacacctattgctatcatggaaagaaacccaggagggtgtacctgggatttggaggtgtcccggataaccaggacctgaacacagcaacccagcgttgggtcccttcagacttctgttttttttaagttaatgttttatttttttggagacagggtctcactttgtggctcagactgagtgcggtggcacgatcatagatcactgccaccgcgacttcctgggctcaaggtattctcctccct

SEQ ID NO: 21787 - DNA, 601 bp, Human
atggaaagaaacccaggagggtgtacctgggatttggaggtgtcccggataaccaggacctgaacacagcaacccagcgttgggtcccttcagacttctgttttttttaagttaatgttttatttttttggagacagggtctcactttgtggctcagactgagtgcggtggcacgatcatagatcactgccaccgcgacttcctgggctcaaggtattctcctccctcagcctcccaagtagctgggactacaggtgcacaccaccatgcctaactaatttgtaaaaaaaatttcggcagwgaaagggtctcaccatcttgccctggctgttggtgagctcctaggctcctaggctgaagtgatcctctcaccttggcttcccgaagtgccggttgcaggtgtgcacctctgagcctggcccagccttgtttgttgctcagcctctgactctctgcctgacgccttccctctctgtgataattcttctttatatggaatttggccactttccttgttggcagaagcaacatgaatcattggtgcctgctagaccagttcagccccctgcctgccccctgcccaccccctgcccttcccaaa

SEQ ID NO: 21788 - DNA, 601 bp, Human
gtgtacccccaggtgttgtgcagattgggcgaaattcggcctgtctttctgtattttaccagagggcccccctgttggggaagtctctgagaaagtctctgtgggtctgggtacgtggtcagtgcacaagggacaattggtggtgtaaaccaactttcatcattttgaaagaggagaccatcatcaaaaattgcttttgagacatcagttggcctttgttctgcctgcattgaggccaaaaaggtgtgatctatggagcagcctgcaaattgcctgtatctttgtggactttttcctttgyaagtgtgttgcctgtttgcttctaagacatcggcagactgcaatacaagccaaatgagttgccgtcttttctacttctttgtgttttctttgatatgttaagacttaaaaaattaagagcgatctagccacccctcaccccacctttttgggaactattgtttgatttacattcagcaatcctattgataataaaagctactgttttttttttcctcccaaagggtatatttcctgcttcatatattcatcttaaagaagcgatagttgaaggaaaagggtgagtctggtcttgatgttt

SEQ ID NO: 21789 - DNA, 601 bp, Human
agttactgtccttgaacctggggtcactattggaaagcattcgccctggtgctctgtgcttcctctgtgagctactgacttcatttggcagagactccaaagccccccagctctgagtccccttttttttgggaagacattgcaggctgtgatataaatggagtttagggtgaagcaacagttgttaaattgggacatgcaggagtttacattttgtctaattgtgatgtatgtttcctagaggtcataaaactgatgtataagatcattaaaaggacatttctagaacaggaacccattaggcaggaatggcaaatgaataaccaggtgtgaacttggaagaaggaacattaaaatgttttctttttttgtctctgctacatcttcacactcagttaaatatgtaaattataaaattactaatcatatgattactgcataatgacatctctttggctgattacaaaattgcctttccaagcactgtacttttaacatatgaaaagaaccgttcgggttccatagttccatgatgcatacttaaaatgaagaaaataatttagaggcatgaatgatgatgacctgcaatatggtacttttt

SEQ ID NO: 21790 - DNA, 601 bp, Human
cgctgacttcattcattctcagacatcccaaatgattactctatgcctgttaccactgattctgtacctattcccccataaccaaagcaattcccattttgtcctccatgcttttcccagtactgacatggttagcaatgcctccttatgtctggacctcacagtgtcttctcatcctctgcctctggagctccactgcagccttggacacgttggtccttgcttcactgaaagcccctcttaacgccgatgctcttatcctcttcttattatgctgacctactgctcaggcatgtcaccrtctcctctgtcctgtgtccgctactctgagggtgctgtcctagccttctcctatttctttgttgcccctccctgattgacatggcctctgttgcgtttccctcttcagctgatctgtctctgtgggtgatgctcacatcgggaccaccagccctgatttgtctcttgacccctcattcagttaggcagccaagtaactaatgagaatcatccccactgttgggtgagcatctgctatgtcccattcattctcttttcaaaaaaaattattattatttttattttgtattgtgtattttta

SEQ ID NO: 21791 - DNA, 601 bp, Human
gcgagatcttggctcactgcaacctctgcctccaggttcaagtgattctcctgccttagcctccccagtggctgggactacaggcattcaccaccatgcccagctaatttttgtgtgtgtgtgtgtgtgttttttttttttcagtagagatggggtttcaccatggtggccaggctggtcttgaacttctgaccttaagtgatctgcctgccttggcctcccaaagtgctgggattacagatgtgagccaccgcacccggccaaaaaattatttttagatttgacaaataaaaattgtatrtatttatggtgtgcaacatgatgttttgaagtatgtatacattgtgggatggctaaatcaaactatgtgtgcattaccttacatacttatcatttgtttgtagtgagaacacttaaaatctactctcagcaatttcgagtatacaatacatagctattgtagtcaccttggtgtaggataggaggcctgttgaacttattccttctgtctaacagaaactcggtgtccctttgacccatcatctccccactcccctatgtcccattcttttttttttttttttttttttttgagacgaag

SEQ ID NO: 21792 - DNA, 601 bp, Human
ccaggctggtcttgaacttctgaccttaagtgatctgcctgccttggcctcccaaagtgctgggattacagatgtgagccaccgcacccggccaaaaaattatttttagatttgacaaataaaaattgtatgtatttatggtgtgcaacatgatgttttgaagtatgtatacattgtgggatggctaaatcaaactatgtgtgcattaccttacatacttatcatttgtttgtagtgagaacacttaaaatctactctcagcaatttcgagtatacaatacatagctattgtagtcacctkggtgtaggataggaggcctgttgaacttattccttctgtctaacagaaactcggtgtccctttgacccatcatctccccactcccctatgtcccattcttttttttttttttttttttttttgagacgaagtcttgctctgtcgcccaggctggagtgcagtagcatgatctccgctcactgcaacctctgcctcctgcgttcaagcgattctcctgtctcagcctcccgagtagctgggattacaggcgcacgccaccatgcctggctaatttttgtatttttagtagagacagggttt

SEQ ID NO: 21793 - DNA, 601 bp, Human
atgtgtgcattaccttacatacttatcatttgtttgtagtgagaacacttaaaatctactctcagcaatttcgagtatacaatacatagctattgtagtcaccttggtgtaggataggaggcctgttgaacttattccttctgtctaacagaaactcggtgtccctttgacccatcatctccccactcccctatgtcccattcttttttttttttttttttttttttgagacgaagtcttgctctgtcgcccaggctggagtgcagtagcatgatctccgctcactgcaacctctgcctcytgcgttcaagcgattctcctgtctcagcctcccgagtagctgggattacaggcgcacgccaccatgcctggctaatttttgtatttttagtagagacagggtttcaccacgttggccaagctggctttgaacccctgacctcacgtgctctacccgctttagcctcccgaagtgttgtgattacaggcgtgagccaccgcgtggagccccattcattcttaaagatgctctgccttgatgcactttccctcagtcttaccagcagccctatgaggcaggcattattggggttacatattc

SEQ ID NO: 21794 - DNA, 601 bp, Human
tgaacttattccttctgtctaacagaaactcggtgtccctttgacccatcatctccccactcccctatgtcccattcttttttttttttttttttttttttgagacgaagtcttgctctgtcgcccaggctggagtgcagtagcatgatctccgctcactgcaacctctgcctcctgcgttcaagcgattctcctgtctcagcctcccgagtagctgggattacaggcgcacgccaccatgcctggctaatttttgtatttttagtagagacagggtttcaccacgttggccaagctggcyttgaacccctgacctcacgtgctctacccgctttagcctcccgaagtgttgtgattacaggcgtgagccaccgcgtggagccccattcattcttaaagatgctctgccttgatgcactttccctcagtcttaccagcagccctatgaggcaggcattattggggttacatattcttgaacactggcaggtaacaaggtggtaacaaaggtaagacaataaagccagatcaaatgtgttaatgccagctggcacattaatcccagggatccactgggcctaccagaagggaggaacctaag

SEQ ID NO: 21795 - DNA, 601 bp, Human
cagagtttaatcagagttggcatcagatagagtaaccatggacatttggaagctgtaacctctctcatatttcgccaaggataactgcttcctgtattatcatgtaatgagttttatgcgtgatggaaaatgtaaaagtaatcttaacccaaacctgcattttaatgccacatggaccggctgtaatttatggcatctttaagatagatgggtacacatattatgaatatactttccttttgccagaccttgacattctgtagacttttaatggaatattatttgcctctttcatcttacyttgacgtatgaggtggatggcttacgtgcagggtaatgtatgaaccttcccaagctctgtacaaatataacttgtcattcgtagagacgtatgtatttatatgtgtgcatgcagtcttatttgtagattttcttcccatttgcttaatactgaacgctatggcctagatgtgaaatttaccaggtactactcatagcaggcagtgaaaccgtggactcagctgctctttccttctttcctcccaggcaacatgaaacagtcatcccgggtgacctccccctcatccaggaagtcaccacg

SEQ ID NO: 21796 - DNA, 601 bp, Human
tggctgagagtttagcccctgctgggggctgtgtgcccttcgacctgccatgtatttgggtgtattacagtgagctgtagcagaagggactgtaggatgtgtctttccttgcattggaaggagaaatgtggttgtttcaggcccctggaatgcaggatcgggcagtgggtgttgatgtcaccttttaaacagtaataggtgcttatttaaggatccggtagagggcaattactatttttttttttttttttgccgttgtctgacagtaggtaatacctcttatcatttaagaaaaacaacggtcttctagatttacctgtgtttgtgacaggaatagggaaatattttacattctagcttcgtgtgcaattgtccagttctcctgatcacagaagaagtcttattaatgcagagaggttgaagctctgacatcttccatttcgtattccctcggggcatttctttgcacataaattcatatttgcagtagattaccttttgttaagcttgtatttctattcagagtgttgatttctcatatgctaatgttattaccaccaagccagggctctggaaggaagtcggtacgttcatttcttga

SEQ ID NO: 21797 - DNA, 601 bp, Human
acgtgttttttgatgctgaaagcaaacaagctgctctgatcctaattctgctgggtcctgtaactagaatgaggccatgcccttttccacctggtaatatttagttttcatagaatagcagagctgcaagaagccttaaaaagtatctggtcacatggttcccaaatgctcttctatttcagaatcactgggatagctgttgaattatagaatcccaagacctaccccttaaggctctgatttgtgatatctgggatgctggctggaaatctccagtgttttttttttgtttgtttgtttktttttgagatggagtttcggccttgttgcccagactgtagtgcaatggcatgatcttggcccattgcaatccccgtctcctgggttcaagtgattctcctgcttcagcctcccgaatagctgggattataggcatgcaccaccatgcctggctaattttgtatttttagtagagatggggtttttccatgttggtcaggctgatctcaaactccctacctcaggtgatccacccgccttggcatcacaaagtgccaggattacatgcgagagccactgctcccagccggaaatctcaagt

SEQ ID NO: 21798 - DNA, 601 bp, Human
ggccatgcccttttccacctggtaatatttagttttcatagaatagcagagctgcaagaagccttaaaaagtatctggtcacatggttcccaaatgctcttctatttcagaatcactgggatagctgttgaattatagaatcccaagacctaccccttaaggctctgatttgtgatatctgggatgctggctggaaatctccagtgttttttttttgtttgtttgtttttttttgagatggagtttcggccttgttgcccagactgtagtgcaatggcatgatcttggcccattgcaatcyccgtctcctgggttcaagtgattctcctgcttcagcctcccgaatagctgggattataggcatgcaccaccatgcctggctaattttgtatttttagtagagatggggtttttccatgttggtcaggctgatctcaaactccctacctcaggtgatccacccgccttggcatcacaaagtgccaggattacatgcgagagccactgctcccagccggaaatctcaagttttaaaaatagagttgggttgtgctggacagcagatttggaaaacttctggtttaattcaaccccctcattt

SEQ ID NO: 21799 - DNA, 601 bp, Human
ccatgcccttttccacctggtaatatttagttttcatagaatagcagagctgcaagaagccttaaaaagtatctggtcacatggttcccaaatgctcttctatttcagaatcactgggatagctgttgaattatagaatcccaagacctaccccttaaggctctgatttgtgatatctgggatgctggctggaaatctccagtgttttttttttgtttgtttgtttttttttgagatggagtttcggccttgttgcccagactgtagtgcaatggcatgatcttggcccattgcaatcccygtctcctgggttcaagtgattctcctgcttcagcctcccgaatagctgggattataggcatgcaccaccatgcctggctaattttgtatttttagtagagatggggtttttccatgttggtcaggctgatctcaaactccctacctcaggtgatccacccgccttggcatcacaaagtgccaggattacatgcgagagccactgctcccagccggaaatctcaagttttaaaaatagagttgggttgtgctggacagcagatttggaaaacttctggtttaattcaaccccctcatttta

SEQ ID NO: 21800 - DNA, 601 bp, Human
tggaaaacttctggtttaattcaaccccctcattttacacattggaatgtggaagtcagaaaagggaaggggtttgcttccagccattcagcagaaaggagtccgggtaaatcaaggaacctttctgtaaaatcagaattatcacataattttctggtaatttatattttgaagtgtgaaaaacttcttaaagcaacgttatgagcaagatgtagggtttggattagaaatgctgtaggagagatttttatttttttttccagaaagcctgagatattagctattgttgcagcaaaacccrtttcaagaccacctgcttaaaaaagcagacttttggagctttgatttgattttctattggagtatcataatttaaacttatgttcagagaccacctgcttaatttggctgcaggaagctagcaaagtacattgtatcatggaaaaatctagttaaggaaggaagtgtttccaaatacagtttactactttgataggaaatacagtccttaataagacaggttttttgcccaaggatctccaggctcttccataatttctccaaagcccagcgctctgcatatatcttcctagttcttcct

SEQ ID NO: 21801 - DNA, 601 bp, Human
tcttccataatttctccaaagcccagcgctctgcatatatcttcctagttcttccttcagaaaacctaaatgatgcaaaatgataccacagtgttgaatgtttgattttaaggtgggtggatttaataaggaaaagatgttttgcgtctttttcattgatcgcttaggcattcttgcttttttgattgatttttaacctgggtggaggggtttgaggagctgtttgagaatgtgatgaaggtcttggaccatatctctagaaaaatgtacatacacaatacacaaacacaggcacacagacccccccaacacagacacacacacacacacacacacacacagacagacacagacacacacacacagacacacacacacacacagttctacacatgatttcaggttggggaggtctcccaccctgtcctcatagatgcattgggcttccatggacttcatctctccattgccttgctgtgataagttgcaccttcataatggaaactcactctgattcagaaccagctgaacactggttgctgagaacaatgcgtagaagggttgactgcacaggccacttcgtttgatggtttgcatgtgg

SEQ ID NO: 21802 - DNA, 601 bp, Human
atttctccaaagcccagcgctctgcatatatcttcctagttcttccttcagaaaacctaaatgatgcaaaatgataccacagtgttgaatgtttgattttaaggtgggtggatttaataaggaaaagatgttttgcgtctttttcattgatcgcttaggcattcttgcttttttgattgatttttaacctgggtggaggggtttgaggagctgtttgagaatgtgatgaaggtcttggaccatatctctagaaaaatgtacatacacaatacacaaacacaggcacacagacccccccaayacagacacacacacacacacacacacacacagacagacacagacacacacacacagacacacacacacacacagttctacacatgatttcaggttggggaggtctcccaccctgtcctcatagatgcattgggcttccatggacttcatctctccattgccttgctgtgataagttgcaccttcataatggaaactcactctgattcagaaccagctgaacactggttgctgagaacaatgcgtagaagggttgactgcacaggccacttcgtttgatggtttgcatgtggcattctgga

SEQ ID NO: 21803 - DNA, 601 bp, Human
atatcttcctagttcttccttcagaaaacctaaatgatgcaaaatgataccacagtgttgaatgtttgattttaaggtgggtggatttaataaggaaaagatgttttgcgtctttttcattgatcgcttaggcattcttgcttttttgattgatttttaacctgggtggaggggtttgaggagctgtttgagaatgtgatgaaggtcttggaccatatctctagaaaaatgtacatacacaatacacaaacacaggcacacagacccccccaacacagacacacacacacacacacacacrcacagacagacacagacacacacacacagacacacacacacacacagttctacacatgatttcaggttggggaggtctcccaccctgtcctcatagatgcattgggcttccatggacttcatctctccattgccttgctgtgataagttgcaccttcataatggaaactcactctgattcagaaccagctgaacactggttgctgagaacaatgcgtagaagggttgactgcacaggccacttcgtttgatggtttgcatgtggcattctggaaggagcatggctctgccattggagagt

SEQ ID NO: 21804 - DNA, 601 bp, Human
tttctgtatttgtcttcccagtggtacagtgcttgagcaaaactccaaagactaaatatgtttgagatgctggcagactcgtatctggctttaaggtgtgtgacctcaagactcgaagtctcagggtagttttttagatggaacatttattggcaattcaactttcctctttaatttgtaactataaagatgttctctaattgaaatttatcattctttcaaatgactctgtttcctttttcatattgttaaaaaagcctgtttccatcggcttgttaattacaggaatataatcctaacrggtaagaggcacctatggttaattttctgcccttagacctgcgtgttttgttaacaagaaagccagaacctactgccagatcacaactcttgatctcttttgttacacagttgtctgtgttctttaaataaaaactgtggtaaaaatcatcttacaattttgttggatttgaggaatcagagagaatattccccaaaatatgtactgtttatttatttatttatttatttatttttagtatttattgatcattcttgggtgtttctccgagagggggatttggcagggtcataggacaat

SEQ ID NO: 21805 - DNA, 601 bp, Human
tttaaccctgagtggacacagcacatgtttcagagagcacggggttgggggtaacgtcatagattaacagcatcccaaggcagaagaatttttacttaatacagaacaaaatggagtctcccatgtctacttctttctacacagacacagtaacaatctgatctctctttcttttccccacatttcccccttttctattcgacaaaaccgccatcgtcatcatggcccgttctcaatgagctgttgcgtacacctcccagacggggtggccaccaggcagaggggctcctcacttcccagwaggggcggccgggcagaggcgccccccacctcccgaacggggtggctgccgggcggaggggctcctcacttctcagatggggcggcccgtcagagacgctcctcacctcccagacggggtggcggcggggcagagacactcctcagttcccagacggggtcgtggctgggcagaggcgctcttcacatctcagacggggcggcagggcagaggcgctccccagatcccagacgatgggcggccgggcagagacgctcctcacttctagacgggatgacggccgggaagaggcgctcctca

SEQ ID NO: 21806 - DNA, 601 bp, Human
ttaaccctgagtggacacagcacatgtttcagagagcacggggttgggggtaacgtcatagattaacagcatcccaaggcagaagaatttttacttaatacagaacaaaatggagtctcccatgtctacttctttctacacagacacagtaacaatctgatctctctttcttttccccacatttcccccttttctattcgacaaaaccgccatcgtcatcatggcccgttctcaatgagctgttgcgtacacctcccagacggggtggccaccaggcagaggggctcctcacttcccagtmggggcggccgggcagaggcgccccccacctcccgaacggggtggctgccgggcggaggggctcctcacttctcagatggggcggcccgtcagagacgctcctcacctcccagacggggtggcggcggggcagagacactcctcagttcccagacggggtcgtggctgggcagaggcgctcttcacatctcagacggggcggcagggcagaggcgctccccagatcccagacgatgggcggccgggcagagacgctcctcacttctagacgggatgacggccgggaagaggcgctcctcac

SEQ ID NO: 21807 - DNA, 601 bp, Human
gcgctcttcacatctcagacggggcggcagggcagaggcgctccccagatcccagacgatgggcggccgggcagagacgctcctcacttctagacgggatgacggccgggaagaggcgctcctcacttcccagactgggtggccgggcagacacgctcctcacttcccagacggggtggcggccgggcagaggctgcaatctcggcactttgggaggccaaggcaggtggctgggaggtggaggttgtagcgagccgagatcatgccactgcactccagcctgggcaacactgagcactgrgtgagcaagactctgtctgcaatcccagcacctcgggaggctgaggctggcagatcactcacggtcaggagctggagaccagccgggccaacccggtgaaaccccgtctccatcaaaaaatacgaaaaccagtcaggtgtggcggcgcgcgcctgcaatcccaggcactccgcaggctgaggcaggagaatcaggcagggaggctgcagtgagccgagatggcggcagtacagtccagccttggctcggcatcagaggcagaccgtggagagagagggagagggagaccgtggagaggga

SEQ ID NO: 21808 - DNA, 601 bp, Human
acttctagacgggatgacggccgggaagaggcgctcctcacttcccagactgggtggccgggcagacacgctcctcacttcccagacggggtggcggccgggcagaggctgcaatctcggcactttgggaggccaaggcaggtggctgggaggtggaggttgtagcgagccgagatcatgccactgcactccagcctgggcaacactgagcactgagtgagcaagactctgtctgcaatcccagcacctcgggaggctgaggctggcagatcactcacggtcaggagctggagaccagccrggccaacccggtgaaaccccgtctccatcaaaaaatacgaaaaccagtcaggtgtggcggcgcgcgcctgcaatcccaggcactccgcaggctgaggcaggagaatcaggcagggaggctgcagtgagccgagatggcggcagtacagtccagccttggctcggcatcagaggcagaccgtggagagagagggagagggagaccgtggagagggagagggagaccgtggagagggagagggagagggagaatgtactgttatagactggacagatttattagccagatgttgcttgtgtt

SEQ ID NO: 21809 - DNA, 601 bp, Human
aggcgctcctcacttcccagactgggtggccgggcagacacgctcctcacttcccagacggggtggcggccgggcagaggctgcaatctcggcactttgggaggccaaggcaggtggctgggaggtggaggttgtagcgagccgagatcatgccactgcactccagcctgggcaacactgagcactgagtgagcaagactctgtctgcaatcccagcacctcgggaggctgaggctggcagatcactcacggtcaggagctggagaccagccgggccaacccggtgaaaccccgtctccaycaaaaaatacgaaaaccagtcaggtgtggcggcgcgcgcctgcaatcccaggcactccgcaggctgaggcaggagaatcaggcagggaggctgcagtgagccgagatggcggcagtacagtccagccttggctcggcatcagaggcagaccgtggagagagagggagagggagaccgtggagagggagagggagaccgtggagagggagagggagagggagaatgtactgttatagactggacagatttattagccagatgttgcttgtgtttttagttggtgactacatttagccatct

SEQ ID NO: 21810 - DNA, 601 bp, Human
actgtaagtgcacccaaagatgcttagttgaattggctaccattctaaggactacttttagccatttctgtctgccttcctgcgacactagaacatgggtccctgggatgcctgtatacaggttaatttagtattactaagtagagcgcatttccagaaatcatctgagtctctagccacccttagaatcaccgtgacaaagatttaccccattaacatggaatgtgcctcttaaatgtgtatcgtttttatttttttccttgagacggagtcttgctctgtcacccaggctggaatgcartggcgtgatctcggctcactgcaacctacgcctcctgggttcaagcagttctcctgcctcagctcccgagtagctgggattacaggcatgcaccaccacaccttgctaattttttgtatttttagtagagatggggtttccccatgttggccaggctgctctcaaactcctgacctcgtgatccaccctcctcggccttccaaagtgctgggattacaggtgtgaggcactgcccctagcccttaaatgtgtatcttaagctcacttaacagtaattgactattgttattaaattccttt

SEQ ID NO: 21811 - DNA, 601 bp, Human
gtaatcccagctacttgggaggctgaggcaggagaatcgcttgaacccgggaggcagaggttgcaatgagccaagatcacgccactgcactccagcctgggcgacagagggagattctgtctcaatgataatagtaattagaatgaagtagcattaaacatttagttcttcagtcacattggtcctgtttcaagtgttcagcagcaggggaggtcagtggccccgtcctgggcagcacatacatagcacatctccagcactgcagaaagctctgctggattatgttgttttgtagtcccayccagtgaggagagtttataaagggaacacagtgctgcagaatctggaagtttccttagcaaacaaggggaacagtatcatggaacatgggcagatattgaggtcataaataaaatacacctttgtaaaattataatattaaattgcctcattctctcatgagaaataatgcagccccctgctgttttgaatgctgtattatatattagacctcagaggttcttgatgcccagatgtaacactaagttgaaattacctgttgcctgctagtgtcctctgtgaaaagtcaaaaacaaaaaca

SEQ ID NO: 21812 - DNA, 601 bp, Human
aatgacaacagtcttcagttccctcgagtcatgtggctcaagtgatggatagcactgtccttgttcccaggattgattttaaacattatggccatgctgtctattttcttgctcatttcatagtgcacttcgctgtgctacatggtatttctatttgggcatatgccccccgtttgtagccagtctctcgtacagcgcagcatctgtcacaggctcctggttcatgggccctgaaaacgtgggtggtctgtgttcataacagcgccacacgtgggactaggcagtggtgttctccacacayggtaccattcttctcacatgtagtcacttgagggactattgtgtacgtagtccaggagggtagagtagaaagcctttgcaagcagttaggttccagggatttttttttttttaaatcttgattttgcttttccctttagatcaacctgccccttgacctatgctatgttcagaattaattgaaattggaggaatggccataaacattctttgggattaaatgcctttcaaccatgtggctttcagacaagctcctttttttaaacacaagagtctgatggagatgcagtggaggcctggt

SEQ ID NO: 21813 - DNA, 601 bp, Human
atgtggctcaagtgatggatagcactgtccttgttcccaggattgattttaaacattatggccatgctgtctattttcttgctcatttcatagtgcacttcgctgtgctacatggtatttctatttgggcatatgccccccgtttgtagccagtctctcgtacagcgcagcatctgtcacaggctcctggttcatgggccctgaaaacgtgggtggtctgtgttcataacagcgccacacgtgggactaggcagtggtgttctccacacacggtaccattcttctcacatgtagtcacttsagggactattgtgtacgtagtccaggagggtagagtagaaagcctttgcaagcagttaggttccagggatttttttttttttaaatcttgattttgcttttccctttagatcaacctgccccttgacctatgctatgttcagaattaattgaaattggaggaatggccataaacattctttgggattaaatgcctttcaaccatgtggctttcagacaagctcctttttttaaacacaagagtctgatggagatgcagtggaggcctggtgcacgtttattcctggggagagggttgccc

SEQ ID NO: 21814 - DNA, 601 bp, Human
gtgcacttcgctgtgctacatggtatttctatttgggcatatgccccccgtttgtagccagtctctcgtacagcgcagcatctgtcacaggctcctggttcatgggccctgaaaacgtgggtggtctgtgttcataacagcgccacacgtgggactaggcagtggtgttctccacacacggtaccattcttctcacatgtagtcacttgagggactattgtgtacgtagtccaggagggtagagtagaaagcctttgcaagcagttaggttccagggatttttttttttttaaatcttgaytttgcttttccctttagatcaacctgccccttgacctatgctatgttcagaattaattgaaattggaggaatggccataaacattctttgggattaaatgcctttcaaccatgtggctttcagacaagctcctttttttaaacacaagagtctgatggagatgcagtggaggcctggtgcacgtttattcctggggagagggttgccctcatttgctctgttccctctcgtggttcagcattttcctgatcaatgcttttccctgtttctcttgtcacctctcccatcctttgtcgtgcg

SEQ ID NO: 21815 - DNA, 601 bp, Human
gaaattacttcctggagatatccatcagatccgaaaagagtttccgcatttagtggacaggaccacagctgtggctcgaaaaacagggtttccggagataatcatgcctggtaagaactggcttgttcagggcttctcagcatggcatgggggtagccggccacggaggatgacgtgtgggcagcatcatgtatgagctctggcaaggaaagggctcagctcctggtaggtgaccctgtaagccccagcatggttatggatcatggggctgtgaccggagtggtagaatatgctccctggycccctgtacccctggatggatcagctctccccagctgcaaggattgtgtgaggggggcgtgggcacccagcaaatgtctgggtagacatcaggtcaaaagaagaaagaggtcagaaagggagctgcccattgtgaagcccacttagggcaaatggcagggttggatggtcgctgaatggaaatgcctgtgcctgcgcccgctcagctagtgtacgttatactggcattcctccatgaattctaagtcatgaattctaaactgaccgataacaggatttgcgtgttaacattaatctcata

SEQ ID NO: 21816 - DNA, 601 bp, Human
tacgttatactggcattcctccatgaattctaagtcatgaattctaaactgaccgataacaggatttgcgtgttaacattaatctcatatttacataatacttttcattttccaaataacgttcctaataatctgatttgatcatcaagagatctttggaagcatgttaatttgtatcctttatatccgtgtgatactttttggtttgcaagtaatgcttacgtggcttggcagggcgtagtggctcatgcctgtaatcctagcactttgggagttcgaggcggggggatcacttgaactagggttcgagaccaccctggggaacatggcgaaaccccgtcttgacaaaaaaataaaaaaactagctgggcgtggtggcatatgcctgtcattctagttactttggggggctgaggtggaggaatcacttgaacctgggaggcagaggttgctgtgagcacagatcacgccactgcactctagcctgggcgacagattgagaccctgtctcaaaacaaaactaacttgaaccacgtgaggctcttggaagcccacaaattggtgttgagtgaattcctatccagattaaactgtagcctaa

SEQ ID NO: 21817 - DNA, 601 bp, Human
tgagcctccggagtagctgagattacaggcacgcactaccatgcctggctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggstaagtgacttgtccaaggtcacacagcaaatgagcaacaagtcttggttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaaaagaaaaaaaaaagccaaaacaagaaagcaaggagcaaagagagttattttc

SEQ ID NO: 21818 - DNA, 601 bp, Human
gctgagattacaggcacgcactaccatgcctggctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggctaagtgacttgtccraggtcacacagcaaatgagcaacaagtcttggttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaaaagaaaaaaaaaagccaaaacaagaaagcaaggagcaaagagagttattttccttaagggatccttg

SEQ ID NO: 21819 - DNA, 601 bp, Human
ggctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggctaagtgacttgtccaaggtcacacagcaaatgagcaacaagtcttsgttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaaaagaaaaaaaaaagccaaaacaagaaagcaaggagcaaagagagttattttccttaagggatccttggtcttcagccagaatgggcatttgctgctct

SEQ ID NO: 21820 - DNA, 601 bp, Human
gccaaaacaagaaagcaaggagcaaagagagttattttccttaagggatccttggtcttcagccagaatgggcatttgctgctcttgacggaaccgctctttggctccttgggagagcgggtggtcagggcgtgggaggtggccaggcaggcagcagaggagcagtggctgggaacgaggcttcctctaaatcatgttactaatgaagcttgtgaagttctcccagttgggccattaccaggggcttcctatgttctcagtaggaagaagagtcttgagctcatttcttgcgttttttttmccccctacaattaaaagcccatctcactttaaaacagacaggtctgttttgttcttctctctgtggtccccattcgggatcctgatagctgcctgccagaagggaagagccatgcagaaagtttctccctagacccgtttttcctccctgattctaggctggtgatcctcattctttttttctttatttttattttattttattattttaagttttagggtacatgtgcacaacgtgcaggtttgttacatatgtatgcatgtgccatgttggcgtgctgcacccattagctcgcttttg

SEQ ID NO: 21821 - DNA, 601 bp, Human
ggtggccaggcaggcagcagaggagcagtggctgggaacgaggcttcctctaaatcatgttactaatgaagcttgtgaagttctcccagttgggccattaccaggggcttcctatgttctcagtaggaagaagagtcttgagctcatttcttgcgttttttttaccccctacaattaaaagcccatctcactttaaaacagacaggtctgttttgttcttctctctgtggtccccattcgggatcctgatagctgcctgccagaagggaagagccatgcagaaagtttctccctagacccrtttttcctccctgattctaggctggtgatcctcattctttttttctttatttttattttattttattattttaagttttagggtacatgtgcacaacgtgcaggtttgttacatatgtatgcatgtgccatgttggcgtgctgcacccattagctcgcttttgagacggagttttgctctgttgctgaggctggagtgcagtggcaggatctcggtttgcggcaacttctgcctcccgagtagctgggattacaggcctgcaccaccacgcccagtagctaatttttgtatttttagtag

SEQ ID NO: 21822 - DNA, 601 bp, Human
tgagggttcaccatgttggccaggctggtcttgaactcctgacctcaagtgatctacccacctcggcatcccaaagtgatgggatcacaggggtgagccacctcgcctggccggtcctcattcttaatcagcttttagttcaactcttggagtcatgcttttaagaagaatgcataggaggcaaccttgccagttacctgggagtgccagtggatactgcgatagtccttggctactgaggactcagacagccgtagccagccgtctaacaagggacaatggtgtgggctgccatgggtcrtggatgccatcaatagtattggagcccctctggttgtcggctaccctgagaggggtagagtgtcctctgcccagatgataaccaagcagatcattggaaactttgagatttttcctctttctagaaaactttatcatgatgaaaattgctcttgtcatgtatttaaatggtgagactgttttgtagaaaatatttcataatcatctaatatgtatttgtaataatctatgaggataggtagacagtcttgcaaaattcacaattacgctattaataatggattgttttttaaatgtatga

SEQ ID NO: 21823 - DNA, 601 bp, Human
tggtgagactgttttgtagaaaatatttcataatcatctaatatgtatttgtaataatctatgaggataggtagacagtcttgcaaaattcacaattacgctattaataatggattgttttttaaatgtatgatttctcccccctcaggtgatgttcgaaatgatatctatgtaacattagttcaaggagattttgataaaggaagcaaaacaacagcgaagaacgtggaggtcacggtgtctgtgtacgatgaggatgggaaacgattagaggtatttattgtggcgagggctcatctgkagtgtttcagttttacttgccaagtgctcaccttggctctgctacagcatagatgtcgtcagggtggggctttggagtcccgtttcttgggattggcgttggttcttgtttccttttctccagcttgccatgcagggcctggggtcctctggtcctggcagctggcctatctcaggaggtccctgtggtcttttttttttttttttttgagatggagtctagctctgttgcccaggctggagtgctgcaggtgtgtgccaccgtgcctggctaatttttatattttttagtagagatggg

SEQ ID NO: 21824 - DNA, 601 bp, Human
aaatatttcataatcatctaatatgtatttgtaataatctatgaggataggtagacagtcttgcaaaattcacaattacgctattaataatggattgttttttaaatgtatgatttctcccccctcaggtgatgttcgaaatgatatctatgtaacattagttcaaggagattttgataaaggaagcaaaacaacagcgaagaacgtggaggtcacggtgtctgtgtacgatgaggatgggaaacgattagaggtatttattgtggcgagggctcatctgtagtgtttcagttttacttgycaagtgctcaccttggctctgctacagcatagatgtcgtcagggtggggctttggagtcccgtttcttgggattggcgttggttcttgtttccttttctccagcttgccatgcagggcctggggtcctctggtcctggcagctggcctatctcaggaggtccctgtggtcttttttttttttttttttgagatggagtctagctctgttgcccaggctggagtgctgcaggtgtgtgccaccgtgcctggctaatttttatattttttagtagagatggggtttcaccatgttgacctca

SEQ ID NO: 21825 - DNA, 601 bp, Human
atcaattaaattgctcagcgttagagagctctaggggtggaactgagcacctgctcatgacagccagagctctgacctcgtgctctacctaccggcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatkatgtctttctctctgggtgaaccccgtccagcatcactgcctgcctcgtctccctggaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtg

SEQ ID NO: 21826 - DNA, 601 bp, Human
gagagctctaggggtggaactgagcacctgctcatgacagccagagctctgacctcgtgctctacctaccggcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatgatgtctttctctctgggtgaacyccgtccagcatcactgcctgcctcgtctccctggaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggc

SEQ ID NO: 21827 - DNA, 601 bp, Human
gagctctaggggtggaactgagcacctgctcatgacagccagagctctgacctcgtgctctacctaccggcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatgatgtctttctctctgggtgaacccygtccagcatcactgcctgcctcgtctccctggaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccg

SEQ ID NO: 21828 - DNA, 601 bp, Human
gcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatgatgtctttctctctgggtgaaccccgtccagcatcactgcctgcctcgtctccctggaaacataggtgctgcccttgccactggtctttctggytggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgt

SEQ ID NO: 21829 - DNA, 601 bp, Human
gtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatgatgtctttctctctgggtgaaccccgtccagcatcactgcctgcctcgtctccctggaaacataggtgctgcccttgccactggtctttctggttggagtgaagcaaacagtgttcatggctggaggaaggggaggggagggttcccacyttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccacatatatagtgggagatgtatatggtgtcaag

SEQ ID NO: 21830 - DNA, 601 bp, Human
gaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgcygggaacgtgttcatttgtggtgggggtgtgttggtgttcttggagcgtacctgtccccccacatatatagtgggagatgtatatggtgtcaagctctatgaggtcttacgtgagctctttatgtcttcttttaaagcatgtgattttcccgggtgctggtgatgaagcgatttcagagtacaaatctgtgatttactaccaagtaaagcagccacgctggtttgagactgttaaggtattatttacatggtcattttatcacatggcgctgattatgaaatgctcatttgtaacccaagg

SEQ ID NO: 21831 - DNA, 601 bp, Human
tggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccrcatatatagtgggagatgtatatggtgtcaagctctatgaggtcttacgtgagctctttatgtcttcttttaaagcatgtgattttcccgggtgctggtgatgaagcgatttcagagtacaaatctgtgatttactaccaagtaaagcagccacgctggtttgagactgttaaggtattatttacatggtcattttatcacatggcgctgattatgaaatgctcatttgtaacccaaggaaacatcctaacatcctcctcagcccgggagctgctccaggcaggcagagtgtctcccaac

SEQ ID NO: 21832 - DNA, 601 bp, Human
gggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccacatatatagtggragatgtatatggtgtcaagctctatgaggtcttacgtgagctctttatgtcttcttttaaagcatgtgattttcccgggtgctggtgatgaagcgatttcagagtacaaatctgtgatttactaccaagtaaagcagccacgctggtttgagactgttaaggtattatttacatggtcattttatcacatggcgctgattatgaaatgctcatttgtaacccaaggaaacatcctaacatcctcctcagcccgggagctgctccaggcaggcagagtgtctcccaacaaagtcattcaag

SEQ ID NO: 21833 - DNA, 601 bp, Human
attagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccacatatatagtgggagatgtatatggtgtcaagctctatgaggtcttacgtgagctctttatgtcttcttttaaagcatgtgattttcccgggtgctggtgatgaagcratttcagagtacaaatctgtgatttactaccaagtaaagcagccacgctggtttgagactgttaaggtattatttacatggtcattttatcacatggcgctgattatgaaatgctcatttgtaacccaaggaaacatcctaacatcctcctcagcccgggagctgctccaggcaggcagagtgtctcccaacaaagtcattcaaggttgctaaggaaccacactggtgtttcttagaatacatttactctcatctccttttggacgtaaaaataggacgttcatggagacaaatgacaga

SEQ ID NO: 21834 - DNA, 601 bp, Human
gtcattcaaggttgctaaggaaccacactggtgtttcttagaatacatttactctcatctccttttggacgtaaaaataggacgttcatggagacaaatgacagagtctttttaagatagctattgtctttctcttcccagtactgttttatgtgtggcatgctgtctttacaccaaacaaaaaaaccgagctgccagcctgtggaggtcattgctggggagtgggatcctgttctgtagctctgatatggtgccttttcataatgcagcgtgctcacatctccacgatggagtaaacacygtctcaccgccaagagcttgaatatttgaaaaccaggccaggggttggctctggaatacagatgtttgatgtgagaattagggacaatttttgcttagaggcagcatgtattaggtcttttttctttgagtgtaatgtgacaacaggaaagcttttttggcgcagctgtgggcaggtcaccacagctgtggaaggaatatagacccttccaggttggggctaagaagaaaaacggcaacttttctttttttgagacggagtctcactctgtcacccagactggagtgcagtggtgcaatc

SEQ ID NO: 21835 - DNA, 601 bp, Human
gactgctgggattacaggcatgagccaccatgcccggcccaaaaacagcaacgtttaaaagtagaatcttggccggatgtggtggctcacacttgtaatcccagcactttgggaggctgaggtgggcagatcatctgaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcragccattgcaccactctagcctgggcaacaagagcgaaactctgtatcaaaaaaaaaaaaaaaaaaaaaaagaaagaaaaaagaatcttaacagtaatggtcagagcattcagaaaaaaaaattcagctgtgtcacggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttac

SEQ ID NO: 21836 - DNA, 601 bp, Human
ggctcacacttgtaatcccagcactttgggaggctgaggtgggcagatcatctgaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcgagccattgcaccactctagcctgggcaacaagagcgaaactctgtatcaaaaaaaaaaaaaaaaaaaaaaagaaagaaaaaakaatcttaacagtaatggtcagagcattcagaaaaaaaaattcagctgtgtcacggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttacgctggatgatattgataacagtgcttaaacttctttttcaattcttgaaggtggccattcccatcgaggacgttaaccgcagt

SEQ ID NO: 21837 - DNA, 601 bp, Human
gaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcgagccattgcaccactctagcctgggcaacaagagcgaaactctgtatcaaaaaaaaaaaaaaaaaaaaaaagaaagaaaaaagaatcttaacagtaatggtcagagcattcagaaaaaaaaattcagctgtgtcayggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttacgctggatgatattgataacagtgcttaaacttctttttcaattcttgaaggtggccattcccatcgaggacgttaaccgcagtcaccttcggtttaccttccgccacaggtcatcacaggactgtgagtagtcaag

SEQ ID NO: 21838 - DNA, 601 bp, Human
aacatgggctcttaaggtgcctgtcttagaattggaaatcttgaaccctttttgtcttccttggtggcccttgctgtctggagctcagggatggcttttctcatagacatttttgtgaatactgaccatggtgccaagactttaggaggaaagaactgctatttgaatcactctccttcaaaaagaatttattattgatgactgaaatttgttccatcacattttgttaaattaattgtcaactaaagctgtagccctgtgctagacagtaagatatcacagaaggaaaacatgattcccrtctttcagggtgtgtgtctctttggcattgggaactgagacatattcatatttgggacaataaatgacaaagagagttggctacaggcttgtgtgccgcaggcagttaaaggaaaagagtggtgtggagggcagaccgccctttgtcactgatgaccccgtgggggtcacaccgtgcagtgggcagtttcaggttctgtgtgctctggatggagcttaagcatgagcctcttctgtatcttcatttgaggataagaatacctttctggctggtgccgtggctcacacctgtaatcccaga

SEQ ID NO: 21839 - DNA, 601 bp, Human
ggaaaagagtggtgtggagggcagaccgccctttgtcactgatgaccccgtgggggtcacaccgtgcagtgggcagtttcaggttctgtgtgctctggatggagcttaagcatgagcctcttctgtatcttcatttgaggataagaatacctttctggctggtgccgtggctcacacctgtaatcccagaactttgggaagccaaggtggaagattgcttgagccccggagtttgagaccagcttgggcaacacagtgagacccgatctttactaaaacagttatcctggtgtgatggtayacctgtagtctcagctgctcaggaggctgaggcaggaggattgcttgaacccgggaggcagaggttgcagtgagctgtgattgcaccactgcacttcagcctggggaacagagtgagaccctgtctcaaaaacaaaaagcaaaacaaaaaaaacataaaccttcctcctagggtattcttgaaggtcaggcaaggtggaggctggccaccttctggcacgctgcctggtatggataggggctccattgtagttgctgctgctggaataatgtgttcattcacctgactgtttctggggcc

SEQ ID NO: 21840 - DNA, 601 bp, Human
caagattcccatgtggtatcagtattattacttcccacattacagatgaggaaactggggcttggaaaccccaggtcaggggctgaaaggcacccaggtagtcagtggaagagctttggttctaagccaggtccttgtgcccgagccttatgctccaatgccttgggggagtggcgaggccacttctttcctttggcttttattgagttcctgctgtatacacaacaagctgctggggtttctcctcttgcagagcttaggtttgagttgaggtttgagattagtttgcaagaaccagctrgggcgtggcagcctgtgagtatcacatgaattaggcagaggtatgatgtgagcggagggtgctggtggaatgggggtggctgtgggcacaggtgtgtcctcgaccaaggcatggagggcatggtgggggccagcctagtgggctgcagtgtgccccagaccctctagggctccacgcatatatcaccttgaggcccacggaggaagcaggttaagaacggggttctggaatccacagaggactcgtctcaaaattacgctcccgtcttttaacaagctcattctctctaattaataaatt

SEQ ID NO: 21841 - DNA, 601 bp, Human
tccgtggccacagcttgtgggattttggaaacatgttgagcatcgcaggtgcgatgccgatgaaagcctggatgtcggccgctgaccatggccttcggggcctccccagccagccctgcatgcagatacctggggcagaaacaggtagaaagagctgaggccacattggtccccacttgctaccctgaagaggaggctagcaaagggaacaagtgatgggatttctcacctgggatctgaccttgggattggaaagtttggtgtcgatgggttaacataatacctttccagcaacctgtcrgcaactccagctgcaccagaccgtgtggtccacggagccaggcagacttgcagctctcaggcccagctggccaggagctgagttttccttgattgtagtgggcttgttgggtagggcggcctagagaatgggcagctctacccacactccagaacacacaacccctactgctgttcctaaggttctgtaaacttgtcatataaaccatccatctcatgatggctgctagtgagcatgcagtaaaaagcggtccattcctcggatgtgaagatgcagaatgttaataaaaggtgcacttac

SEQ ID NO: 21842 - DNA, 601 bp, Human
ttattgtcacacgtccttctgaaccctggctgttttcctggaggcatgtcttttttgttgccgttgtttccaagtccacccaaacttaggaggaactgttctgttctttgccatttgaacattgaaatatttcatgtgctctggtgcccttttacagagttatttttttagaatcctagggtacatatattttacttctgtttcttcctgtgttttttggctggttgattattcatggaaccatttaatttgccaggatgtattgagcacaaccaggaaggcaaaggtgataagccatgtygtcttgggtagtgggatccgacggtaaatattttgagccgtggactcaaggcgggtggatgtgtcattctccctctctgatctctgtcctttcatctataaagagaaagctcggaatctgtaattgtagagatagtttccagctctggtcctctgtttctgtgctctgctgggattgcaacttgaggaatttctggcagatccatttcttcagtccatgttcctcatctgtcctggcttatcagtccttccccgcctttggccctcgctgtctgtcaccagccacactggacttctgtcc

SEQ ID NO: 21843 - DNA, 601 bp, Human
gactaataaattggattgtccccgttgtcactgtgaccccttaagaaaccacaatgttttgttttctatatcatctgaaagctcatttgtttgttgactgtctcccaaagtggcacaaatatggattgagtacctgttgggcaccaggctctatttcatgtactaggaaatggcagtaaaacaaaaggtcacttacattccagggtctagtggatgaaaccaacaataaatagcaacaagatcaacaagattctctatcaatctatctctatctctgtctctgtctctgtctctgtctctrtctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattggggtcgttagtccattggtaattcacatgatggatattgcaaggcaggaatt

SEQ ID NO: 21844 - DNA, 601 bp, Human
attctctatcaatctatctctatctctgtctctgtctctgtctctgtctctatctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattgrggtcgttagtccattggtaattcacatgatggatattgcaaggcaggaattgattttagttttctgtattgacccgcagtttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatcc

SEQ ID NO: 21845 - DNA, 601 bp, Human
ctctgtctctgtctctgtctctgtctctatctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattggggtcgttagtccattggtaattyacatgatggatattgcaaggcaggaattgattttagttttctgtattgacccgcagtttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatc

SEQ ID NO: 21846 - DNA, 601 bp, Human
tgtctctgtctctgtctctgtctctatctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattggggtcgttagtccattggtaattcacrtgatggatattgcaaggcaggaattgattttagttttctgtattgacccgcagtttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctct

SEQ ID NO: 21847 - DNA, 601 bp, Human
ctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctcttctatgagattttgattagaatggctttgaatttatagattaatttgagaacaactgatccctttatgctaggagtcttcttacttgtaaacgtggtccatttttccatatatttattagattagctttaatacctgttygtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccaccctgcgagacggagagcacgatcttatcgtctataaggtatctggttgcattggtgcaatattgctgctatagacagtttcagtcttttctgggctccctgacctggaccaacctttcccatc

SEQ ID NO: 21848 - DNA, 601 bp, Human
ttagaatggctttgaatttatagattaatttgagaacaactgatccctttatgctaggagtcttcttacttgtaaacgtggtccatttttccatatatttattagattagctttaatacctgtttgtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccmccctgcgagacggagagcacgatcttatcgtctataaggtatctggttgcattggtgcaatattgctgctatagacagtttcagtcttttctgggctccctgacctggaccaacctttcccatcattgtgaggaagctgctatctagctacatttaattatgcaaatgaacatttccaatgaccagcccttttgttgttcctaacgggaaaagatgatatacaatataacaataggtgccatctaaaaatgccgtgaacatgaattatgctgcagtaataagggaaattattaaaatgtg

SEQ ID NO: 21849 - DNA, 601 bp, Human
tacaaagcaattacgatggttacaaggattagggataacaaagggtggcaaaaatggtgtgttgctgtttgtgaattgcctttgacatacggcatgactaaatccacaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacggtgcgttygagaggagaaacacactcaccccaggagctctgccccagtcctgtcttttccatgctccttcctatgtggaggtgtgctccgtaggtgcatgaacgtcacccataaggcattcattgcatcgggctgtgatgatttatcaatgcatagaaggtggcatttgttcatttgttgtaatttaaaattcacacttctactctggtctaagggttattcttttatttttatttttattttttaagacaaggtctcagtctcgctctgttgcccaggctggagtgcagtggtgtgatctcaactca

SEQ ID NO: 21850 - DNA, 601 bp, Human
acaagatttggagtcagactaaaaacctggaatcggaacatagccctgtgttaaccctggggatgcccttgaacaagtcttctgcacatttctgggtcttatcttccttgtctgtcgatacgggaatagtgcctgcctcaaagggcttagtgagggttacatgaacagtgggctgggagctcacctccctctttatgtcttccccattctcagctactctctgagataattactagttatctttatttttaaaagctggtttggatgttactttctagccctactcgtgttgtgggataagcaccccctgctgactcccacaccccaaagctcagccctaatgtggcagatcactcatccatcagctggtgccgtgcccttgtgtggggttcggccgatgctttgagtgcctgcaccaccactgcttgcagcctctccagtgacattgctgtccagccaggggtacttcttattcagagcacactgatgttgttgctgtcactccgtctggaagaggcagaaatcctacatttaaaaattgaatcttccaaatgcagccgtatcacagctgtgcagagtgactttatgctctcttgaagca

SEQ ID NO: 21851 - DNA, 601 bp, Human
actttaataggataaacacaggacaaaagtaaagccattgtctggaagtcaggacattgtagtggagcgtgcactgagtgtgctgcatgtttgggcatgcgagccctgggtcaaatgcttttggatctttccgtttctgcactttgcactctgttgttctgggctacactttcccactgctggtctgctgagtaaactgcttggtgtgggagcagtaagtctcttaagtgccttaagcctactggggcacttttatattccatttgcatgcatttctcgaaccatttatgaagggtcctakcttgtggttgtgtagtggtctccatgagcatatgaaaagccttacctgggtgtgggatctatgcagccgtgcagtggggaagggagagaatgcacagggagcctgctagtggcatgcccgaggcatgtgcagtgtatttgtccctgttcatgctgctgataaagacatacctgagactgggcaatttacaaaagagagaggtttaatgtacagttctgtgtgactggggatgcctcacaattgtggtggaaggcaaggaggagcaagtcacatcttacgtggatggccgcaggcagagag

SEQ ID NO: 21852 - DNA, 601 bp, Human
tggtggaaggcaaggaggagcaagtcacatcttacgtggatggccgcaggcagagagagagagaaagagagagagagagcttgtgcaggggaacttctctttttaaaaccatcagatctcatgagtcttatcactctcatgagaacagcacaggaaagacctgcccccatgattcaattacctcccaccaggtccctcccacaacacgtgggaattcaagataagatctgggtgtggacatagccaaaccatatcatgtggtcagcagtgcggggctcaacttgggacttggttatggaarggatgctcccctgtgacatgttagtctctggatgtggccttgatagctccactcgcctgacagatgacagcatccagagcctaatttaacccaaaggtgacatctccaggtgggccacactttagcatttcagtaggtgccatgtgttgcagtgctcatggtgcaggaagccatcatctcataattgggtcatgttccgaaagcatgctcggaagtcattacttaacttgctcatctttccccattcaaagcaatgctctgagctgcggttaggtgatgaggcccatccacagaatcctt

SEQ ID NO: 21853 - DNA, 601 bp, Human
gaattcaagataagatctgggtgtggacatagccaaaccatatcatgtggtcagcagtgcggggctcaacttgggacttggttatggaaaggatgctcccctgtgacatgttagtctctggatgtggccttgatagctccactcgcctgacagatgacagcatccagagcctaatttaacccaaaggtgacatctccaggtgggccacactttagcatttcagtaggtgccatgtgttgcagtgctcatggtgcaggaagccatcatctcataattgggtcatgttccgaaagcatgctcrgaagtcattacttaacttgctcatctttccccattcaaagcaatgctctgagctgcggttaggtgatgaggcccatccacagaatccttcttaacccttatgaccctggagaaaggggactgtggaccaggacatccccccggggggtggggtcagtggcaatccctcctttcaccctcaagctccttaagtctcaccagctgcagagtaatcccctccccagactgagggagagggcaccctgctctcagcagcagctgttgccaggcaacaaggaaattccgatgtgatgccactcac

SEQ ID NO: 21854 - DNA, 601 bp, Human
cggaggttgcagtgagctgagattgcgccattgcactccagcctgggcagcaagagcgaaacgccatctcaaggaaaaaaaaaaaaaaaaagaaaaagaatatcttgatgccttaaacaaaaacatttctggacactgtcttcttccacattgactctttaaaaaccagtatattcattccttgctttttctatataaaatgcaacaaacaaaaacacaaccataacaaccacaaacttctgtggaagcccagacatggtgagggccggaagctcactcagtgcaggcgtgaacctcagtkcaggcgtggtctcagttgtccagagctactgtagctgtggggactcttaaccttgcagtctcagtactttaatttgtgttagttattttatttatattatctataaaaaaatagcagcttgttcttgagcaggagaaacaaaccatttggtatccagtgcctgggcagcgctttctgggtgagcaggcctcttcaggccttgtggtgctctgaaactgccttcctgtagaatggaaagacaagttcttttttagaattcccaaatgcacttttaaagcttctacatggaaatcatttcat

SEQ ID NO: 21855 - DNA, 601 bp, Human
ttaatgaaattttgtcctctttcattttgaagtccctgtatcatattaggaatgagttgtatttctggcgaccagttaccacagttacctggaagaatgtagaatgatcttgtcccgtcattctcccccattcccctcatctcatagattctcacatttgattattcatccctagacgtggcctttacacctttcctttcttcctgtgcgtgctggtaccacgcaagcctgggtgacctgtccagcccttacctaccttgcctaactttgtgctttttctctgctggcgtgtctgacatgygccgtgagcctagagagtggaactgacttgaggccacggggctgttaatggccagccaggacttgaggaattcctgcctgcacggggctccttttgctgatagggatgctgatagattgtgggtttggttccatttattcaggacctcccttctgagtattgatgactgatagcagagagatggcattgcttggtagattgaggaaggtatttgtgtatttagcaaaagatacgctgtcccattagatggaaaatggaaatggtgactttggtgcccttgaacatggtcttagagagagg

SEQ ID NO: 21856 - DNA, 601 bp, Human
atattaggaatgagttgtatttctggcgaccagttaccacagttacctggaagaatgtagaatgatcttgtcccgtcattctcccccattcccctcatctcatagattctcacatttgattattcatccctagacgtggcctttacacctttcctttcttcctgtgcgtgctggtaccacgcaagcctgggtgacctgtccagcccttacctaccttgcctaactttgtgctttttctctgctggcgtgtctgacatgcgccgtgagcctagagagtggaactgacttgaggccacggggytgttaatggccagccaggacttgaggaattcctgcctgcacggggctccttttgctgatagggatgctgatagattgtgggtttggttccatttattcaggacctcccttctgagtattgatgactgatagcagagagatggcattgcttggtagattgaggaaggtatttgtgtatttagcaaaagatacgctgtcccattagatggaaaatggaaatggtgactttggtgcccttgaacatggtcttagagagagggtggggtgccagatgaagccctttcatggctccgtgtgaagg

SEQ ID NO: 21857 - DNA, 601 bp, Human
aaatgatgggaaatggtgcaaaagtaacaaagtggtacagatccacatagttaggagttgattaatcccttgacatccagaccagcatgccttttggtcaggttggttttgtttcccactgtttgcatgtgacattttctggtataaagtaagtggtggctggcacagccaagcatggagaggattttactccttaaagggtctctgatctcatgctgggcatgctgggcgtcctctctcccaaaggaaacggatgaggctcatgctgggcatgctggacatcctctctcccgaaggaggygggcgaggctgttgctgctgctgtggttccacagcactcctttgcgagcaggagtttgtggtttgcttctttaatcttggggctatagcagtttgagatcttccatgccatcccaaaagccccctgggtgttgggaagaggctgcacagtccaggaggaatctgaaccaaacacctgacccagcctttcctctgatgtccttgctgtgtgatcacctcacccatttatttttatttttctttaaattacagtttcattgagatataattcacataccaaaaaattcatccttttactctg

SEQ ID NO: 21858 - DNA, 601 bp, Human
tgttctggatattttatgtaaattgaatcatacgccctgtggccttttgtgtctggcttctctcacttagccttgtgtcttcaaggtttattcatgccgtagtgactatcagtgcttcacacctttttttgttttgagatgaagttgtgctcttgttggccaggctggagtgcaaaggcgcaatctcaggatcttggctcaccacaacctccacctcccaggttcaactgattctcctgcctcagcctcccaagtagctgggattacaagcgtgtgccaccatgcccggctagttttgtayttttagtagagatgggggtttctccatgttggtcaggctggtctcgaactcccgacctcaggtgatccggcctcctcagcctcccaaagtgctgagattacagatgtgagccactgcacctggcctgcttttatgcctttttatggccgataacattccatcacatggatagaccgcagattgtctttccattcattagttgacacacatttgtattgattctgcttttttggagatgatgaataatatttgtgtacaagttattttgtgaacatatgtttcctttcttttggagagatg

SEQ ID NO: 21859 - DNA, 601 bp, Human
gaccagtagcaaattatttctctgcctcgttctttaatctctttcaatttcaaaatacaaatggcacaaaatcttagattcatggtccataattttttttttcgtttgatcagtctaatagtgcttaggaatatgattggctgcatgtaatagaaaaacaccatttatgtgacttaaccatatggggttcactttttttttttagtcacataatgtgcagcccggaggaagagttccgagttcatgcacctgcgtgaggactcagcgtcctgatgtccttggctcctttgatctctctgcyccaccatccttagtggggtctctttatctcctaatcctaagatggcttctgcccctcccagcatcagctctgcattccaggtggaggagaggggaaggcaaaggagaaacagctgtgccagctattcttctttgaaagagctttcctcatccctagaaagtgtcatgtgctttcatcttattggccagaaccatgtcacatgaccaccctacctgcaaggaagctggaaaggatttttagatgggctggttgatgctttctacaataccagagtgattttagtaaaggagttagggagaa

SEQ ID NO: 21860 - DNA, 601 bp, Human
tagtttgggagtcaatctctgagacttctgtcaccagtatctctttggctttaagtatctctttaggccctaagtgatccactggcatggtttagtcctaccaggctacatagaaatggactgaagtactcagctgctcctcgtgtttgggacaggaagtgtttagtgctaaagtcctctgaatgcctgcattctggtgctcaacagcatggcacagaacatgatcgctctacctgcctttgtcctggtatggacccagcaggagccaggcatggtccacaaactgagtttctttgctggwataacttgtttgttagaagagttgagactgttgaggacacaaagtggtcacaagacaagttgtagcaattgttacaacttagtgaggctccctaagcctctgaggccattgtctgggcattcctgactttagctaaccgagtactgcagtgattctggagatcctgatgctgctgctgctgctcctgatcatgatgatgatgatgatgatttgagacaggacctccctctgtcactcaggatggagtactgtgatgcagtcataggtcactgcagcctcaaacccctgggctcaagccat

SEQ ID NO: 21861 - DNA, 601 bp, Human
gatttgagacaggacctccctctgtcactcaggatggagtactgtgatgcagtcataggtcactgcagcctcaaacccctgggctcaagccatcctcctgccttagtctcccaagtaactaggactacaggcaggtgccagcatgcctggctaattttttgtaggacatggtctcgctatgttgcccaggctggtctcaaactcctggcctgaagccatcctcctgctgtggcctcccaaagtgccaggattccaggcatgagcccctgtaccccactgattctggggatgttgatactcrtgttccttctctccctccctcttttcctcccttcttccctagcttcttccttctctcctcgcttcgttctttcctctctccttccctccttttttctctcttttgtcccttccttccttccttccatgaatacttaatgagtgtatgagccccaagtgtatcccagactttcacagtttgactttattattttttctctgaacgtttcctgaatgtggatcctggctgcctaccctcattcctgaggggagagaaggacataacgttctttgagatgtagagcacctagccgcattgtgc

SEQ ID NO: 21862 - DNA, 601 bp, Human
tttaacagtgatcttttgttacagaaagatgcttcaaaaggatcacggcaaaatgctatgttctaaacatgttggttggcacaagagaaactgttttacatttttactcatgagaggttctggtagaatttaaaaaatattaaagattcattaatcatgccttatagattttgaagctgtgttattgggggcatacagatttataatcatgatgtctttcctgttggtctattccttaatcaatatgaaaagtttctcttaatcttttggctagtatttgcatggaatacctatttccatcttttattttcatgctttctgtgtctttatacttaaggtgtgcctcttataatacaacatatagttgtatttttctttcatccagtctgacaagcttcttaattgagcatttcatccatttatatatagtgtaattaagtaatgttagatttatatattatttttgcattaattttcccttctccatctgtattattttccccttttcctccttttttgccttcttttataccagttacactttttttaagcatctcattttctgatttttaaacatattatttgaatattcttttactat

SEQ ID NO: 21863 - DNA, 601 bp, Human
acagtgatcttttgttacagaaagatgcttcaaaaggatcacggcaaaatgctatgttctaaacatgttggttggcacaagagaaactgttttacatttttactcatgagaggttctggtagaatttaaaaaatattaaagattcattaatcatgccttatagattttgaagctgtgttattgggggcatacagatttataatcatgatgtctttcctgttggtctattccttaatcaatatgaaaagtttctcttaatcttttggctagtatttgcatggaatacctatttccatctttyattttcatgctttctgtgtctttatacttaaggtgtgcctcttataatacaacatatagttgtatttttctttcatccagtctgacaagcttcttaattgagcatttcatccatttatatatagtgtaattaagtaatgttagatttatatattatttttgcattaattttcccttctccatctgtattattttccccttttcctccttttttgccttcttttataccagttacactttttttaagcatctcattttctgatttttaaacatattatttgaatattcttttactattatt

SEQ ID NO: 21864 - DNA, 601 bp, Human
tattgggggcatacagatttataatcatgatgtctttcctgttggtctattccttaatcaatatgaaaagtttctcttaatcttttggctagtatttgcatggaatacctatttccatcttttattttcatgctttctgtgtctttatacttaaggtgtgcctcttataatacaacatatagttgtatttttctttcatccagtctgacaagcttcttaattgagcatttcatccatttatatatagtgtaattaagtaatgttagatttatatattatttttgcattaattttcccttcyccatctgtattattttccccttttcctccttttttgccttcttttataccagttacactttttttaagcatctcattttctgatttttaaacatattatttgaatattcttttactattatttttaacaattattctagagatggtaacatccatgttggacttattttagggtatttcaaatgattactcttaccaatccactgataatgctagatatggccagaaaaatagcacgctggaattgccattttcttctcctctgttttatattattattgtatttcaattctatgtttta

SEQ ID NO: 21865 - DNA, 601 bp, Human
caacatatagttgtatttttctttcatccagtctgacaagcttcttaattgagcatttcatccatttatatatagtgtaattaagtaatgttagatttatatattatttttgcattaattttcccttctccatctgtattattttccccttttcctccttttttgccttcttttataccagttacactttttttaagcatctcattttctgatttttaaacatattatttgaatattcttttactattatttttaacaattattctagagatggtaacatccatgttggacttattttagrgtatttcaaatgattactcttaccaatccactgataatgctagatatggccagaaaaatagcacgctggaattgccattttcttctcctctgttttatattattattgtatttcaattctatgttttatattccataagacattactgttattttatacagttagtattcatttgatgtgttttatgtttgtaattgtttttcatccttcaatttcacttttcctttgggatcattttctttctgtccaaagaactcacttgtattatttcttttagtgttggccagttatgggactctg

SEQ ID NO: 21866 - DNA, 601 bp, Human
ctagatatggccagaaaaatagcacgctggaattgccattttcttctcctctgttttatattattattgtatttcaattctatgttttatattccataagacattactgttattttatacagttagtattcatttgatgtgttttatgtttgtaattgtttttcatccttcaatttcacttttcctttgggatcattttctttctgtccaaagaactcacttgtattatttcttttagtgttggccagttatgggactctgtttgtatgaaaatgatttatttcatctttgtgtttgaaakatattttcactcactatagcattctaggttggaagttattttcttcttccatgtattctattctattttgatttccttcatttatagtaagtcattagctttcagacttactgttacatctttgaatttaaatggtattattttctttcttgctgcttttagtttgtctccttttctgtggttattgacaatcttactatgggttgcataggattgtttttgctttttatttatcctgcattgaatttctgaattttttgattgatatctttgatcagttttggaagatttgtggccatt

SEQ ID NO: 21867 - DNA, 601 bp, Human
tttgatgtgttttatgtttgtaattgtttttcatccttcaatttcacttttcctttgggatcattttctttctgtccaaagaactcacttgtattatttcttttagtgttggccagttatgggactctgtttgtatgaaaatgatttatttcatctttgtgtttgaaagatattttcactcactatagcattctaggttggaagttattttcttcttccatgtattctattctattttgatttccttcatttatagtaagtcattagctttcagacttactgttacatctttgaatttaartggtattattttctttcttgctgcttttagtttgtctccttttctgtggttattgacaatcttactatgggttgcataggattgtttttgctttttatttatcctgcattgaatttctgaattttttgattgatatctttgatcagttttggaagatttgtggccattgtctgttctaatgttacttttgtctcattatcttcctccttttctcctggcacttcaattacatgtatgttagatctcctcaatatgcctgcacattcctagccctcttctgtattctcttcctcagtactt

SEQ ID NO: 21868 - DNA, 601 bp, Human
ctgtggttattgacaatcttactatgggttgcataggattgtttttgctttttatttatcctgcattgaatttctgaattttttgattgatatctttgatcagttttggaagatttgtggccattgtctgttctaatgttacttttgtctcattatcttcctccttttctcctggcacttcaattacatgtatgttagatctcctcaatatgcctgcacattcctagccctcttctgtattctcttcctcagtacttctgtttagttattttctgtggattgtcttccattttactaattmtgcctcttgctgtgtctactctctattttgttaatccatctaataaatttttaattttagagagtatattttgtagttttagaatttccagttgattttttcatagattcatttctctactgaaatttttctcttaccttctatttgtcatttttttatcttattttccctgttctcaaatatgattatagttgttttgatgttctaggaaattgtaatatctagattatctgtggggctgtttctgctctctttttcctctttcacttggactgtggtctggttttctgctgagtttaa

SEQ ID NO: 21869 - DNA, 601 bp, Human
atattttgtagttttagaatttccagttgattttttcatagattcatttctctactgaaatttttctcttaccttctatttgtcatttttttatcttattttccctgttctcaaatatgattatagttgttttgatgttctaggaaattgtaatatctagattatctgtggggctgtttctgctctctttttcctctttcacttggactgtggtctggttttctgctgagtttaataatttttgtttgaagtcaagactgtttgtatgtaaaactgtagaagcttcagatgatgtgatctycttccagagataattcatcctgccttcttctagacaaagtggggctgaccatcttattttaatcagagactgtgctcagtttcgaggctacactggacctttagtatgcctcagtctccatttactgtgcctctggctttctaggattttcatctgagagtcggctctgttacctggggactctctccctggcgttttccaaactgcgagtcattttctctgatgattggtgcaaattccactttgctttatagaggttttcgttttggtttttagtcttctatcccatacaggtctagg

SEQ ID NO: 21870 - DNA, 601 bp, Human
accaggtgttcttcatgccacttgcaagcagaagttcatgattccatcattttaattgtttggtacatcatttaagcaaaccccatttgaaaacccttatttacaaaacagatccactaggttgcaatttcccattttacacagaatttgttgctttacagtggaattcatttaaatatcagactacctctagggtaattaattatcacttagtttacaaaattttccattgtacacaagttttcaggtatcgtatatttttaattaggcagcaaactagtattagtaaacactgtattamtaaaacatctgagtcacaatattttaaaatgcaaatgtgttgctttttagtaacacagcaacttgaagtaactgctaataaataatttacaaacgagacttattttcaattagtaacatatattagcatacatgtaaccaatgcacaacttccttattacctatttattgaatatgtcccacctcttgaatacttttcagttaccactgatgttgaaatgaatgcgtttgtaaagcaccattactctggaataaaaaagcaactcttgtgatatcattttaaaggattagaagatcatgg

SEQ ID NO: 21871 - DNA, 601 bp, Human
ataatttacaaacgagacttattttcaattagtaacatatattagcatacatgtaaccaatgcacaacttccttattacctatttattgaatatgtcccacctcttgaatacttttcagttaccactgatgttgaaatgaatgcgtttgtaaagcaccattactctggaataaaaaagcaactcttgtgatatcattttaaaggattagaagatcatggtaaatttaggcaatggagtgtgttgttgattttcaatttgtgacataatgggtttaaaaacattggtagtggccgcctggckgctcacgcctgtaatcccagcactttgggaggccgaggcaagtggatcaccttaggtcaggagttcaagaccagcctggccaacatggtgtaacttcttccctactaaaatataaaaattagctgggcatggtggtggccacctgtaatcccacctacttgggaggttgaggcaggataattgcttgaacccaggaagcggtggttgcagtgagccgagatcatgccattgcactccagcctgggtgacaagagcaagactccattacaaaaataaataaataaaataaaaataaaaaca

SEQ ID NO: 21872 - DNA, 601 bp, Human
gtggccgcctggcggctcacgcctgtaatcccagcactttgggaggccgaggcaagtggatcaccttaggtcaggagttcaagaccagcctggccaacatggtgtaacttcttccctactaaaatataaaaattagctgggcatggtggtggccacctgtaatcccacctacttgggaggttgaggcaggataattgcttgaacccaggaagcggtggttgcagtgagccgagatcatgccattgcactccagcctgggtgacaagagcaagactccattacaaaaataaataaataaaayaaaaataaaaacactggtagaaaacacaactgcatcttaatagtgtaatttttgtggggtagaaataaagctgaatttccccatcctctttccctccttctcttcctcggccctttccaccctccctttctgtatattttctgtgtttttcagatttataagatgtagtatgttacaatgaaaaatgcagtgagtggtagcattaagggtcagcctctgtatgtggaggcacgctgccttggctgagtggtctgcatgagtctcactgccaagttaccttccttgcttcatagatgttga

SEQ ID NO: 21873 - DNA, 601 bp, Human
gatcatgccattgcactccagcctgggtgacaagagcaagactccattacaaaaataaataaataaaataaaaataaaaacactggtagaaaacacaactgcatcttaatagtgtaatttttgtggggtagaaataaagctgaatttccccatcctctttccctccttctcttcctcggccctttccaccctccctttctgtatattttctgtgtttttcagatttataagatgtagtatgttacaatgaaaaatgcagtgagtggtagcattaagggtcagcctctgtatgtggaggcaygctgccttggctgagtggtctgcatgagtctcactgccaagttaccttccttgcttcatagatgttgaggatgtggtctctcattctaacttgtcacccaagtgattcccttcatggctatagacatggattcaaaaaatgttgaggtgtttctgccaggcccccacagtttgtgtgtttctttgcagactgtatgaaaacaagggagaggctgacttcgtggaatctttgctgcagctcttcaggtccatcaatgacatgatgagcagcatgtcagaccagaccgtccgggtgaaggtg

SEQ ID NO: 21874 - DNA, 601 bp, Human
ttttaagaagattgtttacagtctaattggtatataatgtccatttggcattttgcatactttgaggtttgaatttcagtatgtggttgttggttttgctcttgttttcagcacctaaaaatcctgacataggagctttaatattcctgcgccggcttctgcttctgtaatagaggcaactcctctttgggaggggccctgagcctcaagcagaagactcagaagttactaagaaaataatttttagaaaaccccacaaacaaactttgagaaagctggtcactgggctttcagaccaagsagtgagattggacaccaaatccttccttttctctccctaacttgccgcctctcagtggccaggtgtgctgtttgtttcctaatctgttggtatcactgcattctgaaagtgccattgtgagcaaatgggatacacagcctttttaatttattttttaagagataggggtctcactctgttgcccaggctgtagtgcagtggcgcgatcatagctcactgcagcttcaaactcctggcctcaagcacccctcccgcctctgccttcaaagcactggaattaccgacgtgcgccaccgctcc

SEQ ID NO: 21875 - DNA, 601 bp, Human
atataatgtccatttggcattttgcatactttgaggtttgaatttcagtatgtggttgttggttttgctcttgttttcagcacctaaaaatcctgacataggagctttaatattcctgcgccggcttctgcttctgtaatagaggcaactcctctttgggaggggccctgagcctcaagcagaagactcagaagttactaagaaaataatttttagaaaaccccacaaacaaactttgagaaagctggtcactgggctttcagaccaaggagtgagattggacaccaaatccttccttttmtctccctaacttgccgcctctcagtggccaggtgtgctgtttgtttcctaatctgttggtatcactgcattctgaaagtgccattgtgagcaaatgggatacacagcctttttaatttattttttaagagataggggtctcactctgttgcccaggctgtagtgcagtggcgcgatcatagctcactgcagcttcaaactcctggcctcaagcacccctcccgcctctgccttcaaagcactggaattaccgacgtgcgccaccgctcccaccccagggatgcacagtcgtttaaacccc

SEQ ID NO: 21876 - DNA, 601 bp, Human
atttagtgtcctgcagggaaacatttattttctgctcccagggcaccaacagtgctggtcataagcttagcaggtcctacatgagaaaaggagaaacacacaggctcacgggcggtgtctgcccacctggcgcgctgtagagtcctctccttggcacatgcttctccaagagcgggccccaaaatggcagctccggtagcccttgggaacttgttagagaaagccaaactttggcttcctccccagaccttctgaattagaaactgcacagtggggcctggtcatttgattttaacaaccyccctccccgtgcaggtgcttccagggctctctcatattttagtagctcaggtcttgaaaaactgagaggaagcagagaaagctgcaactggtgtgggctgtggccatactctaggcctgtctcatggtgcacacagatcagctccgcacccgcggaggggtatcgtcgatactctcagtttgcgcttgagccgggcctgtcctcactgtacgcacaaattagcccctcaccgatggagggtatcattgacgctcacagtttgtggttgagccgtgtgcttggaggtcctaggaagacctg

SEQ ID NO: 21877 - DNA, 601 bp, Human
gacattttgaggaaatgcctaactgttttccaaagtggctgtgctgtgttaccttcccaccagcttggtgtgactgttctcatttcattatatctttaccaacacttgttattgtctgtcttttggattataggcacgttagtgattgtgaagtgaaaacgaacactttcaaaacatcatttcttggaatgagttattgaccccatagtgcatgagaggctgtgttgaacatactggtgacattaatgaccatgtgatgacctatatctcagtattgtaacaacattggatccttttgctrtgtgtctcaaaattatttcccttgtgtttttcctcacagcaaaatgtttactgaattcatcctcaatgttcccatgggcttgctgaccatccagaaactctactgcttgatcgaaatcgtccacagtgacctcttcacacagcatggtgagtggaaccccaagaattattcacttgtcctgttatttattttctgaagacattgaccctctgaattgcctcttcttgacaaaaggagtagaggctgcaaccaattaaaactgctgtattacaagacaggaagatttagcccttacaagag

SEQ ID NO: 21878 - DNA, 601 bp, Human
ttgaaagggcagacaagcttatagcaaacacgagttgcgtcttggtgggtttcacactgactggcaatgctgtgtcctgtgtagactgcagagagatcctgcttcccatgatgaccgatcagctcaagtaccatctggagagacaggaggacctggaggcctgctgtcagctgctcagccacatcctggaggtgctgtacaggaaggacgtggtgagtgttggctctgtgcgtgacgtcctgccatttgcctgaacctgccatttgccttgcagtacaactttattcagttaaaaatgaamggtcttgattttaaggtctagcctctctttttgtctcggtagagttgcacccttaaattatttttatttatgtatatatggtgattattacaacatttatccttttgcattgaaaattgttctttatttcctgtgtcttctcgacgaaatgtctctcaggacctaaattttcatccttaaggtcagacaaaaaggctttgatgcttaaagttggctaattatctgcattctttcttcttatttttattaaagtaatacatgcacaaagttaaaaataaataaataaataaagccaggcat

SEQ ID NO: 21879 - DNA, 601 bp, Human
tttttatttatgtatatatggtgattattacaacatttatccttttgcattgaaaattgttctttatttcctgtgtcttctcgacgaaatgtctctcaggacctaaattttcatccttaaggtcagacaaaaaggctttgatgcttaaagttggctaattatctgcattctttcttcttatttttattaaagtaatacatgcacaaagttaaaaataaataaataaataaagccaggcatgctgagggagtcgtaaggagaagagcagctcttttcctcccctcaggctctcttcccctargtcagtgctttgcttttgtagctctaccctattcctttttttttttttcttttttcttttgagacagagtcttacactgtcgcccaggctagagtgcagtggcacaatctcagctcatggcaacctctgcctcccgggttcaagtgattctcctgcctcagcttcccaagtagctgggattataggtgcctgccaccatgcccagctaatttttttgtatttttagtacagacggggtttcactatgttggccaggctggtctcaaactcctgacttcgtgatccacttgccttggcctc

SEQ ID NO: 21880 - DNA, 601 bp, Human
agcctgtctctagaaaatgaaagaaaaaataaaaagcaagtttgtgccagcacatatggaaaagtctgaccctgtgcctttcactcccaacataccattcctgttggagcacacacatgatgctattgatcttccaggtgtgcctggaaaggtgaaagcagggctttgtctgtccttgcccctagccctggacagagtggccaggatttctaagtagataaggcttgtccctggccgtttcctgcgtgaccttgaaaatccctcctagtcaccacgcccatatacctggccacccactccsctgtagccctggctcattctctcagagcctgattagtgatctggaagaaaaagatcggattaaatctgttcttggtgatgctggaaacctcacctcttacaggggcattgcctttggagaggtcttggaggccttcacccaaaggccagcctccagtggtcccacttcaggctcttccctgtttttattggagaaaagcttggggtaagagcttgtatggccaaagctcacagaggaggtggtgatgctgggaagggcctagagcatgtgtttaagcagattcatagttcacgaagaaga

SEQ ID NO: 21881 - DNA, 601 bp, Human
actgaatgccacagcagtgtgaattttagatagtttgctaaatgctgtttaaacattctatcctgtgtgactgtttaagttatttgcatttgacgtgcagaaccatctaggactgttatctgcctgccttccatttacagatggccaaatatctttagaaaactaattggtgggctaatcagggatcataaacattatattgtttaaacagattttcttttatttttaaggtttgcttaaattaaattactatgattatatatgtaacaaattatcattaatggactataattaataaaawcccctgagtttttttgtgagagcttttgcctttgacaagggccatttttcatctcattaagggttataattgatttactctttacagggtaaatggattcaatgacaaccactggggcttgcatgttaatgtttctctggtgttggtgttcattggtgtgtccttccccaggggccaacccagaggcacgtccagattatcatggagaaacttctccggaccgtgaaccgaaccgtcatttccatgggacgggattctgaactcattgtaagtgcttggtgacatatgtttggatattta

SEQ ID NO: 21882 - DNA, 601 bp, Human
attccttcctaaccctttgctgcctctcactgcccctctgcagggataacttttaactcattgttctgaattctttgtcacgctttcagcatttatatgggcctgtgtgtgttttttttcagcctttaacatgaactggatcataccctgtgtttttcagctctgtcatattccacgatatgaatgtaccaacatttattcagccatttctgcactgataacctagaggctgtttccaggtgtttacaatcacaggctgtgctaccgtgagggctgtgatacatgtgtctcttagtacacrcattgctatggaaaaggttgatctctaggccaaatgatatgacattttaagtttgatggaaaatgatcaatttccttcctaacatgattttagcaatttgccaccccaccaaccttgagagcagccactttctatctagaatcttcttcaacactgatttaaaatgattgatttttgtttttattgtcatttttctgatgattatttaggctaagaatacttagtggccatgtgggtttctgctgtgaattctctgatcatttcttctcctaacattcgtatttggctgtcttttttata

SEQ ID NO: 21883 - DNA, 601 bp, Human
ttggctgtttttgtgcatttcctgttccatttggagtttaaaatcagatagctgagtttctcttttaaaaacatactgcttggattttagctggaatcccattgaattgataaataaatttggagtaagtttatggtatttgagggaatactttgcagtatttttttccccatctcatactagactatttaagtatttgttttgccatttttctggtttttttctaggtcaggtctcacacatgacttgctgggtagattcccgtgtgttttagttgtggctgctctggtgggggagcctktttctcaacatgttggttctccctggctttcgtcctgtttcatgaggatggccccttggactctcaccgtgagcccgcacaccttacaagccacgtgcttcagggcccacatcgagcgtcgccccttggcaggtgtgacacacatatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtg

SEQ ID NO: 21884 - DNA, 601 bp, Human
tgcttggattttagctggaatcccattgaattgataaataaatttggagtaagtttatggtatttgagggaatactttgcagtatttttttccccatctcatactagactatttaagtatttgttttgccatttttctggtttttttctaggtcaggtctcacacatgacttgctgggtagattcccgtgtgttttagttgtggctgctctggtgggggagcctgtttctcaacatgttggttctccctggctttcgtcctgtttcatgaggatggccccttggactctcaccgtgagccygcacaccttacaagccacgtgcttcagggcccacatcgagcgtcgccccttggcaggtgtgacacacatatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtgctctggctcaaaggcagccctggtcctatgtaggaaaagaaagaattaggagttggtgaagctgtcatttaaaaag

SEQ ID NO: 21885 - DNA, 601 bp, Human
agggcccacatcgagcgtcgccccttggcaggtgtgacacacatatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtgctctggctcaaaggcagccctggtcctatgtaggaaaagaaagaattaggagttggtgaagctgtcatttaaaaagaagcattcgtgttttgttgttgttgctgctgctgttgctgttgctgttgttgttgctgctgctgctgctgctgttgttgttaaagggagcaggtagaaatgaagatctattgtgagtcctcgcaggcatgggtcctattctggctgagcccctgaccatgattctcagaatacaggtggctgcagccagtgattcctgccggtgctgtggcaaggctgaaatcggtgggaggtgtcagtcccaaaaacaaaaggaacgacttgtattttattgactggcactcccctttctttataaagggggctaaaaaaaagagagccccattg

SEQ ID NO: 21886 - DNA, 601 bp, Human
gtgacacacatatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtgctctggctcaaaggcagccctggtcctatgtaggaaaagaaagaattaggagttggtgaagctgtcatttaaaaagaagcattcgtgttttgttgttgttgctgctgctgttgctgttgctgttgttgttgctgctgctgctgctgctgttgttgttaaagggagcaggtagaaatgaagatctattgtgagtcctcgcaggcatgggtcctattctggctgagcccctgaccatgattctcagaatacaggtggctgcagccagtgattcctgccggtgctgtggcaaggctgaaatcggtgggaggtgtcagtcccaaaaacaaaaggaacgacttgtattttattgactggcactcccctttctttataaagggggctaaaaaaaagagagccccattgtgggctctgaggttgggggtgcctggctcagac

SEQ ID NO: 21887 - DNA, 601 bp, Human
atatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtgctctggctcaaaggcagccctggtcctatgtaggaaaagaaagaattaggagttggtgaagctgtcatttaaaaagaagcattcgtgttttgttgttgttgctgctgctgttgctgttgctgttgttgttgctgctgctgctgctgctgttgttgttaaagggagcaggtagaaatgaagatctattgtgagtcctcgcaggcatgggtcctattctggctgagcccctgaccatgattctcagaatacaggtggctgcagccagtgattcctgccggtgctgtggcaaggctgaaatcggtgggaggtgtcagtcccaaaaacaaaaggaacgacttgtattttattgactggcactcccctttctttataaagggggctaaaaaaaagagagccccattgtgggctctgaggttgggggtgcctggctcagacccccattct

SEQ ID NO: 21888 - DNA, 601 bp, Human
tagaaagtgtgctgttcatgggaagtgttggataaatgcaagcccaacagacttttctcaaatcctacaaatgctcttaaatttccccttacttctcaggtaattaaaaatagagtcaatataatgttcacactttatttttatagaactctttgcagctatctcctttgatataatacatattatccctggtttgtaaatgagaaaactgagacctacaactttcttcttctaaaggccgttgtcttttaaaccgcatatatgtagtccataaacccttgaaatatgggtttattgaaasaagaaatgtttgatctctttacatttgttttccttgtctagtgtatgtgtgatttgggggtaaagagtcctaaattatggaaatctatactattcttaagtgaggagcttcataattacattaataaaagttaacattggccaggcatggtggctcacacttgtaatcccagcactttgggaggctgagggaggtggatcacttgaggtcaggagttcaagaccagcctggccaacatggtgaaaccccatctctactaaaaatacaaaaattatccaggcatggtggtgcacacctgta

SEQ ID NO: 21889 - DNA, 601 bp, Human
cccatctctactaaaaatacaaaaattatccaggcatggtggtgcacacctgtagtcccagctactcaggaggctgaggcaggagaattgcttgaacccagaaggcagaggttgcagtgagccaagatcatgccactgcattccagcctgggcaacagagggagactccatctcaataaaaaagagctaacattgatgaagtgcttacacatgctctgtaccgccttaaattctgtgcatatatttacttctttgatcttctgagcactcctataagatagatactcttgaaattcacatyttatccatgaggaaactgaggcagagagaggttagagtctgagtaaatggcagacccgggatttgaatatgtgcaccgtgacctctgagcccacacgctaaggcctgaattacaccgtgggtggctggttagcaacatgtatagagtgagtgtgggttttttttttaacttttcagaagtgtgtgctgagcaaatgataaatgtctgagagcattgttgagatcctatatcaagctgttcaacaacttagcatctcctcctttttggttttcagctgtggaacaactactttcacctggc

SEQ ID NO: 21890 - DNA, 601 bp, Human
atattcagttttacagactctgccttctaaagggttaattcccctcctcaaaaccagatctacctggtggcagcctaacatgctcctgcactcaaagcagtgaagggtctgtgtgtgtatatgaaattaataggagtttatttgtaaattaagtaattttttccaactacttttatcatgaacagtaagaataaattctctattaaaattttaaccaatgtgacatgtaattcttatagataagccccttcaagaaatcaatgactgacaataacttggtatcttcccagcatctttacastaccctctaggaatctggcctcactcctcgttgagatgaagctctctctggctcctgccgtcagccctcgggcttgctttgtgccgaggtgtcctaggccatggggtgctggtggccttgcctcagtcctgagcaaagcatcagttgcttttctgccccaggatctccaggcctctgcttccttccttcaaatggacacgagaagcctgcattggcctgttgcaagaaaccctccactctcccctctacctcagagaatcttttcctactagaaggaggcaggggtctgtccgcatcact

SEQ ID NO: 21891 - DNA, 601 bp, Human
accagatctacctggtggcagcctaacatgctcctgcactcaaagcagtgaagggtctgtgtgtgtatatgaaattaataggagtttatttgtaaattaagtaattttttccaactacttttatcatgaacagtaagaataaattctctattaaaattttaaccaatgtgacatgtaattcttatagataagccccttcaagaaatcaatgactgacaataacttggtatcttcccagcatctttacactaccctctaggaatctggcctcactcctcgttgagatgaagctctctctggytcctgccgtcagccctcgggcttgctttgtgccgaggtgtcctaggccatggggtgctggtggccttgcctcagtcctgagcaaagcatcagttgcttttctgccccaggatctccaggcctctgcttccttccttcaaatggacacgagaagcctgcattggcctgttgcaagaaaccctccactctcccctctacctcagagaatcttttcctactagaaggaggcaggggtctgtccgcatcactctgttagcctcgtagcattagggtttcacttgttgcaccagggttgggacaa

SEQ ID NO: 21892 - DNA, 601 bp, Human
tacctggtggcagcctaacatgctcctgcactcaaagcagtgaagggtctgtgtgtgtatatgaaattaataggagtttatttgtaaattaagtaattttttccaactacttttatcatgaacagtaagaataaattctctattaaaattttaaccaatgtgacatgtaattcttatagataagccccttcaagaaatcaatgactgacaataacttggtatcttcccagcatctttacactaccctctaggaatctggcctcactcctcgttgagatgaagctctctctggctcctgccstcagccctcgggcttgctttgtgccgaggtgtcctaggccatggggtgctggtggccttgcctcagtcctgagcaaagcatcagttgcttttctgccccaggatctccaggcctctgcttccttccttcaaatggacacgagaagcctgcattggcctgttgcaagaaaccctccactctcccctctacctcagagaatcttttcctactagaaggaggcaggggtctgtccgcatcactctgttagcctcgtagcattagggtttcacttgttgcaccagggttgggacaacttagctg

SEQ ID NO: 21893 - DNA, 601 bp, Human
acatatatatacgatgatctcagtaataacgtgctaaggcttttagaacagggaggaggaccatccgtgattcattccaattgatctctctgtgttctttgttaaaatcctgctctgacagatgcatctgtcatttgctctgttaggccagacggcaggccccacaccaggcagggacccagtgtggtcccatgagagagagagagaggcaggagacgggggagggctttcacagcaatggcatggaggggggctgttctctgttggaactcagtgagtccaggacttttataggcaccarcgttcatgaaggaggtgatatgagctccacctgccacagttgggctctcagggcagaccccagacctcttctctggacacaggctctctctgaggccatcttttaccctggcccctcctaaaagagtgagtccattttcttctgtgttgttccatttcaactctaaagtatagacagggaattgcctatttcccccaagaggacacttgcacatatactttcaaatgaaggttctcattctggaatggctcggtaacatttcacatcatttatgataattagagacaccaccctagcgga

SEQ ID NO: 21894 - DNA, 601 bp, Human
tttttagccaggaacactgactgtggcctgagaagcggccaagaggtcaaaagtaaaccaaagccaattagggtcagggacttggaaacaacaagaagtaacagtcagccaccagacttgggttccttgctggtaaaataagttatctttcaaagtgagggaggtgatcttaaaagcacctgcagcccacaggatcctccccaagcagcccctcaggatggctaaggatagcaccacggggtggcctccttcctgccatggtgccaggtgcctgagtgtctttgccaaggctgtcacactccaaatttatgacagcacatctcagtttcccaggatgtatacaacctactttctacatagtttttttttttttattttaattttactttttgtaaatgggtgcaggtttgggaacatattggcaggatgatagcaccgactctgccaagaaaatagaaatggaaatcagatctatttatctgcttacaattaataaactgtcacttgagcagaccttcagctgaatgctccatgagtctcctccttcagtctttccaatagtatgcatggcccatagagaggagcatctcagctcttgcct

SEQ ID NO: 21895 - DNA, 601 bp, Human
tgcttatttacccagctcctgagttatttatcaaagcgcactctgtgcagcagcctgccggagcacctgatctccttgcctgtgccgcctcaatttacattttgtttattacatccagcacactggagcgagcactagaccccagccagccagaacgaatgtgcttggagcaagatctttatccaccgcgttgggtttgggatatttttcatgcagggattcccttcatgggtgttttttggcgactgggcaaattgtgtgcttttcattaaaacccgtatacattgtggcctaatgggtktggccaggtggtggaagcttttgctctgcctgctcttgtgtatacagagatttttctgggataagtctatgtttaatgtcccagatttttgaacaccagtgattgcaaagagataatttaaacacccacagggaggcttctgactagggaggccttggcttcgtgagaaaacaagatgttgttcccaggggaaagagctccacgttctgtaactaaaatagactctagatgggctatgagaccggcaaggactggaagtaaaatattctcctcgtcaccttcctttggctcaaaagtgtg

SEQ ID NO: 21896 - DNA, 601 bp, Human
tctttttctttaagtctacactgcaggagtcaccttggtcctcattggttccaaacctgagttcatcattaaatttgagcaagatatgctccaggggaaatctataatgcaaatgtcaaaaaaaaaaaaggtggctaccagagaacattccccacccactcctgctcaccttggggaccactggtttacgaagagtcagtgcccagggctgtcactatccatagaacccagtaccagctccaggccagtgtgtcttctgtactaataaggagggtgataataaaaggttaagctactgtcrttttggtagcttctttttccaatccctgcttctacaaccacttgtgactgctttctatgtttttcccagcttggaacaataaaacctgttggtgacagacagaactttatgacgctgaaattgtggttgatgaacaactcgctgtcaccatcatctgttttctgaaacattggctctgacattttttaggcataatacaaggaaagtgtcacctgagagatggaatataatagcattttcaagagaatgctttgcagcagttacaggcctttcagaaacattaagcatttgggaaagtgg

SEQ ID NO: 21897 - DNA, 601 bp, Human
taatagcattttcaagagaatgctttgcagcagttacaggcctttcagaaacattaagcatttgggaaagtggtgagaatcacacaatgatagccttagtcaaaatattaattatttagtaaaagttgaaaataagatgttaattacattttgtgtgtatgtccacccaataaaaagtaattcagtctaattatgaggattacgtattctcttaagtatcgttatagtagccacatttctttaatgattctctttacagaaatgtatattcactgagttgcaaagaaaactaaagaatttrgtttcctgattgtgtagaaatattaataagattggttaattcgggatacattgctggtgttaaaatactgcacatattttattcaaacatttaatttctcaggcattcttctgttatatgttggaaatgaaatggttttagttgcagtggggtgaaatgaaaacaaaatcaagatttctgaaagacaagagggtcagcttttaaaagatcacctttttgataggacctgcctctgagtttcattatgtcaccttaactaaggttcgcagccccatttttagaaaggagtcttccaggagc

SEQ ID NO: 21898 - DNA, 601 bp, Human
aaaatattaattatttagtaaaagttgaaaataagatgttaattacattttgtgtgtatgtccacccaataaaaagtaattcagtctaattatgaggattacgtattctcttaagtatcgttatagtagccacatttctttaatgattctctttacagaaatgtatattcactgagttgcaaagaaaactaaagaatttggtttcctgattgtgtagaaatattaataagattggttaattcgggatacattgctggtgttaaaatactgcacatattttattcaaacatttaatttctcrggcattcttctgttatatgttggaaatgaaatggttttagttgcagtggggtgaaatgaaaacaaaatcaagatttctgaaagacaagagggtcagcttttaaaagatcacctttttgataggacctgcctctgagtttcattatgtcaccttaactaaggttcgcagccccatttttagaaaggagtcttccaggagcttcattccagaggtgcagtgtccaggcagtgaaagaagcttggcagttgctgtggtttcctccctctcccatctctctgaacttgcctggttcacttcaag

SEQ ID NO: 21899 - DNA, 601 bp, Human
gtaaaagttgaaaataagatgttaattacattttgtgtgtatgtccacccaataaaaagtaattcagtctaattatgaggattacgtattctcttaagtatcgttatagtagccacatttctttaatgattctctttacagaaatgtatattcactgagttgcaaagaaaactaaagaatttggtttcctgattgtgtagaaatattaataagattggttaattcgggatacattgctggtgttaaaatactgcacatattttattcaaacatttaatttctcaggcattcttctgttatrtgttggaaatgaaatggttttagttgcagtggggtgaaatgaaaacaaaatcaagatttctgaaagacaagagggtcagcttttaaaagatcacctttttgataggacctgcctctgagtttcattatgtcaccttaactaaggttcgcagccccatttttagaaaggagtcttccaggagcttcattccagaggtgcagtgtccaggcagtgaaagaagcttggcagttgctgtggtttcctccctctcccatctctctgaacttgcctggttcacttcaagctctttaggagctcacc

SEQ ID NO: 21900 - DNA, 601 bp, Human
agagagtcgggtagggtccgagtgccatgcaaagatcctgagacaagcaaacagggaaggaatttgtaaaatgagggtcacagctaagccttcataatctcagacccaggttcaaatcctgcttctccacttctctgaacagctcacagaacagctttgggtacagcccactttcctcgtctgtttaacaggttaagaaggtaaccatctcgtaaggttaccgtgaaaattcagtgagatgatgctttatcttgagcttgtcatgtaaattgtaaatgctaactaatatgatcatattcaktattattcacatttgaaaaacttttgagaaacatttttctgagttctttaaaaatcatatctggaacaagataggtgaaatgagattaataaagtagttctttttttttttttttttttttttttgagacagagtcttgctctgtcgcccaggctggagtgcactggcgtgatcttggctcactgcgacctcttcctcccaggttcacgccattctcctgcctcagcctcccaggtagctgggactacaggcgcccgctaccacgcccagctgatttttttgtatttttagtagagacgg

SEQ ID NO: 21901 - DNA, 601 bp, Human
aacttttgagaaacatttttctgagttctttaaaaatcatatctggaacaagataggtgaaatgagattaataaagtagttctttttttttttttttttttttttttgagacagagtcttgctctgtcgcccaggctggagtgcactggcgtgatcttggctcactgcgacctcttcctcccaggttcacgccattctcctgcctcagcctcccaggtagctgggactacaggcgcccgctaccacgcccagctgatttttttgtatttttagtagagacggtgtctcaccgtgttagccrggatggtctcgatctcctgacctcgtgatctgcccgccttggcctcccaaagtgctgggattacaggcgtgagccaccacacccggcctaaagtagttatttaaataagcattttcctatcaaacaatagctcaaaaaggtagaatcactgctgtttttagggtttcagcctcagattccggcgccttgatttactttgattggagtcgtttggcatgttgcagaaatcaccctgcattatttacagaggtgtcagatggcaaactcatcttcataagatgtgggaaataaagaggaccc

SEQ ID NO: 21902 - DNA, 601 bp, Human
gctggagtgcactggcgtgatcttggctcactgcgacctcttcctcccaggttcacgccattctcctgcctcagcctcccaggtagctgggactacaggcgcccgctaccacgcccagctgatttttttgtatttttagtagagacggtgtctcaccgtgttagccaggatggtctcgatctcctgacctcgtgatctgcccgccttggcctcccaaagtgctgggattacaggcgtgagccaccacacccggcctaaagtagttatttaaataagcattttcctatcaaacaatagctcraaaaggtagaatcactgctgtttttagggtttcagcctcagattccggcgccttgatttactttgattggagtcgtttggcatgttgcagaaatcaccctgcattatttacagaggtgtcagatggcaaactcatcttcataagatgtgggaaataaagaggacccaagagactatctgctctctctcatttgtcggctcctgttcctgtcgctgtgcacagagttagaggctgagacccccgactcgcagcccctgctctattcagaattgggaattagctgcatgtgttctgaatctg

SEQ ID NO: 21903 - DNA, 601 bp, Human
ttttgtatttttagtagagacggtgtctcaccgtgttagccaggatggtctcgatctcctgacctcgtgatctgcccgccttggcctcccaaagtgctgggattacaggcgtgagccaccacacccggcctaaagtagttatttaaataagcattttcctatcaaacaatagctcaaaaaggtagaatcactgctgtttttagggtttcagcctcagattccggcgccttgatttactttgattggagtcgtttggcatgttgcagaaatcaccctgcattatttacagaggtgtcagatrgcaaactcatcttcataagatgtgggaaataaagaggacccaagagactatctgctctctctcatttgtcggctcctgttcctgtcgctgtgcacagagttagaggctgagacccccgactcgcagcccctgctctattcagaattgggaattagctgcatgtgttctgaatctgtgtgatggaactggctacttataaaacagtgttcatcttctctgacagagaagtcatgattacaggcttataccgcgcggatctttgaagagcttcacttataacatgtggaatacaggccactt

SEQ ID NO: 21904 - DNA, 601 bp, Human
caccgtgttagccaggatggtctcgatctcctgacctcgtgatctgcccgccttggcctcccaaagtgctgggattacaggcgtgagccaccacacccggcctaaagtagttatttaaataagcattttcctatcaaacaatagctcaaaaaggtagaatcactgctgtttttagggtttcagcctcagattccggcgccttgatttactttgattggagtcgtttggcatgttgcagaaatcaccctgcattatttacagaggtgtcagatggcaaactcatcttcataagatgtgggarataaagaggacccaagagactatctgctctctctcatttgtcggctcctgttcctgtcgctgtgcacagagttagaggctgagacccccgactcgcagcccctgctctattcagaattgggaattagctgcatgtgttctgaatctgtgtgatggaactggctacttataaaacagtgttcatcttctctgacagagaagtcatgattacaggcttataccgcgcggatctttgaagagcttcacttataacatgtggaatacaggccacttcttatactaatggctgggaaagttcaaa

SEQ ID NO: 21905 - DNA, 601 bp, Human
caggatggtctcgatctcctgacctcgtgatctgcccgccttggcctcccaaagtgctgggattacaggcgtgagccaccacacccggcctaaagtagttatttaaataagcattttcctatcaaacaatagctcaaaaaggtagaatcactgctgtttttagggtttcagcctcagattccggcgccttgatttactttgattggagtcgtttggcatgttgcagaaatcaccctgcattatttacagaggtgtcagatggcaaactcatcttcataagatgtgggaaataaagaggacycaagagactatctgctctctctcatttgtcggctcctgttcctgtcgctgtgcacagagttagaggctgagacccccgactcgcagcccctgctctattcagaattgggaattagctgcatgtgttctgaatctgtgtgatggaactggctacttataaaacagtgttcatcttctctgacagagaagtcatgattacaggcttataccgcgcggatctttgaagagcttcacttataacatgtggaatacaggccacttcttatactaatggctgggaaagttcaaaatcatcatctgc

SEQ ID NO: 21906 - DNA, 601 bp, Human
tggcatgttgcagaaatcaccctgcattatttacagaggtgtcagatggcaaactcatcttcataagatgtgggaaataaagaggacccaagagactatctgctctctctcatttgtcggctcctgttcctgtcgctgtgcacagagttagaggctgagacccccgactcgcagcccctgctctattcagaattgggaattagctgcatgtgttctgaatctgtgtgatggaactggctacttataaaacagtgttcatcttctctgacagagaagtcatgattacaggcttataccgcgyggatctttgaagagcttcacttataacatgtggaatacaggccacttcttatactaatggctgggaaagttcaaaatcatcatctgcagacgcgaaatggatgcacattttcgggatcctgctgctcaaagtcacagtgatctgtgttgtgttgttttatccatttaagcccattttagaattctatttttctttatttctgaatattgtacctcttttttccaaggtcaacacaagataaagttcattccagaaatggtgggcccaatattagaaatgacattaattcccgagacggag

SEQ ID NO: 21907 - DNA, 601 bp, Human
ttctgaatctgtgtgatggaactggctacttataaaacagtgttcatcttctctgacagagaagtcatgattacaggcttataccgcgcggatctttgaagagcttcacttataacatgtggaatacaggccacttcttatactaatggctgggaaagttcaaaatcatcatctgcagacgcgaaatggatgcacattttcgggatcctgctgctcaaagtcacagtgatctgtgttgtgttgttttatccatttaagcccattttagaattctatttttctttatttctgaatattgtayctcttttttccaaggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatggtaaggacgtagatgtgcagcgagtggccgggggacatgagggaggcaaacctgaaaaccttcaaagaaacctgtagacagttctagagttaaaggtgccaacgtggaaaacacattttcctacagcttgagagaga

SEQ ID NO: 21908 - DNA, 601 bp, Human
atggctgggaaagttcaaaatcatcatctgcagacgcgaaatggatgcacattttcgggatcctgctgctcaaagtcacagtgatctgtgttgtgttgttttatccatttaagcccattttagaattctatttttctttatttctgaatattgtacctcttttttccaaggtcaacacaagataaagttcattccagaaatggtgggcccaatattagaaatgacattaattcccgagacggagctgcgcaaagccaccatccccatcttctttgatatgatgcagtgtgaattccattcracccgaagcttccaaatggtaaggacgtagatgtgcagcgagtggccgggggacatgagggaggcaaacctgaaaaccttcaaagaaacctgtagacagttctagagttaaaggtgccaacgtggaaaacacattttcctacagcttgagagagaaaaagcctatgattttccttattgaagaagcttatcatcccttgcactcaatttttgggaggattattctcaatttttagctcttacttacttcttttaatctgggtttacttacacattgcaccctggataaaagtctcttgct

SEQ ID NO: 21909 - DNA, 601 bp, Human
tggcctcaaaggtagagcaataccccagtccttagaacctgtgaatgagaccttatttggaaacaagaggccctgcaaatataattaaaaagaatctcagatgggattatcctggattacctgcaaggggaggggagaggtactaactccaatgacaggtgtcctcataagagacaaaagagaagacacagaaacaggctagaccttgtgaagatggaggcagagattggagggacccagtctcaagccaaggaatgcctggagccaccagaagcctgcggaggccaggaaggatcccccsctagagctttctaggggaacgttgtcctactcacaccttgatttcagattctggcctctggaactgtgagaagaaacatatctgttgttttaggtttatggtaatttgttacagcagccacaggaaaccagatctgggcaccatggagaacagacgcctgggcgaccttggctgctgccatctgtctgccttttgcattcctgctgttgccctgatacagctgggttctgtggacacccccttcctgatgtcattgtggtccctaatccaggaaatccattagtaccaatgagcttttgg

SEQ ID NO: 21910 - DNA, 601 bp, Human
gattccttttacccagtccatcatattcactttcaacgcattagtacaatgcacgctaaagacaaaaacacagtgaaggggcagagcaggcattagaaccagactctgatacggcagaggttttgaaatcatcagacctgcaatttaaaacagctgtgatgaatatcctaagggctctaatgggaaaagtagataaaacataaaagaaggtgggtaaactacgtagaaactcacagaaatcatcaagaagaaattctggaaatctaaaacactgtaacagtgtgaagaatgcctctgatgrtctcatcaatcaactggacacagaatctgtggacttgaaaaatctgaatgtttgcagatgcatcatgtgtcttaggctactgtagaaattactggtctctgatgtctggccctgaggtctgggctgtggctgtgtttgtctttatattcacctggagactgaccaagtggtacagcagcaagctctgccccaggtcagttggtctgatcttacagacagaaaagaacctggcgcttacttcactgtcttcttgcattctgaccaacgttcaaagtaatttgttgtcatggtgccaatgtg

SEQ ID NO: 21911 - DNA, 601 bp, Human
gaaggaagaattatcaataagtttattagtcttccaactttgatgattgagacttttatttgttttaagcaagatctcttatgctcaccaggacatgaaacagtggagaaatggtggtgtgctctgaatatgggctcttactacctgaatctagggtcaggaaacaaactcttgtaataaaacctacaatcacggtttctaatgtgaacctgtgttcctctttaattcagagccagactcagtgcccacgtacttttactgtggtcagcacttgctcagttttaactaagaaacacacccwgggttctcaaggttatctgacattattaactttcttcaaatgggaacgtcctgaatcatttgatgaaaaatcaaatgttctgctcttaaccatttcctggggatgataaaatggatcccaactgtcacagttttttcatttagaaaataaatctgtggaataaagggaaacaagaaaccagagttttaaagataggtagataggtgtcctaaccatagatactcactgcccagctcaatttcctggtcagtttttcccttttctcctggtacttttattacagaaacagagtgtaataga

SEQ ID NO: 21912 - DNA, 601 bp, Human
ttgcccttaaaaaaacaaaaataggtccgggtgtggtggctcacgcctgttgcactttgggaggccaaggagggaggatcacttgaggtcaggagtttgataccagcctggccaacatggtaaaaccccatctctactaaaaatacaaaaattagctgggcatggtgttgggtgcctgtaatcccaggtactcgggaggctgaggcaacagaatagcttgaactcgggaggcggaggttgcagtgagcctagatcacaccactgcactccagcctgggcaacagaggtagactctgtctcaaaaaaaaaaaaaaaaaagaagaaagaaaatgaaaaagtaagagacgcagcagtcactctgcttggccacctaagtccccaggacatctcctgcaaggatgtctgcatgtatgttggaacttggatgtatatttgtaattctttaactagaatttcactgacagctcataatcgagcatctttaattattggtcactaatgttgctgagtgtcacttagtgcttctgtgcagtcatccacacgtcccatctctgtgactggtaggcgcatcattactttgcacatgccagttacttctctt

SEQ ID NO: 21913 - DNA, 601 bp, Human
agctcataatcgagcatctttaattattggtcactaatgttgctgagtgtcacttagtgcttctgtgcagtcatccacacgtcccatctctgtgactggtaggcgcatcattactttgcacatgccagttacttctcttcatagccccttggcaaggctaattaaatgcagagtggggtccagtatttttaaaatcttggtatctgttttagtccaaaatggaaatataatgcagatgtctgcgttctaaaagatcaatgcctagcggtggattggagttggggggccggtcccaatgggkttcctctgggagctgagctgcaagcttggcacagatgtcagtcagcgctggtgtggggggacttgagagacaaggctgcccgcggagcccaggaggagtgggagcaccgcgtgaacctttacgtaagaaacacaaaggttttatatagaaattgggattggagatgagtgtacttcggttgtggagaggttttgaagtcctaggaagggaacaggactcagcacaggcagaaaatagaagacatttcgtatctccgagagaggaatgaaggtcgcatgatattcccgttgtgaaattgta

SEQ ID NO: 21914 - DNA, 601 bp, Human
atcttgaatttttattgtgcatgtgataccttttgtggaacagatttcttaaaacagtattatggtttaacttttcagaatttctacaaagaaattgaaagagaagaaatgtatataaggtatgtatgcatcacgcttgtctgcatgttaattataaataataatatatgttgtatgtttacgtatgctaagaaatgtgttatagccgcaaaggtttattttgtagaaaattgtgaaacgtataaggtagagtttggtggagctcccagatacattctcagctcttgcatagcttgtccasaccagtgcagagttcttggtggtcaccattagccaactcaaaagcaaaactacaaataattgtttcacagcgttttgtacctgttgaccaactcatgtggcccttttgcaaaaagataagcacataaattttaatgtttcacagtaagttatatgatccagtgagaaatccagttataactttaccagacataggggagttataatttttcagtctgctcttagttaactgacgccatagtcccgtgttttttatgtctttcttccatgaagaagagaaacattttgcattgcctgctgg

SEQ ID NO: 21915 - DNA, 601 bp, Human
attgtttcacagcgttttgtacctgttgaccaactcatgtggcccttttgcaaaaagataagcacataaattttaatgtttcacagtaagttatatgatccagtgagaaatccagttataactttaccagacataggggagttataatttttcagtctgctcttagttaactgacgccatagtcccgtgttttttatgtctttcttccatgaagaagagaaacattttgcattgcctgctggattttgcttccctactcgccttgctccctggagtgagggactgtgattgagcccttctstcttggttacttctaaagtctcgtgtcaaataattagcaagattaccactctggagactaggagaaggatgtaacctacacagcatgagtttttagtgatgtgtttattacactgagggtgattgtctaattttctatttctaagattgtttttacttctcctttttaagaacatactatgtgaatttaataactcagttacctttatttctttatggcaaagaaattctttcgatcacattgactgtaatcattggagctctttattctgatggatttgtatttttacggatttttttg

SEQ ID NO: 21916 - DNA, 601 bp, Human
ttacctttatttctttatggcaaagaaattctttcgatcacattgactgtaatcattggagctctttattctgatggatttgtatttttacggatttttttgtgcatttggactcagtagaaatgcagaaaatcacaatcaagtattgtgtgtctcattaaaaatgtttaagggaaaatgaaaaggaatgaaaaatttgaaggaaaattctacctttgtgtatcatctttatttttttcctgagtttttcttagtgctttctgtaccaaaagtttttaaggcattttgaattatgaacatygtaaaaaggaagtgtagccatgatttactgttgaacatagaatttagctcttgcaatcctcaacacaaattatttagtgacattttaagaacatacctctgttttattgtctcaggtatttgtacaagctctgtgacctgcacaaggagtgtgataactacaccgaagcggcttacaccttgcttctccatgcaaagcttcttaaggtaatgtcaattaccagtcaccttgatgattctattgttataaattctaacaatattcagaattgtatttttccatggcaaattttagtaggcc

SEQ ID NO: 21917 - DNA, 601 bp, Human
tgtagccatgatttactgttgaacatagaatttagctcttgcaatcctcaacacaaattatttagtgacattttaagaacatacctctgttttattgtctcaggtatttgtacaagctctgtgacctgcacaaggagtgtgataactacaccgaagcggcttacaccttgcttctccatgcaaagcttcttaaggtaatgtcaattaccagtcaccttgatgattctattgttataaattctaacaatattcagaattgtatttttccatggcaaattttagtaggcctataacttaaggktttatgaaattgactaaataaatgcaaggatatgaacaaaaatatttaggaagtactttgattagagatttgtccctgctgaatgcagatttaattagatgtcatagcaggtgatcactgagcattataaactcccatcacttggctgtgagctgacagcaagttagagattctacaattccttgttcaggactacaggactccaggatggtggagaacaatatcaagaaggaattttcctggtagaacagctaagagataggatgagacatacccctaattgtcttagtaaagagttag

SEQ ID NO: 21918 - DNA, 601 bp, Human
tctccatgtggaagtggaaggtagagaggatttttgcttccctagtccatgttttcatttgcaaaagtgatttaaaaatgcaaggaagtcatttggattctgaacttgcttgttcttaatttattttattgtggttacatttcagaatctagttttgcttttattctccatcctccaataaaagtagaccaattatgttgtacaaacttcaaagttaaagagtttgtccaattgtgatggagatatgcaagttcaattttaaggtgaaaaatcttgcagaccgcttaaaggcttctcactyttgcctgacctttctggaaaggcagagccatacagggcccgtgccctgtgcctgggagccctgatgtccagcgggaggtgctccccagcccgtggtttcaggaaagtggggcgggacctttgctaagacagtaagcagctgacagagccttgccccgttgcccggaccccagcttcccacttagtgcctttgcagcaccctccctggcctggctgaaaacagggtcaagctccctctcctagggccagcaataagcaagcccatgctcaccgtgtcctcccgtgagcctccaggctgccc

SEQ ID NO: 21919 - DNA, 601 bp, Human
aaaatgcaaggaagtcatttggattctgaacttgcttgttcttaatttattttattgtggttacatttcagaatctagttttgcttttattctccatcctccaataaaagtagaccaattatgttgtacaaacttcaaagttaaagagtttgtccaattgtgatggagatatgcaagttcaattttaaggtgaaaaatcttgcagaccgcttaaaggcttctcactcttgcctgacctttctggaaaggcagagccatacagggcccgtgccctgtgcctgggagccctgatgtccagcgrgaggtgctccccagcccgtggtttcaggaaagtggggcgggacctttgctaagacagtaagcagctgacagagccttgccccgttgcccggaccccagcttcccacttagtgcctttgcagcaccctccctggcctggctgaaaacagggtcaagctccctctcctagggccagcaataagcaagcccatgctcaccgtgtcctcccgtgagcctccaggctgcccagtgggagcacatgcctcctgcccgtaggtgcccatggagtctttttcacagtgttctttttcttgttctgttt

SEQ ID NO: 21920 - DNA, 601 bp, Human
gaatctagttttgcttttattctccatcctccaataaaagtagaccaattatgttgtacaaacttcaaagttaaagagtttgtccaattgtgatggagatatgcaagttcaattttaaggtgaaaaatcttgcagaccgcttaaaggcttctcactcttgcctgacctttctggaaaggcagagccatacagggcccgtgccctgtgcctgggagccctgatgtccagcgggaggtgctccccagcccgtggtttcaggaaagtggggcgggacctttgctaagacagtaagcagctgacrgagccttgccccgttgcccggaccccagcttcccacttagtgcctttgcagcaccctccctggcctggctgaaaacagggtcaagctccctctcctagggccagcaataagcaagcccatgctcaccgtgtcctcccgtgagcctccaggctgcccagtgggagcacatgcctcctgcccgtaggtgcccatggagtctttttcacagtgttctttttcttgttctgtttttttttcttcttcttcctgtagaagggtcttgctctgttgtccaggctagagtgcagtagcccggtccta

SEQ ID NO: 21921 - DNA, 601 bp, Human
gcccggaccccagcttcccacttagtgcctttgcagcaccctccctggcctggctgaaaacagggtcaagctccctctcctagggccagcaataagcaagcccatgctcaccgtgtcctcccgtgagcctccaggctgcccagtgggagcacatgcctcctgcccgtaggtgcccatggagtctttttcacagtgttctttttcttgttctgtttttttttcttcttcttcctgtagaagggtcttgctctgttgtccaggctagagtgcagtagcccggtcctagctcacgcagtgttgytctgtgtcattattctctaatgtagaatcgcaccatcctgggggtcaggcatcttccgcctcctctttgacctagtttgtggcacacagcaggtcctcatcaaatagctgctgaattttattgaaccttatacttaatgccactgatgtgttgagcccaagttcaggagctgacacgttgtatctgttaagtggccttgccttccctctggcatgtctcctcgtgcatcttcagctcacacgccgactgcaccaatgcttccaggaatactggccaaaccctgactctgtgcccagcacc

SEQ ID NO: 21922 - DNA, 601 bp, Human
gagctagccgagcagtatgagaacgaaatgtttgattatgagcaactcagcgaattgctggtgagtctttatttctttttatttaaatgaacacaggcaatctcagctggtttttcaggaatctctctttccatgtcaatgttagggttcaccccaggcactctgggaccttggccatgtccctccgttttgcctaggaagatggttttagttaatttgctggttgatatttggcccataaatatttactttttagtcccaagtcagctcttataaccaaactcttaaggcttctatgaayaaattgtacgtaaacaactgctgaccttgtgtatagcggtcttgacagcccaggagtctgtgaacatttgtactagtttaaaactgaccccaggccaggcgcactggctcacgcctgtaatcccagcactttgggaggctaaggcaggcggatcacgaggtcaggagatcaagaccatcctggctaacacggtgaaaccccatctctactaaaaatacaacaaagtagccgggcgtggtagcacacgcctgtagtcctggctacttgggaggctgaggctggagaatcgcttgaacccag

SEQ ID NO: 21923 - DNA, 601 bp, Human
aaacaactgctgaccttgtgtatagcggtcttgacagcccaggagtctgtgaacatttgtactagtttaaaactgaccccaggccaggcgcactggctcacgcctgtaatcccagcactttgggaggctaaggcaggcggatcacgaggtcaggagatcaagaccatcctggctaacacggtgaaaccccatctctactaaaaatacaacaaagtagccgggcgtggtagcacacgcctgtagtcctggctacttgggaggctgaggctggagaatcgcttgaacccaggaggtggaagtwgcagtgagctgagatcgcgccaatgcactccagcctgggcaacagagtgagagtccgtctcaaaaaacaaaaaaacctgaccccttctatgagagagggatggatagataatgaccagacctttcttctgccatgggaatgctgttagtttctaattgctacctcctccaccttgtcatttttgtattcagcagatcaccttaatgatgtgggaatgtctgtcatgaatttagaacagaacgattctgttcctttaaattctctttgaacgtatcccactatctgacctataccttttaa

SEQ ID NO: 21924 - DNA, 601 bp, Human
tgcaagcctcagtaccctctcccaccatctccctctcccaccatctccccctcccaccctatagaagttgccagagcttttaaagagcccgcaagaagaatccagaggcacacatgcttgaatactcaaacctgaaatgcattttcttttttccttccagaaaaaacaggctcagttttatgaaaacatcgtcaaagtgatcaggcccaagcctgactattttgctgttggctactacggacaagggttccccacattcctgcgggtaaagtttggttctgcctaatctgagccatgattkttcccccagcagaaaatccccttcccgttctgaggaagggtggggagtttgcatccgcgtgggatcgtgcaactctctacactgccatagctcggtggttagcccggggggcagagaggggttgacaggattttatttggttgcatataacctttctatctgatttttccgtaaaaggaccctccttcagagatttacacgtattattttaattgaggtgtgatatatgatatgtgatactatttgccatcttagccatttttaggtgtgtagttcggtggcattaatacagtcacgttg

SEQ ID NO: 21925 - DNA, 601 bp, Human
ctacactgccatagctcggtggttagcccggggggcagagaggggttgacaggattttatttggttgcatataacctttctatctgatttttccgtaaaaggaccctccttcagagatttacacgtattattttaattgaggtgtgatatatgatatgtgatactatttgccatcttagccatttttaggtgtgtagttcggtggcattaatacagtcacgttgttgtgcggccagcaccaccatctaccttcagaactttttcatcttgcaaaactgagattctgcatccattaaacackaactccccattctccctcctgccagccccagcagccaccgttctactttgtgtctctatgaatctgactgttgtagggaccttgtattagtggaattgtacagtgttcgcccttctgtgtttggcttgtttcactcggccgaatgtcttccagtttcatccaggttgtagcatgtgtcagaactttatcctttttgaggctgaatggtatttcattgcatggagaggccacattttatttattcattgatccactgatgaacatttgggttgtccccgcccaatgtgctgctatgaagat

SEQ ID NO: 21926 - DNA, 601 bp, Human
tgtatgtttttaattatatgggaaattggaaatggatctgtatggccacggtgctagaaactccaaaccaggctccatccctgagacaggcatgtgctttcagacatgtaattgaagcagtaaccgtgatcacctgccaggtgcccatttcccagtattcacatgaggccaaaggagaagttacataaatattaatagtgctgcctggcctaccatagaattgtttatacattttctcaagaacacattctttggatgccattgaccagtgggtcatgatttcctgatatttcttatgactttttttttttttttttggacacttggttttctcttatcctaggagactatgtgtgattgctctggctttaggaagcagaagctctgtgtcttgagcacagccgtctggggcagttgaaaccagttgggagattcccctggttccagacgttgttcatttggggtcctgtgtttccgactccacgggagtcactaatagtgtgacatctcttcatcacggcacccagaggatacagacctccccttaggaagggcatgtcactgttgacaggggagcaccacagttctggcctgctctagg

SEQ ID NO: 21927 - DNA, 601 bp, Human
ccaaaaggacaaaatgaaaagtccgaatggaggttaacaggctcgattaatattgaactgactttcccgccacacctggatcattctgtgggtctgcagcaatatatttatcacacttcacagatgagctggcaggggtcaatctgccaatgacactggcagttaccaaaacgtgggcagaatgtttgcgtgcttcatgccctgctggagaggagcctccaagaactgactagctgtcccttttgctttgtttttctctaaaaattggtctcactgttttttgtgctcatgttgatatttrtagaccttacaaggaataaatatctttgactatatgtacatttcccccttgttttcatgttcaaaaggatcacttcagaatgcaaagtaactgacattttcagaaaatgttattcgtgtttttacctataactcactagcttttttctattaaagtctttatatacatttttattattatgttttctcatgtaaagcataagaaaaatgcttgctagtttgatagtagtctgttatccattaaatcttactgaattttggaagtgcgtggctttatatagaagccttagaagttgctcag

SEQ ID NO: 21928 - DNA, 601 bp, Human
tcatttcggttgagacagccccagatgggacaggatgggtggggggaggcagaaggcttccaaaaccagcagcagcattacactaggtactcattggcccctttctgtgaccgagttcacactcagaacacacgtgttgaaatcgggaaaaaaacggagacctgttgtatcttgcaaggaaaacgttccttacaggtatatttacagaggactgtgtcacactcaggcagaaatgacctcaacaagacagcctcgtggaaggaagaacacttacctacttaactcccctccccgccccggrctgcctagtctagcctagccgtctataacaaccccagtggactgacattccatcttggaatttatggaggtgacaaaagtgtcatttgagatggaccaaacccagcccttccaagaagagctctgtatgttttatcttgacatgtgttgatgaataatgacctgcacacacattctgaatgcaggaagggaagtcctgctctccgtccatcgccagtcactcactcgggggaggccaggaacttagtagctctcggctctggtctgcatcccttcccctcgggttctgctcgcctcggct

SEQ ID NO: 21929 - DNA, 601 bp, Human
tgtgttgatgaataatgacctgcacacacattctgaatgcaggaagggaagtcctgctctccgtccatcgccagtcactcactcgggggaggccaggaacttagtagctctcggctctggtctgcatcccttcccctcgggttctgctcgcctcggctgtgtctcacaggagtcagcgcccggcggccgtgtgcaggtgctggggccccaccttagctcaagctctcttaaattccttatggcagaatgaaaacaacttcattagggcctacctgagaagaaaacaaaaacaagaaaaagygtggacatcattatccacttgtcctggctgccttgcccccttctaaccatttcatgcccattctagtgtgggcttctgagtgctcatttggtttttcatatagtttttaaatcagttgttactgtcaagatgaaaacatatcacagatgttagtagcgcagtgctgagtgcttcttaaacagtattaacttacatgcttgatgaccatgtgttcttgattaacaaagccaacgcaagtacaaaaaaaaataaaaattacaagttgttcttaaatttaatgacattttgtaagaacccgta

SEQ ID NO: 21930 - DNA, 601 bp, Human
gcagaatgaaaacaacttcattagggcctacctgagaagaaaacaaaaacaagaaaaagtgtggacatcattatccacttgtcctggctgccttgcccccttctaaccatttcatgcccattctagtgtgggcttctgagtgctcatttggtttttcatatagtttttaaatcagttgttactgtcaagatgaaaacatatcacagatgttagtagcgcagtgctgagtgcttcttaaacagtattaacttacatgcttgatgaccatgtgttcttgattaacaaagccaacgcaagtacaaaaaaaaataaaaattacaagttgttcttaaatttaatgacattttgtaagaacccgtaaggcatattttaaggccagcatattgcatgtgaactcttcctggccctttctctgtggtgttatgaaatgaatgtcacccttttcagggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtgtatcctttaag

SEQ ID NO: 21931 - DNA, 601 bp, Human
aggcatattttaaggccagcatattgcatgtgaactcttcctggccctttctctgtggtgttatgaaatgaatgtcacccttttcagggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtgtatcctttaagacaacctcatcaactctgaaaccatggtgatgccattcatttgggtggttgggtgtggtrgggggcctctctcatggttgatgtctatgctgccttagtgatccttaaccccctcacctcagatattcagtgcttcacagtgaagcccaaactcgatctgcctcctaagtttcacaggccagtgtcagagcagattgtaaggtaataatcccatttttcttacccaacgtgagggttgtaagaggctgtgtacagatctcttgctaataattccaccttttaaaggacggactttggccatggattcgctttccaaatgctctttctgtcctctttgaagagcaagggaagctaattatt

SEQ ID NO: 21932 - DNA, 601 bp, Human
ccctcacctcagatattcagtgcttcacagtgaagcccaaactcgatctgcctcctaagtttcacaggccagtgtcagagcagattgtaaggtaataatcccatttttcttacccaacgtgagggttgtaagaggctgtgtacagatctcttgctaataattccaccttttaaaggacggactttggccatggattcgctttccaaatgctctttctgtcctctttgaagagcaagggaagctaattattttcagcatccaaaaaaagtgacaggagatgttaatccatgtgctgggagcrtgcaaagcctattcctttcccaaagtcagctgacagcaaaaacctaagagggcagtggaggccgtctggtctcctttatagacctgccctgtggggtacaatcccctagggaacttcacagcagtgcacaagtcctgcctgttcccagcaaagccaagttcatacatgtgagtgtggcctgaatgtttgcattttagaaggcgggaaatgggatttgcacatttgctcctggtgacacacaggagaacccttcagccttacagcacagcaattccataatgtagggttatgagggggctt

SEQ ID NO: 21933 - DNA, 601 bp, Human
tacagatctcttgctaataattccaccttttaaaggacggactttggccatggattcgctttccaaatgctctttctgtcctctttgaagagcaagggaagctaattattttcagcatccaaaaaaagtgacaggagatgttaatccatgtgctgggagcgtgcaaagcctattcctttcccaaagtcagctgacagcaaaaacctaagagggcagtggaggccgtctggtctcctttatagacctgccctgtggggtacaatcccctagggaacttcacagcagtgcacaagtcctgccygttcccagcaaagccaagttcatacatgtgagtgtggcctgaatgtttgcattttagaaggcgggaaatgggatttgcacatttgctcctggtgacacacaggagaacccttcagccttacagcacagcaattccataatgtagggttatgagggggcttttaaacctcctgagtcaactgtccatatttgagtgagattttctgcctgtcagttgtatcgcacctgacttagcaatggcatagaaagacctgctttagcagatgtgtttgatattaagacttttctgttctgtttgatc

SEQ ID NO: 21934 - DNA, 601 bp, Human
ataattccaccttttaaaggacggactttggccatggattcgctttccaaatgctctttctgtcctctttgaagagcaagggaagctaattattttcagcatccaaaaaaagtgacaggagatgttaatccatgtgctgggagcgtgcaaagcctattcctttcccaaagtcagctgacagcaaaaacctaagagggcagtggaggccgtctggtctcctttatagacctgccctgtggggtacaatcccctagggaacttcacagcagtgcacaagtcctgcctgttcccagcaaagccragttcatacatgtgagtgtggcctgaatgtttgcattttagaaggcgggaaatgggatttgcacatttgctcctggtgacacacaggagaacccttcagccttacagcacagcaattccataatgtagggttatgagggggcttttaaacctcctgagtcaactgtccatatttgagtgagattttctgcctgtcagttgtatcgcacctgacttagcaatggcatagaaagacctgctttagcagatgtgtttgatattaagacttttctgttctgtttgatccatgttctggtgaaaa

SEQ ID NO: 21935 - DNA, 601 bp, Human
caaatgctctttctgtcctctttgaagagcaagggaagctaattattttcagcatccaaaaaaagtgacaggagatgttaatccatgtgctgggagcgtgcaaagcctattcctttcccaaagtcagctgacagcaaaaacctaagagggcagtggaggccgtctggtctcctttatagacctgccctgtggggtacaatcccctagggaacttcacagcagtgcacaagtcctgcctgttcccagcaaagccaagttcatacatgtgagtgtggcctgaatgtttgcattttagaaggcrggaaatgggatttgcacatttgctcctggtgacacacaggagaacccttcagccttacagcacagcaattccataatgtagggttatgagggggcttttaaacctcctgagtcaactgtccatatttgagtgagattttctgcctgtcagttgtatcgcacctgacttagcaatggcatagaaagacctgctttagcagatgtgtttgatattaagacttttctgttctgtttgatccatgttctggtgaaaatattaatctctttgatgacctcatattccttaggatcagcttcattt

SEQ ID NO: 21936 - DNA, 601 bp, Human
caaagtcagctgacagcaaaaacctaagagggcagtggaggccgtctggtctcctttatagacctgccctgtggggtacaatcccctagggaacttcacagcagtgcacaagtcctgcctgttcccagcaaagccaagttcatacatgtgagtgtggcctgaatgtttgcattttagaaggcgggaaatgggatttgcacatttgctcctggtgacacacaggagaacccttcagccttacagcacagcaattccataatgtagggttatgagggggcttttaaacctcctgagtcaactrtccatatttgagtgagattttctgcctgtcagttgtatcgcacctgacttagcaatggcatagaaagacctgctttagcagatgtgtttgatattaagacttttctgttctgtttgatccatgttctggtgaaaatattaatctctttgatgacctcatattccttaggatcagcttcattttgcttcctgaagtttggtggtttctttaacctttcatcgtttctttgaccttgcatcagcaataatgggaaataaactgggaccctgtttatttacaaatgattgctctcgcaaggca

SEQ ID NO: 21937 - DNA, 601 bp, Human
tttcagtgcaggggagaaatcagtctcagtctctccacgccctgccctgtgcatgcggaaagcctgcctcgtaccccgaccgcggaggcaggttacttatgtttcctgtgtgtcactcttggggtggttgcaaaatctgtgctttgtagatctgaaactaaggtatgtaatacttttttaaaataataataaacacatacgttgaacacaaaagcttttttctctctccttcgcttcacctttcctctgtttttgctcatttcactcttactcagcttctgttttccctcgagggttggcrgggacagggaagaggcaaaaactcaagttaatttttccacctgccaacatttccctggctgggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaa

SEQ ID NO: 21938 - DNA, 601 bp, Human
agcctgcctcgtaccccgaccgcggaggcaggttacttatgtttcctgtgtgtcactcttggggtggttgcaaaatctgtgctttgtagatctgaaactaaggtatgtaatacttttttaaaataataataaacacatacgttgaacacaaaagcttttttctctctccttcgcttcacctttcctctgtttttgctcatttcactcttactcagcttctgttttccctcgagggttggcggggacagggaagaggcaaaaactcaagttaatttttccacctgccaacatttccctggckgggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgcc

SEQ ID NO: 21939 - DNA, 601 bp, Human
taccccgaccgcggaggcaggttacttatgtttcctgtgtgtcactcttggggtggttgcaaaatctgtgctttgtagatctgaaactaaggtatgtaatacttttttaaaataataataaacacatacgttgaacacaaaagcttttttctctctccttcgcttcacctttcctctgtttttgctcatttcactcttactcagcttctgttttccctcgagggttggcggggacagggaagaggcaaaaactcaagttaatttttccacctgccaacatttccctggctgggagaggacrccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgccactggagaagc

SEQ ID NO: 21940 - DNA, 601 bp, Human
aaacacatacgttgaacacaaaagcttttttctctctccttcgcttcacctttcctctgtttttgctcatttcactcttactcagcttctgttttccctcgagggttggcggggacagggaagaggcaaaaactcaagttaatttttccacctgccaacatttccctggctgggagaggacaccaaggcgatggcttcaggtcaaggttagggacattttacaggaggcagtgacatgttctaaggccagaccccgtgtccaaaagcaaattggctatttgccgggttaaatatctaatgrtctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgccactggagaagcgtggcctcagaggcagccacggagccatattaaatgtctttgtgtattatgtgcagaaatcttaatctattaccccctccaaagttagaaaaactaattgccatttcactaacaatatg

SEQ ID NO: 21941 - DNA, 601 bp, Human
aaactcaagttaatttttccacctgccaacatttccctggctgggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaamcaaacaacaaaaaatatcattccgccaccagtagaactgccactggagaagcgtggcctcagaggcagccacggagccatattaaatgtctttgtgtattatgtgcagaaatcttaatctattaccccctccaaagttagaaaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaa

SEQ ID NO: 21942 - DNA, 601 bp, Human
gccaacatttccctggctgggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccrccaccagtagaactgccactggagaagcgtggcctcagaggcagccacggagccatattaaatgtctttgtgtattatgtgcagaaatcttaatctattaccccctccaaagttagaaaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaaatggacccaccgagtgctgaggtg

SEQ ID NO: 21943 - DNA, 601 bp, Human
ggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgccaytggagaagcgtggcctcagaggcagccacggagccatattaaatgtctttgtgtattatgtgcagaaatcttaatctattaccccctccaaagttagaaaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaaatggacccaccgagtgctgaggtgcggggtgctgacgtggctt

SEQ ID NO: 21944 - DNA, 601 bp, Human
ttggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgccactggagaagcgtggcctcagaggcagccacggagccatattaaatgtctttgtgtattatgtgcagaaatcttaatctattaccccctccaaagttagraaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaaatggacccaccgagtgctgaggtgcggggtgctgacgtggctttctgcaggtgacacagcagtcagcacatgaactggatctggacccgggtgctcattcctcattcagtatccagcacctgaacttcagtggagcacaac

SEQ ID NO: 21945 - DNA, 601 bp, Human
cagaggcagccacggagccatattaaatgtctttgtgtattatgtgcagaaatcttaatctattaccccctccaaagttagaaaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaaatggacccaccgagtgctgaggtgcggggtgctgacgtggctttctgcaggtgacacagyagtcagcacatgaactggatctggacccgggtgctcattcctcattcagtatccagcacctgaacttcagtggagcacaacacacaactgcagggttgaccccagcactactagcaatacggaccgggttattctctgtggtggggaccatccagtgcatccagggatgtttggcagcatccctgaacactgcctactaggtgccagtgccaccaccccagttgggacaaccaatcaaaaagatttccaggccaggcatggtggctcacacctgtaatcccaacactttgggaggctgag

SEQ ID NO: 21946 - DNA, 601 bp, Human
gtggagcacaacacacaactgcagggttgaccccagcactactagcaatacggaccgggttattctctgtggtggggaccatccagtgcatccagggatgtttggcagcatccctgaacactgcctactaggtgccagtgccaccaccccagttgggacaaccaatcaaaaagatttccaggccaggcatggtggctcacacctgtaatcccaacactttgggaggctgaggcaggtagatcaaattagttcaggagttcgagaccagcctgaccaacatggtaaaacactgtctctactraaagtacaacattagccgggcgtggtggtgcacgcctgtaatcccagctatttgggaggctgaggcgggagaatcgcttgaacccaggaggcagaggttgcagtgagccaagatcgctccattgcactccagcctggggaacgagagtgaaactccatcaaaaaaataaagtttccagacattgcaaaataaaacatctgccccttgttgcaaaccacggcattcgagttgtagaaataacagcaaacatctttagagccttttttctttatttttttatttttatttgtttattttttt

SEQ ID NO: 21947 - DNA, 601 bp, Human
ggaccgggttattctctgtggtggggaccatccagtgcatccagggatgtttggcagcatccctgaacactgcctactaggtgccagtgccaccaccccagttgggacaaccaatcaaaaagatttccaggccaggcatggtggctcacacctgtaatcccaacactttgggaggctgaggcaggtagatcaaattagttcaggagttcgagaccagcctgaccaacatggtaaaacactgtctctactaaaagtacaacattagccgggcgtggtggtgcacgcctgtaatcccagctayttgggaggctgaggcgggagaatcgcttgaacccaggaggcagaggttgcagtgagccaagatcgctccattgcactccagcctggggaacgagagtgaaactccatcaaaaaaataaagtttccagacattgcaaaataaaacatctgccccttgttgcaaaccacggcattcgagttgtagaaataacagcaaacatctttagagccttttttctttatttttttatttttatttgtttattttttttgagacagagcctcgctctgtcgcccaagctggaatgcagtgccatgatct

SEQ ID NO: 21948 - DNA, 601 bp, Human
ctcacacctgtaatcccaacactttgggaggctgaggcaggtagatcaaattagttcaggagttcgagaccagcctgaccaacatggtaaaacactgtctctactaaaagtacaacattagccgggcgtggtggtgcacgcctgtaatcccagctatttgggaggctgaggcgggagaatcgcttgaacccaggaggcagaggttgcagtgagccaagatcgctccattgcactccagcctggggaacgagagtgaaactccatcaaaaaaataaagtttccagacattgcaaaataaaayatctgccccttgttgcaaaccacggcattcgagttgtagaaataacagcaaacatctttagagccttttttctttatttttttatttttatttgtttattttttttgagacagagcctcgctctgtcgcccaagctggaatgcagtgccatgatctcggctcactgcaagctccgcctcccaggttcacgccattctcctgcctcaccctcccaagtagctgggactacaggtgcccgccaccacgcccggctaattttttgtatttttagtagagacggggtttcacggtgttagccag

SEQ ID NO: 21949 - DNA, 601 bp, Human
agactataaagaaatagacacaaggaggtcaagtgagccactggagggtgcgcggccagttgggtgcagagctaagaataacgaaggctcttgacattttgagctatgctgagcctcagaggctatgcttcttctaaatggccctgaaatcccctaatggccctgttgaggtccgggcacttggacaaagtgttcggaagctgcaggatttggtccttcacatgccccacaaagccttagataagtgcaacgtcttttgctctactgggaagccagcctcggcccctccagcggggagccyggctccaagtgcagggggctggggaagctgcccaccaggccgagagcagtgcgaggtggctcatccctgcagacctggcaaggggtgactgatgtgctggggagtgagggcactgacgaggaggaagatgagacagggcctgcgtgaggaggagctggccgtaaagcccaggatggaacccagaggtccgtctcagggcatgttgacatgagagaaagcactggaatctggtctagaggtggatgtgagagggccagacctgtttccattgccaggacaaaaacctgagggagccgtccc

SEQ ID NO: 21950 - DNA, 601 bp, Human
tttgttcatgtgtctcagtgccttttgttttcacctggcaagaactcactgagggggtggcacttgccatttagttttcaatgagtccccccgaaacacctgattatttgtctctaggggccggcatctctctgcccagctgcgtgtccagcgccgagccttctcctttgcccacaccagcatgagctatgggcagctatgggccactctctgagaggttgcccgcagtcagagccactgctttatactcaaagcacccagggctcttcacctacccctcctggggtcactttctgctctsgagttccctttctgtgcccctagcagccaggcagtgcctgacagatagaaggctgtgggagttatgtgtcaggtggtaaaaatgcactccctttgctgggtccctttgtagctagtgaggcattgtacatgtgagagacaacagaagagcaggccctccacctaaacaggccgtgatcctcttaatcaccctctgcccatgagccctttgtaatcggggcctgccagccaacagctgccggatgcaggagcttagggaggtggagaggggagccctgacctttcgtgaggatgcagcttc

SEQ ID NO: 21951 - DNA, 601 bp, Human
cctcctcgtgccacctgggaccaacccccgtgggatatctgtgggagcagcagctaaccttcttcaataaaaataggaagggattctttctcagtgcaaatgagattagtaacagggaggtaacagtcagtcctggtggaatactgccctggagtgtgcatttgttgaagctgtgtgcccgggatgaaatgtcgtagggcctggcaaagtaagttgtggggtcaggacagcatggctatgcctgctgtccaggacaccggacaaggggccctctcagcagggtgcacgtggctggccacaccagtgcatcacaatctccccaaggctgtccctccatcagtgcaaggacagtgacatcagtgggcagacaacctctgttatgtccacagccacctaggagtgccagtctagggttgctgacggacagaatcgcccattcgctgttcatctctgccctgccccacccccagctcccaggcagtccgctagaggctgtagcaggaagaaagccggacatgaagataccaagggctcttgggcatgggtgggggcccatcacgcttcctttggaaggagcaaagttattgctgaggtcaccctg

SEQ ID NO: 21952 - DNA, 601 bp, Human
aatactgccctggagtgtgcatttgttgaagctgtgtgcccgggatgaaatgtcgtagggcctggcaaagtaagttgtggggtcaggacagcatggctatgcctgctgtccaggacaccggacaaggggccctctcagcagggtgcacgtggctggccacaccagtgcatcacaatctccccaaggctgtccctccatcagtgcaaggacagtgacatcagtgggcagacaacctctgttatgtccacagccacctaggagtgccagtctagggttgctgacggacagaatcgcccattckctgttcatctctgccctgccccacccccagctcccaggcagtccgctagaggctgtagcaggaagaaagccggacatgaagataccaagggctcttgggcatgggtgggggcccatcacgcttcctttggaaggagcaaagttattgctgaggtcaccctgggacatggtccccgtggcccagtgtgaggaggaggtttggtctgctcaagcaagacctcagggcagctgtggtccctgccttagacccagccacgttgccctggcaccttagggctgagctggagggcactgggctggg

SEQ ID NO: 21953 - DNA, 601 bp, Human
tttcctgggatgaccacatatgtgcatagccacatgcacacacacagccccgcccccagagctgagcagcagctttgctttgttcctttggaattttcatctctgggaacaaacaataataataaaatgcccagccacccaaaaattctgtttggaagaaaggttcacggaggagcaggaagcctgccccagagcacgtggctcctctggtgagaccctgggagtggaggcagctgtggggctgacatcgggctctcctctctctttgcaggtggaaatcagccccctggagaatgccatygagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggtacgggacccaccagcttgctctgggcaagcagtcctgcccggggacagactgaaaattcccgagagtccccaaagcccagaaacgcccctggtctcattgagcaatctcagcagtggcccagccaaggccaggcagcagcagccagtggcg

SEQ ID NO: 21954 - DNA, 601 bp, Human
ccatgttggccaggctggtcttgaactcctgacctcaggtgatccgcccaccttggcctaagtgctgggattacaggcatgagccactgcaccaggccactgtgagcatttttattctgacatcccagcagggcctcttcttagtggcctctctgtcatcagcacattggccaatgagacgtcttagagtggagcaaggctgagctttggttgtgagccaaggtacgagtcctcttaaatttgtgtttagatatataggatgggttggatttttataattctaagtgcttatactgatatrtaaacataatatacattatgtatatattataaataattgtgataaaatatacataacataaaatttcccatcttaaacatttttaagtgtccagttcagaggcaataagtacattcacactgttgtacaaccagcaccgccaccatccatctccagagccttgtcatcttgcaaagctccaactctctacccattgaacgacttccccattcctccctccacccacctcctggtcaccaccattctactttgtgtctctatgaatttgcctactctagatagcttatatgagtggaatca

SEQ ID NO: 21955 - DNA, 601 bp, Human
agacgtcttagagtggagcaaggctgagctttggttgtgagccaaggtacgagtcctcttaaatttgtgtttagatatataggatgggttggatttttataattctaagtgcttatactgatatgtaaacataatatacattatgtatatattataaataattgtgataaaatatacataacataaaatttcccatcttaaacatttttaagtgtccagttcagaggcaataagtacattcacactgttgtacaaccagcaccgccaccatccatctccagagccttgtcatcttgcaaakctccaactctctacccattgaacgacttccccattcctccctccacccacctcctggtcaccaccattctactttgtgtctctatgaatttgcctactctagatagcttatatgagtggaatcatgtaatacttgtccttctgtgtctggcttgtttctcttagcagaatgtcttccagattcatccatgttgtagcgtgtgtcagaacttcattcctttttaaggctgagtaatactccattatagggctagaccgcaatgtgtttctccacggatctgtcaaggaacaacatgtgggt

SEQ ID NO: 21956 - DNA, 601 bp, Human
ttctcttagcagaatgtcttccagattcatccatgttgtagcgtgtgtcagaacttcattcctttttaaggctgagtaatactccattatagggctagaccgcaatgtgtttctccacggatctgtcaaggaacaacatgtgggttgtttctaccttttggctggtgtgaacaatgctgctgtgaatgtgggtgtataaatacctgctcaagtccctgctttcaatactcccatagtttggggtatatacccaaatttagaattgctggctcatgtggtattctgtgttttctttttcacraaactgccaaactcttctacggtcacagcaccatttgacattcccaccagcagtaatgcatgattccaacttctctgcacccccaacaagacttgttattttgtttgtctttttttttttttttttttttttttttgagatggagtctcgctctgtcaccagcctggagtgcagtggcgtgatcttggctcactgcaacctccacctcccgggttcaagcgattctcctgcctcggcctcccgagtagctgggactacagatgtgtgccaccacacctggctaatttttgtatttttggt

SEQ ID NO: 21957 - DNA, 601 bp, Human
atgttggccaggatggtctcgatttcttgacctcgtgatccgcccacctcagcctcccaaagtgctgggattacaggtgtgagccaccgtgcctggcctgtttatcttttaagtaatagccattttaatgagtgagaagttttatttatatgtatatataaacaaaaattatattaaaagggaagaaatcagactttgtcacaaatctgcatttgaaatctgtttgctttggaattatggttttgaacgtcctcagagtttgactgaaagggacattgttggccaactttggcttctttgyatggattgtaagcctcatgtagacagtctccctctgtaactaaaaaagtgggagagagtttaaaattgtgaatgattccattttagatgttgtagattttttactaaagggtacgaaattcaaaattcctctgcaggctataaaactattgctatacaaaaactagtttggtctgcaaaagttctattgattttttttttcctataagcttttacagcaaattggattttaagagtttcaagtcctacagaggaaaataatttgttccccagagagcagctttatgtcagcactatgtca

SEQ ID NO: 21958 - DNA, 601 bp, Human
ttctcacacctggtaaatttcacctatcagattgcagttcgagcagcacaagcgtcctaaaccaaaaggtcttaactctcatctgacaagtaccttctttgacagaaagaatctgaccattaagagttttatcacaccaccatcaacaccaacaacagcaaaactcaggaactagattacattttgtagtttgagaaaggcccgccctaaatcagaaatgcttttagtatctagggtggctgtgctttcaccttgcaacagcacctccacacatccctgcctttgcatccagagagagacmcaacacattcgacatcccaccaaaagttgtcccggtctgtctgcgtcatcccccaaggcggaactcaggaggcagaaggctgacagtgagcattttctactgctggccctgagtaaaccgcggctagccccggggaagctgccatctgcacgagtaattcatagggaatattaaaacatcccaagtattttgaaatctctctgtatgctgtcctttcggtgataactggccagaaaggcctgacatgtgcctagggtttggggccaactgtcagcaaaacaaacttttgtgtcggtgcag

SEQ ID NO: 21959 - DNA, 601 bp, Human
tctcttctgtctactggaattccatgcctgccggcactgagggggtgtgcacagggcttcaactccccggcaaaaggaaggcgagctgtgggaagtcgcgctgcttctcccaggtaacatacggcactttcctctgctccttgaagaccaggtgtcgagtggggtgtgccattttggtttttttctgggcccagggccgcctgtccaccagtccctgaagttctcagctattctctattgaaccctgttttctttgacacattgatctcaataagcaaacagtaatttagtgctccccacrtgccagggaccttcctaagtgctgtatagatactcagttgcttaatctgcctcacactctgtgaagcaggcactgcagtcacctgcattttacagtcaaggaaacagggacatgggaaggtaagtaggtcacaccctagcacgtggcagacccatggttcaagccctatccatgtacctccagggtctgtgcttttagcccctactccaggggctgacatttggcaccacagagcttctccgcctctttcccacatggtaggaaatgcatatgagacctgggcaacccctgagagaaggt

SEQ ID NO: 21960 - DNA, 601 bp, Human
gagctgtgggaagtcgcgctgcttctcccaggtaacatacggcactttcctctgctccttgaagaccaggtgtcgagtggggtgtgccattttggtttttttctgggcccagggccgcctgtccaccagtccctgaagttctcagctattctctattgaaccctgttttctttgacacattgatctcaataagcaaacagtaatttagtgctccccacgtgccagggaccttcctaagtgctgtatagatactcagttgcttaatctgcctcacactctgtgaagcaggcactgcagtcayctgcattttacagtcaaggaaacagggacatgggaaggtaagtaggtcacaccctagcacgtggcagacccatggttcaagccctatccatgtacctccagggtctgtgcttttagcccctactccaggggctgacatttggcaccacagagcttctccgcctctttcccacatggtaggaaatgcatatgagacctgggcaacccctgagagaaggtaatttggttatgatcacactgcatgctctcccagtctccccgcctctgccgggcatgaccgaaccttggtgcctccaagcct

SEQ ID NO: 21961 - DNA, 601 bp, Human
gaagttctcagctattctctattgaaccctgttttctttgacacattgatctcaataagcaaacagtaatttagtgctccccacgtgccagggaccttcctaagtgctgtatagatactcagttgcttaatctgcctcacactctgtgaagcaggcactgcagtcacctgcattttacagtcaaggaaacagggacatgggaaggtaagtaggtcacaccctagcacgtggcagacccatggttcaagccctatccatgtacctccagggtctgtgcttttagcccctactccaggggctracatttggcaccacagagcttctccgcctctttcccacatggtaggaaatgcatatgagacctgggcaacccctgagagaaggtaatttggttatgatcacactgcatgctctcccagtctccccgcctctgccgggcatgaccgaaccttggtgcctccaagcctaggacctggtgtccctcagatgagagggtcccaggcccagcagggcttgaacccaacaaagccaacataacacaactgctgctctgaggttgaaaactcagcaggtgggagtctggaactgccagcccagcggg

SEQ ID NO: 21962 - DNA, 601 bp, Human
attggggtgccatgtggattgtggtgttgtgtggattgggctgccatgtggattgtgccatgtggattggggtgtcatgtggattggagtgccgtgtggattggggtgccgtgtggattggggtaccgtgtggattgtggtgctgtgtggactgtgtcatgtggattgtggtgtcctgtggattggggtgctgtgtggattggggtaccgtgtggactgtggtgctgtgtggactgtgtcatgtggattggggtgccgtgtggattggggtaccgtgtggattgtgccgtgtggattgggktgtcgtgtggattggggtgccatgtggattggggtaccgtgtggattgagccgtgtggattggggtaccgtgtggattgtgccgtgtggattggggtgctgtgtggattcgggtaccatgtggattggggtgccgtgtggattgggatgccgtgtggattggggtgccgtgtggattggggtgtcatgtggattggggtgctgtgtggattggggtaccatgtggattggggtgccgtgtggattgggatgctgtgtgtccttggttggagcttatttccagcacattgtgaggcagcac

SEQ ID NO: 21963 - DNA, 601 bp, Human
ccgtgtggattgtgccgtgtggattggggtgctgtgtggattcgggtaccatgtggattggggtgccgtgtggattgggatgccgtgtggattggggtgccgtgtggattggggtgtcatgtggattggggtgctgtgtggattggggtaccatgtggattggggtgccgtgtggattgggatgctgtgtgtccttggttggagcttatttccagcacattgtgaggcagcaccgtctccatcaacctccccacccttctctgtagcaccagctgggtcaccccgtctagggggtgggagrcttttacagaatgaaggttgcattttccaccctgagatactttgttccccggacccaccttgcagagtcctgctccatcctttgaccgcaacagcaggctctgcaagcatcctttgagagtcaaggggactggcaggtccccttgtccttccctgagaaatgtggcaataaaacgcagtctgggatgtgcctttcctgtcttacctactttggaaacttgcaatcatctcagagcactttgaaaagcaatctagtatcaccctgtttgcaaaaaagatggattttaaaatttaaaaataa

SEQ ID NO: 21964 - DNA, 601 bp, Human
aagcaatctagtatcaccctgtttgcaaaaaagatggattttaaaatttaaaaataaacccatagaaaggacataaaccattttgtcagtgtttctgagccagcttaagccatagaaagagaagatgtggacgccctctgacttctcgatacccaggcccctctgccactctgccttggctttcatcgtgttcccagtcctggggctccaaggagctgccattccctggatgggagctctgcagcccagcttctcctgacctttagggagcgaggtgtgcagggccccagggatgagcccrtgagcacctgccacgttcggcattggcccccgtgccctcaccggcccacagcgccacgttcggcattggcccccgtgccctcaccggcccacagcgtgcaggaggcatgtgtgttggccttcaggcttgtgaaaaagagctttaggtttctcaccaaaacttcatctacctcttcaagtccgattaggagcagggaaattgatcctggttctgcattctctctactcccatccacctcatcactccaaacaccatggagagccataaccccaagatgccatcgtccccctctcccctccc

SEQ ID NO: 21965 - DNA, 601 bp, Human
agtgccctctgtctctccttgacgggagtcatcctcctgccaacccccttcctttattccttgaaatccatactcacacatctcaaccaagacctgaggtcaccttctgagattatgtatggggtaaggttttcacagttggggataatccccaagcaaccatttcccttttagtttcttctaaaggcagagtaattacagtgaacatctccatgaagctatcccctggcaccatcattggtgcaggtccaagactgaccagcccctctctgctggcaaatcccagctgcacgtcactcaragccagtggtcagcaaactgtggcccctggcgtggttgtgtaaataaagttttgttgacaggcaggccatgctcattcatttctgtattatctgtggctgcttttgtgctgtcgtggcagcgcgtgctagtttccacagagaccatatgtcctgcaagcctaaaatacttacctggtcctttgcagcagaggtcccagccctcaggcagtggactggtatcagtctgtggcccgttaggaactgggcccacagctggaggtgagcggcgggtgagggagcattactgtctgagctctgcc

SEQ ID NO: 21966 - DNA, 601 bp, Human
tatgtatggggtaaggttttcacagttggggataatccccaagcaaccatttcccttttagtttcttctaaaggcagagtaattacagtgaacatctccatgaagctatcccctggcaccatcattggtgcaggtccaagactgaccagcccctctctgctggcaaatcccagctgcacgtcactcagagccagtggtcagcaaactgtggcccctggcgtggttgtgtaaataaagttttgttgacaggcaggccatgctcattcatttctgtattatctgtggctgcttttgtgctgtygtggcagcgcgtgctagtttccacagagaccatatgtcctgcaagcctaaaatacttacctggtcctttgcagcagaggtcccagccctcaggcagtggactggtatcagtctgtggcccgttaggaactgggcccacagctggaggtgagcggcgggtgagggagcattactgtctgagctctgcctcctatcagatcagtggcagcattagattctcatgggagcatgaactcgattgtaaactgtgcatgtgagggatctgggttgtgcactccttatgagaatctaatgcctgatg

SEQ ID NO: 21967 - DNA, 601 bp, Human
cgccctctgtctgtggcctctgtctcttccctctcatcggacagcaccccttccagaccaggctccgacgggtgagtcaagctcacagcagggctgagctgagcagtgagggcttgggggatctggaaggagccacccagggctctgggtttattttcttacaactgaggattttgtgttcatcaaaattatctttgaaactgagaccctccgagactttctgaccgtagtgcccaatattactttgaggtcgtgtgagttgttgagaaaaacatcctctctttgggtaccactttgggtraggttttcatccaatttagaacctccagtgagtgttcagtcctcttcagcatggcttagaacaagcttgtccacccgcggcccacgggccacatgcagcccaggatggctttgaatgtggcccaacaccaatccataaactccttaaaacagtatgagattgtttttgtgatttcttctttttttttttttaatagctcatcagctattgttagtgttagtgtatttcatgtgtggcccaagacaattcttcttcttctaatgtggctcagggaagccaaaagattgggcacccctggga

SEQ ID NO: 21968 - DNA, 601 bp, Human
gtgttcagtcctcttcagcatggcttagaacaagcttgtccacccgcggcccacgggccacatgcagcccaggatggctttgaatgtggcccaacaccaatccataaactccttaaaacagtatgagattgtttttgtgatttcttctttttttttttttaatagctcatcagctattgttagtgttagtgtatttcatgtgtggcccaagacaattcttcttcttctaatgtggctcagggaagccaaaagattgggcacccctgggaaaaagcaaggtgcagtccgggctggccaagcrctttgtacttttcatctcctgttcacctccagggtgttgtgcccggacaggagctggtgtggtctgaccatgacacaacctccactgtccccctgtgacaccattctgccaagccaactgtcacagagtcaggctttcatgatggatggccgggccttcttttttttttttcttttcctcccttcctcatttttttggagagcaaatgttttgtttatttttgtttctgctgaggtttattgccttttaaagggaaatggtgtttaagtgaatgcttctgagaatgaccatctgtcccta

SEQ ID NO: 21969 - DNA, 601 bp, Human
tacagttgtttgtgtgtccaatcccattttgtttacaatccatcaccctatcaaacccacaggcatctggccccctcaacacacagaaacaaacttccagagagccccaagggacggctcaactcggattgccctttgttgccaacgactgatgtgcccgatggagaattgcaaactatccccatattttttcttaacagtaatttttatcagcgtctgatatttataaggccaagtccatatggaaattctcaatttagaggtatttaaatcatgtgtgcttgtcacttacagcaagatkgctaaagaaatttaattcaacttctccccgagaaaatccccggactggttatggaaaggtttttatatttctaggaacataggggttagggtggaaattaatggagaggttttagacagaagagtggtgaattgcacatgtgagctcgggctgctggctcttccccagaaggcatttgtttaacctttaactggaaggcgtctttattacagtccagatttgtgttcattcttggggttaccaccctttgctagctaactaatgtggagaaaatgaggctttggtctcaaatggcacagg

SEQ ID NO: 21970 - DNA, 601 bp, Human
tcacaacccgggtcttctccctgagctaaacagcatctactaatccttttcttacctacattatctcaagttctgctaaacctagaataaaatcatgaaatgtttggttgttgcttataatagataaaatatttctcacctaatggatatggatgtattgtatatccagtgcgaaaagtccagatgtcccaaaatgccttaatgatctaagtcaatattggtatattttatcaatcagtttaaattttttaagcattttagtatagaaaaatgtcaaagctgagtacagtggctcatgcckaaaatcccagcactttgggaggctgaggcaggtggattgcttgagctctggagttcaagaccagcctaggcaacataacgaaaccccatctctacaaaaaaatataaaaattagctgggtgtggtggtgcatgcctgtagtctcagctacctgggaggctgaggtgggaggatcacctgaacctggagaggttgtggctgtagtgagccatgattgaaccactgcactccagcctgggcaacagagtgagactctgtttcagaaaaaaagaaacatttcagatatgtacaaagtgggcca

SEQ ID NO: 21971 - DNA, 601 bp, Human
ataacgaaaccccatctctacaaaaaaatataaaaattagctgggtgtggtggtgcatgcctgtagtctcagctacctgggaggctgaggtgggaggatcacctgaacctggagaggttgtggctgtagtgagccatgattgaaccactgcactccagcctgggcaacagagtgagactctgtttcagaaaaaaagaaacatttcagatatgtacaaagtgggccaaacagtgtaatgaggcccccatgccccatcatgcagtcttgacaattatcagcttttaactaatctttttttttcaatctgtatcaatcatattttccagcaaatctcaaatatcatattttatctatagctatttcactatgaatttctaatttaaactcttttttaaaaccataactcggttatattatataaactatagtaatatagtttatttcacaccaaaaatattgacaggaattccatattataataatacatgagtgttaatttcccattgtcatgtctttttttttagttggaggcaaaatccaaataaggttcccaccttgtaccttgcacttggttgatattatctctttaagtctcttttag

SEQ ID NO: 21972 - DNA, 601 bp, Human
cttggctcactgcaatttctacctcccaggctcaagccatcctgccacctcagcctcctgagtagctgggactataggtgcacaccaccatgcccagctaatttttgtacgttttatcgagactggatcttgccatgttggccaggctggtctcgaactcctgagctcaaatgatccacctgccttagcctccccaagtgctaggattataggcatgagccaccatgcccggccctgcaatggccttcttaatgagaacagtggctttcttccaagtgtcccattcagaaatacatgtaaragaaactagagctaggatgaaaatatgactggctggctaaattatcttctcttgaaatcatgctccccttgaagaagccaattgcttctccaggcggtcaaggaagtcaggtttggaagttgctgtgaggctcagagctccaaagagcaggctgtattttgaaaatgtaagatcctagtaacagcactgccttccacgtgagttatgctatatggtttttcaggcgggcccatgccttcatccattcaaccatctctcctgactcctcctcacagcaggagctgctagggatgagactcc

SEQ ID NO: 21973 - DNA, 601 bp, Human
gaagtcaggtttggaagttgctgtgaggctcagagctccaaagagcaggctgtattttgaaaatgtaagatcctagtaacagcactgccttccacgtgagttatgctatatggtttttcaggcgggcccatgccttcatccattcaaccatctctcctgactcctcctcacagcaggagctgctagggatgagactccagtcttagagttggatccatttcttccacctcctgataggacttctaggaccagaaacaggatggacatgccaatcttgtgttggagtgacaaatcacaatcrtgtgtggatatgcttgcacactaaccttttggtacatgccttagacactagcctaagattcatttactccatggtataaccacgaatgtgtctttacagcaactgtggggtaggcagaagggtggtggtgtctttatacccttttataagtgagacagctgccagaggttacgaggacatcaagagtcacccacagtggcagacctagaatgcaggtcttctgtctccagcttagttgctggctggaaacctcagggcatctccaagcacctgtgagctggccctggcttgcttctgact

SEQ ID NO: 21974 - DNA, 601 bp, Human
tcattgacctttcctttaggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacggtaacccgacagggtatctttcctcgctctgcggtagcttcagggacctacctttgccccacctgtagccaacagggctgacrgtgggctcttattgaacttgttataaattagcaactcagaaacctggggtcctcctcccctaacctcaaatgtcccaaggcagtaggacagccagagccacagagagacctggaggaaggtgggcttagcatttgtcccccttccgcagggcctggggcgaggccgctctgctgctaggctctgccgctctgttggacttgtttcctacacatgtcctaatatcccagaagatgagcaggagtccttttgttgtcaggaaacagtccttggtgtccgctaatgccttccccttgcccctt

SEQ ID NO: 21975 - DNA, 601 bp, Human
ctttgccccacctgtagccaacagggctgacagtgggctcttattgaacttgttataaattagcaactcagaaacctggggtcctcctcccctaacctcaaatgtcccaaggcagtaggacagccagagccacagagagacctggaggaaggtgggcttagcatttgtcccccttccgcagggcctggggcgaggccgctctgctgctaggctctgccgctctgttggacttgtttcctacacatgtcctaatatcccagaagatgagcaggagtccttttgttgtcaggaaacagtcctyggtgtccgctaatgccttccccttgccccttgctgactggaactcttctaagctagttacggcccaagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacatgacccgtactgctgagctgaccttgaagacgggtcccagtgagtctcgttcattccacagtcgtgggcgtgtgagggcggtg

SEQ ID NO: 21976 - DNA, 601 bp, Human
cgctctgttggacttgtttcctacacatgtcctaatatcccagaagatgagcaggagtccttttgttgtcaggaaacagtccttggtgtccgctaatgccttccccttgccccttgctgactggaactcttctaagctagttacggcccaagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacrtgacccgtactgctgagctgaccttgaagacgggtcccagtgagtctcgttcattccacagtcgtgggcgtgtgagggcggtgaaacccaggagccggctctcatcctggggctgggcctgagggctgatcctcccagaagtgcaccacattgggaatctgtgttcgtctgttttgtgttactgcaaaggaataactgagcctgcgtcatttatgaagaggttgatttggctcatggttctgcaggctgtacgagcacagcactagcatctgcttggcttctggtgaggcctcaggaggc

SEQ ID NO: 21977 - DNA, 601 bp, Human
atcccagaagatgagcaggagtccttttgttgtcaggaaacagtccttggtgtccgctaatgccttccccttgccccttgctgactggaactcttctaagctagttacggcccaagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacatgacccgtactgctgagctgaccttgaagacgggtaccagtgagtctcgttcattccacagtcgtgggcgtgtgagggcggtgaaacccaggagccggctctcatcctggggctgggcctgagggctgatcctcccagaagtgcaccacattgggaatctgtgttcgtctgttttgtgttactgcaaaggaataactgagcctgcgtcatttatgaagaggttgatttggctcatggttctgcaggctgtacgagcacagcactagcatctgcttggcttctggtgaggcctcaggaggcttttattcttggctgaaggcaggggaggggagcagg

SEQ ID NO: 21978 - DNA, 601 bp, Human
tgccttccccttgccccttgctgactggaactcttctaagctagttacggcccaagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacatgacccgtactgctgagctgaccttgaagacgggtcccagtgagtctcgttcattccacagtcgtgggcgtgtgagggcggtgaaacccaggagcmggctctcatcctggggctgggcctgagggctgatcctcccagaagtgcaccacattgggaatctgtgttcgtctgttttgtgttactgcaaaggaataactgagcctgcgtcatttatgaagaggttgatttggctcatggttctgcaggctgtacgagcacagcactagcatctgcttggcttctggtgaggcctcaggaggcttttattcttggctgaaggcaggggaggggagcaggcgtgtcacatggtgagaaagagagtatgggtggggggtggggggtgtgttccaggctctt

SEQ ID NO: 21979 - DNA, 601 bp, Human
caagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacatgacccgtactgctgagctgaccttgaagacgggtcccagtgagtctcgttcattccacagtcgtgggcgtgtgagggcggtgaaacccaggagccggctctcatcctggggctgggcctgagggctgatcctcccagaagtgcaccrcattgggaatctgtgttcgtctgttttgtgttactgcaaaggaataactgagcctgcgtcatttatgaagaggttgatttggctcatggttctgcaggctgtacgagcacagcactagcatctgcttggcttctggtgaggcctcaggaggcttttattcttggctgaaggcaggggaggggagcaggcgtgtcacatggtgagaaagagagtatgggtggggggtggggggtgtgttccaggctcttttaaataactaggtctcacatgaactgatagaatgaggacccactcattacc

SEQ ID NO: 21980 - DNA, 601 bp, Human
accaagcccttcacgagagatctgctcccaggacccagatgcctcccactggccgcacccccaacatttcaacatgagagttggagaggacagatatccgagctgtatcagagtctgagtgcgaagatgaggcacagcccacttccagggcgaacttgattccaaaagtgctagctgtagttggaaacaaaaataaagaaggagttctcatgggctgtcagcatcaaaggtgaagtcaggattggagccgccctccctggaaatgggtgggtgtctgcttgtctcagccctgggcgtcggygggctgtgattagagggttagacatactgcactgcttgtttataacttaaaacccagaaggtacgttttatctatacttcatgccactcagaaagcagtcacatgctacctggctatctagaggtggaaggcaaacgccccagccatgacttgacgtccaacaggccagcgctgctctgcggcctgtgggtaggtgctgtggctgcagctgggctggagaattcccatgagggtggccgaggatgtcagaccaggggggcactggctggaggctggcctgaagtacccagacgctcagcg

SEQ ID NO: 21981 - DNA, 601 bp, Human
ccagccatgacttgacgtccaacaggccagcgctgctctgcggcctgtgggtaggtgctgtggctgcagctgggctggagaattcccatgagggtggccgaggatgtcagaccaggggggcactggctggaggctggcctgaagtacccagacgctcagcgtccagcagattgaggggttcctgaccacacagcatgctctgtctgctattctggaaagttgagatgcccaccaccccagaggctggctgaagtctccatctcttaagccccaggtagatttctcaagtctcaaaacattrtagctgggtaggggaatgaacagaagcatttttgaatattacttagtgccagacactgtgcaagtctttcatacattttaatttaagctccgttttaagatgctaaattggagggcctcggagcagttgtgccaagtggcagaattgatcacagctgacttgtgtgaaaagaagtccaaggacacaagcacacacgtgacaggcacagagccagcacagtgcatcttctgtccctgcccttggtggcccaagcatccttctagggtccttgcaagcagcagggctaggggcagccccacg

SEQ ID NO: 21982 - DNA, 601 bp, Human
ctccaggggacgggtgccggcaaggtctgtgaggacagtcagacacctgaagtttcctagcaggcggctgcgtgccagtgaccagccatgcgcaggaggggaggtgcgggggaggaggttcacaggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcaycaacaatttcctgacctttagctgagcctctccagccagagcctccaggctgtgatttgcatctcagcagtccagcctcctcagctctctgagtcagaatgtgccctccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcaca

SEQ ID NO: 21983 - DNA, 601 bp, Human
gtcagacacctgaagtttcctagcaggcggctgcgtgccagtgaccagccatgcgcaggaggggaggtgcgggggaggaggttcacaggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcatcaacaatttcctgacctttagctgagcctctccagcsagagcctccaggctgtgatttgcatctcagcagtccagcctcctcagctctctgagtcagaatgtgccctccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctg

SEQ ID NO: 21984 - DNA, 601 bp, Human
aggaggggaggtgcgggggaggaggttcacaggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcatcaacaatttcctgacctttagctgagcctctccagccagagcctccaggctgtgatttgcatctcagcagtccagcctcctcagctctctgartcagaatgtgccctccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctc

SEQ ID NO: 21985 - DNA, 601 bp, Human
gggggaggaggttcacaggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcatcaacaatttcctgacctttagctgagcctctccagccagagcctccaggctgtgatttgcatctcagcagtccagcctcctcagctctctgagtcagaatgtgcccyccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctccttccagcctcagt

SEQ ID NO: 21986 - DNA, 601 bp, Human
ggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcatcaacaatttcctgacctttagctgagcctctccagccagagcctccaggctgtgatttgcatctcagcagtccagcctcctcagctctctgagtcagaatgtgccctccctgggatgcagggargccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctccttccagcctcagtaacctccagactggccc

SEQ ID NO: 21987 - DNA, 601 bp, Human
caatttcctgacctttagctgagcctctccagccagagcctccaggctgtgatttgcatctcagcagtccagcctcctcagctctctgagtcagaatgtgccctccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggayagttctggaaatagacctgttggcctggctctgtcactcatttaccagagggcctgaatcttcctcccaagcctagttcccatttcctccttccagcctcagtaacctccagactggccctggcacagctgactcctcctggggcagacattgaagcctatgtgctctgttgctcacccaaaccagcacagcgcatccaccaggcccccagacccagccgcagccccaagcccagagctgcccactcacctgcctgcccttccttgggggagaacgttgacccctcctttttggctgggt

SEQ ID NO: 21988 - DNA, 601 bp, Human
agaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctccttccagcctcagtaacctccagactggccctggcacrgctgactcctcctggggcagacattgaagcctatgtgctctgttgctcacccaaaccagcacagcgcatccaccaggcccccagacccagccgcagccccaagcccagagctgcccactcacctgcctgcccttccttgggggagaacgttgacccctcctttttggctgggttaatacgttttctaattactcctgcgtcagagtattttgtaactgctcctgttccccaaagcctgatgatctgagaccaacctgtaagaaatatgtaaatacaacttactgatggaacaaacaggga

SEQ ID NO: 21989 - DNA, 601 bp, Human
ttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctccttccagcctcagtaacctccagactggccctggcacagctgactcctcctggggcagacattgaagcctatgtgctctgttgctcacccaaaccagcacagcgcatccaccaggcccccagacccagccgcagcmccaagcccagagctgcccactcacctgcctgcccttccttgggggagaacgttgacccctcctttttggctgggttaatacgttttctaattactcctgcgtcagagtattttgtaactgctcctgttccccaaagcctgatgatctgagaccaacctgtaagaaatatgtaaatacaacttactgatggaacaaacagggaaagggcttaggtgggggaaagtcaagtgcctccaaaagccagagatgagcaggaaaaaatgcattgaaaaggagagaaaaagaatccctgcccagtaa

SEQ ID NO: 21990 - DNA, 601 bp, Human
cttggctcccccgacagcacaggacagttctggaaatagacctgttggcctggctctgtcactcatttaccagagggcctgaatcttcctcccaagcctagttcccatttcctccttccagcctcagtaacctccagactggccctggcacagctgactcctcctggggcagacattgaagcctatgtgctctgttgctcacccaaaccagcacagcgcatccaccaggcccccagacccagccgcagccccaagcccagagctgcccactcacctgcctgcccttccttgggggagaacsttgacccctcctttttggctgggttaatacgttttctaattactcctgcgtcagagtattttgtaactgctcctgttccccaaagcctgatgatctgagaccaacctgtaagaaatatgtaaatacaacttactgatggaacaaacagggaaagggcttaggtgggggaaagtcaagtgcctccaaaagccagagatgagcaggaaaaaatgcattgaaaaggagagaaaaagaatccctgcccagtaatgacctaggatgagagaagaagcaaaggaaaggaatagcaaaaatccttca

SEQ ID NO: 21991 - DNA, 601 bp, Human
aacagggaaagggcttaggtgggggaaagtcaagtgcctccaaaagccagagatgagcaggaaaaaatgcattgaaaaggagagaaaaagaatccctgcccagtaatgacctaggatgagagaagaagcaaaggaaaggaatagcaaaaatccttcagccaattcctagactttcaggtacacgccaaggagaccaaagcatgctgagcacagctgggaataattctgccatggaacaggccattgattttgttcttgaccgcacggatgttgccccgtgtgtccttgctggctatctgcrtgtcttgcaataatactcagccacttttgcatctatattcaggtcacctgcgatgtgctgtccagcccaggctgtgtgaggacagcagtgccagcccctcgtgtgggggaggtctgctgtaaccacatgctgggcggctccaaccccagaaactcattgtctcccagttctagaggcgtcggcagggctgattccttcagaggctgtgagggagagtctacacatgcctctctcctcctgtctgggggtttgctgccatctctggtgtttcttggctgatagaagcatcaccctgacctc

SEQ ID NO: 21992 - DNA, 601 bp, Human
gatgttgccccgtgtgtccttgctggctatctgcatgtcttgcaataatactcagccacttttgcatctatattcaggtcacctgcgatgtgctgtccagcccaggctgtgtgaggacagcagtgccagcccctcgtgtgggggaggtctgctgtaaccacatgctgggcggctccaaccccagaaactcattgtctcccagttctagaggcgtcggcagggctgattccttcagaggctgtgagggagagtctacacatgcctctctcctcctgtctgggggtttgctgccatctctggygtttcttggctgatagaagcatcaccctgacctctgctttcatcttcacgttgtgccctcccaaatttggacacgtccatgtccagatttccctttttcataaggtcacctgtcctgttggaattggacctgttactgggaagtgtgcaggtccttggttcttagtcttcttagaggaaagaattcagccaagagaccaattagtaaagtaggtaaagtaggcttattaaggaaataaaagtagcatggactctgggagaggagcaggctgaccctgtggagagcagcccccaggagttc

SEQ ID NO: 21993 - DNA, 601 bp, Human
atgttgccccgtgtgtccttgctggctatctgcatgtcttgcaataatactcagccacttttgcatctatattcaggtcacctgcgatgtgctgtccagcccaggctgtgtgaggacagcagtgccagcccctcgtgtgggggaggtctgctgtaaccacatgctgggcggctccaaccccagaaactcattgtctcccagttctagaggcgtcggcagggctgattccttcagaggctgtgagggagagtctacacatgcctctctcctcctgtctgggggtttgctgccatctctggtrtttcttggctgatagaagcatcaccctgacctctgctttcatcttcacgttgtgccctcccaaatttggacacgtccatgtccagatttccctttttcataaggtcacctgtcctgttggaattggacctgttactgggaagtgtgcaggtccttggttcttagtcttcttagaggaaagaattcagccaagagaccaattagtaaagtaggtaaagtaggcttattaaggaaataaaagtagcatggactctgggagaggagcaggctgaccctgtggagagcagcccccaggagttct

SEQ ID NO: 21994 - DNA, 601 bp, Human
ctgtcttaagcctctccctttgtctttgtctgttttccctgctctgtcttaagtctccaccttttccctgcctagttcctgcccaggtttgtggggctctcccttgctgctagttgatgtgcacacgtggggctcagtgatcagtaggaacctacctaatggcggcattgctcattaccgccaccccaagaaggtcatacagtggtcaaatctgtacatactgtgtgtgtgtatctcttaggcattcatcccttgccctgtttccctcctgatcagcatgtagctagttacattgtcacasgttagctacagagggagcaattactgggtgtcttatggggtgtttcaggatgctgcctcctgcctaggtattctcctcccctctgctcacacctagcatgtgtgttttggggggtctctggggcataaggttttccagagtttcctcccccggtcccccattccttttcatgtcttactatctgcccactctaacaggcccaccctaagagccacaccttagcttgatcatttgcaaagaccctatttccagttaaggtcatattctaaggtaatgggggtcaggacttcaacataggaa

SEQ ID NO: 21995 - DNA, 601 bp, Human
aacaggcccaccctaagagccacaccttagcttgatcatttgcaaagaccctatttccagttaaggtcatattctaaggtaatgggggtcaggacttcaacataggaatttaggtggaaacgcaactcagcccataacagaccgtaactgtgctctttctgtccttttgatgtagataagtcccctgcggccccagagaccgaagagccaggtgatgaacgtcattggaagcgaaaggcgcttctcggtgtccccctcgtcaccgtcctcccagcaaacaccccctccagttacaccaagrgccaagctcagcttcagcatgcagtcgagtaagtggaacgctccccacatacgaatcgtgctatagctccgtgacttcccctcactgaaggctctgaggttagaagcgcttcctccctccccttgcagcagagggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaa

SEQ ID NO: 21996 - DNA, 601 bp, Human
tgcaaagaccctatttccagttaaggtcatattctaaggtaatgggggtcaggacttcaacataggaatttaggtggaaacgcaactcagcccataacagaccgtaactgtgctctttctgtccttttgatgtagataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagtaagtggaacrctccccacatacgaatcgtgctatagctccgtgacttcccctcactgaaggctctgaggttagaagcgcttcctccctccccttgcagcagagggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaagcacgtggaaccaccacactttctatcccaggacgcagag

SEQ ID NO: 21997 - DNA, 601 bp, Human
ataacagaccgtaactgtgctctttctgtccttttgatgtagataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagtaagtggaacgctccccacatacgaatcgtgctatagctccgtgacttcccctcactgaaggctctgaggttagaagcgcttcctccctccccttgcagcagasggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaagcacgtggaaccaccacactttctatcccaggacgcagagctgcaggaggccgtgggcctgcttgtgtctaggactgtgcgctggagaagcaccttcaggcagttggcaacagctaaggggcacagcttattt

SEQ ID NO: 21998 - DNA, 601 bp, Human
taacagaccgtaactgtgctctttctgtccttttgatgtagataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagtaagtggaacgctccccacatacgaatcgtgctatagctccgtgacttcccctcactgaaggctctgaggttagaagcgcttcctccctccccttgcagcagagkgtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaagcacgtggaaccaccacactttctatcccaggacgcagagctgcaggaggccgtgggcctgcttgtgtctaggactgtgcgctggagaagcaccttcaggcagttggcaacagctaaggggcacagcttatttt

SEQ ID NO: 21999 - DNA, 601 bp, Human
ggccaagctcagcttcagcatgcagtcgagtaagtggaacgctccccacatacgaatcgtgctatagctccgtgacttcccctcactgaaggctctgaggttagaagcgcttcctccctccccttgcagcagagggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgargcacgtggaaccaccacactttctatcccaggacgcagagctgcaggaggccgtgggcctgcttgtgtctaggactgtgcgctggagaagcaccttcaggcagttggcaacagctaaggggcacagcttatttttctagttttgaccaatgtttaaattaccctagaagttcccacaaaactggtggctccaaacagcagaaatttgttctctgaaggttttggaggccaaaactctgaaatcaaggaggtagcaagttggttccctctggtggctccaagggagagcctgtcccgggcc

SEQ ID NO: 22000 - DNA, 601 bp, Human
ctcactgaaggctctgaggttagaagcgcttcctccctccccttgcagcagagggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaagcacgtggaaccaccacactttctatcccaggacgcagagctgcaggaggccgtgggcctgcttgtgtctaggactgtgcrctggagaagcaccttcaggcagttggcaacagctaaggggcacagcttatttttctagttttgaccaatgtttaaattaccctagaagttcccacaaaactggtggctccaaacagcagaaatttgttctctgaaggttttggaggccaaaactctgaaatcaaggaggtagcaagttggttccctctggtggctccaagggagagcctgtcccgggcctccctccagcttctggtggctcccagcagtccctagccctccttggcttgtggccacatcactcccctctctgcccctgtc

SEQ ID NO: 22001 - DNA, 601 bp, Human
cagaaagtgcagggtctgtcccagggtccatgtggaggggacctgtgaagcacgtggaaccaccacactttctatcccaggacgcagagctgcaggaggccgtgggcctgcttgtgtctaggactgtgcgctggagaagcaccttcaggcagttggcaacagctaaggggcacagcttatttttctagttttgaccaatgtttaaattaccctagaagttcccacaaaactggtggctccaaacagcagaaatttgttctctgaaggttttggaggccaaaactctgaaatcaaggaggtrgcaagttggttccctctggtggctccaagggagagcctgtcccgggcctccctccagcttctggtggctcccagcagtccctagccctccttggcttgtggccacatcactcccctctctgcccctgtctccacgtggcctccttctcggtgtcctctcttcttacaaggacatcagtcattggatatagggtccactgcaaatccaggatgatctcaccttgagatccttcactaattacatctgcaaagaccctacatccaaataaggtacattctgaggttctgggtggccctaaga

SEQ ID NO: 22002 - DNA, 601 bp, Human
tgttctctgaaggttttggaggccaaaactctgaaatcaaggaggtagcaagttggttccctctggtggctccaagggagagcctgtcccgggcctccctccagcttctggtggctcccagcagtccctagccctccttggcttgtggccacatcactcccctctctgcccctgtctccacgtggcctccttctcggtgtcctctcttcttacaaggacatcagtcattggatatagggtccactgcaaatccaggatgatctcaccttgagatccttcactaattacatctgcaaagacsctacatccaaataaggtacattctgaggttctgggtggccctaagaggtctacattttggagagactctactcaacttactctaagtggcagacagcttttcaccactagattcagagccagcagagaggagaaatcttggcagggagaaggtgctgaggatggggacggcagcagaaccggggagcccactctccttcctgtggcacagagaggggtcccaggcaggaaagctctgtgccctgtggcgagggctgtgcaaggcagtgagtgattgtcctctgctcctgattttcctctt

SEQ ID NO: 22003 - DNA, 601 bp, Human
tctctgaaggttttggaggccaaaactctgaaatcaaggaggtagcaagttggttccctctggtggctccaagggagagcctgtcccgggcctccctccagcttctggtggctcccagcagtccctagccctccttggcttgtggccacatcactcccctctctgcccctgtctccacgtggcctccttctcggtgtcctctcttcttacaaggacatcagtcattggatatagggtccactgcaaatccaggatgatctcaccttgagatccttcactaattacatctgcaaagaccctrcatccaaataaggtacattctgaggttctgggtggccctaagaggtctacattttggagagactctactcaacttactctaagtggcagacagcttttcaccactagattcagagccagcagagaggagaaatcttggcagggagaaggtgctgaggatggggacggcagcagaaccggggagcccactctccttcctgtggcacagagaggggtcccaggcaggaaagctctgtgccctgtggcgagggctgtgcaaggcagtgagtgattgtcctctgctcctgattttcctcttgct

SEQ ID NO: 22004 - DNA, 601 bp, Human
gatatagggtccactgcaaatccaggatgatctcaccttgagatccttcactaattacatctgcaaagaccctacatccaaataaggtacattctgaggttctgggtggccctaagaggtctacattttggagagactctactcaacttactctaagtggcagacagcttttcaccactagattcagagccagcagagaggagaaatcttggcagggagaaggtgctgaggatggggacggcagcagaaccggggagcccactctccttcctgtggcacagagaggggtcccaggcaggaragctctgtgccctgtggcgagggctgtgcaaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaaatgtgtttaaaatctattttaatattgaaaacagacaccatcactgctgctgcggaaa

SEQ ID NO: 22005 - DNA, 601 bp, Human
gcagaaccggggagcccactctccttcctgtggcacagagaggggtcccaggcaggaaagctctgtgccctgtggcgagggctgtgcaaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaamtgtgtttaaaatctattttaatattgaaaacagacaccatcactgctgctgcggaaaacaatttagtggttcctccaaagttcaatgtagaataaacctataatatcaactggcagtcctgcttctaggcctgtactccaaagaattgaagacagggactcaaacagatacttaatattcatagcagtatttttcaagagccagtaagcaaacacaggccaaatgtccatcaactgatggccagattaacaaaatgtacgtccaaagaaatgtccgtgcaatggaatattacccagccgt

SEQ ID NO: 22006 - DNA, 601 bp, Human
aggaaagctctgtgccctgtggcgagggctgtgcaaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaaatgtgtttaaaatctattttaatattgaaaacagacaccatcactgctgctgcrgaaaacaatttagtggttcctccaaagttcaatgtagaataaacctataatatcaactggcagtcctgcttctaggcctgtactccaaagaattgaagacagggactcaaacagatacttaatattcatagcagtatttttcaagagccagtaagcaaacacaggccaaatgtccatcaactgatggccagattaacaaaatgtacgtccaaagaaatgtccgtgcaatggaatattacccagccgtagaaaggagtgaagttctgacacgtgctacagcacggacgaacctcagaacca

SEQ ID NO: 22007 - DNA, 601 bp, Human
caaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaaatgtgtttaaaatctattttaatattgaaaacagacaccatcactgctgctgcggaaaacaatttagtggttcctccaaagttcaaygtagaataaacctataatatcaactggcagtcctgcttctaggcctgtactccaaagaattgaagacagggactcaaacagatacttaatattcatagcagtatttttcaagagccagtaagcaaacacaggccaaatgtccatcaactgatggccagattaacaaaatgtacgtccaaagaaatgtccgtgcaatggaatattacccagccgtagaaaggagtgaagttctgacacgtgctacagcacggacgaacctcagaaccatgatgctgagtgaaatagatcagtcacaaaggg

SEQ ID NO: 22008 - DNA, 601 bp, Human
aaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaaatgtgtttaaaatctattttaatattgaaaacagacaccatcactgctgctgcggaaaacaatttagtggttcctccaaagttcaatrtagaataaacctataatatcaactggcagtcctgcttctaggcctgtactccaaagaattgaagacagggactcaaacagatacttaatattcatagcagtatttttcaagagccagtaagcaaacacaggccaaatgtccatcaactgatggccagattaacaaaatgtacgtccaaagaaatgtccgtgcaatggaatattacccagccgtagaaaggagtgaagttctgacacgtgctacagcacggacgaacctcagaaccatgatgctgagtgaaatagatcagtcacaaaggga

SEQ ID NO: 22009 - DNA, 601 bp, Human
cagtatttttcaagagccagtaagcaaacacaggccaaatgtccatcaactgatggccagattaacaaaatgtacgtccaaagaaatgtccgtgcaatggaatattacccagccgtagaaaggagtgaagttctgacacgtgctacagcacggacgaacctcagaaccatgatgctgagtgaaatagatcagtcacaaagggacaaatattatatgactccacctaaatcaaatatctaaggcaagttcatagagacagaaaggcatggctcacgcctgtcatcccagcactttgggagtycgaggtgggtggatcagctgaggtcaggagttcgagaccagccagtcaacatggtaaaaccccgtctctactaaaaatacaataattagctgggtgtggtggtgcgtgcctataatctcagctactcagaaggctgaggcaggagaatcacttgaacctgggaggcggaggttgcagtgagctgagatcgcaccactgcactccagcctgggcgacacagcgagactccatcccaaacaaaaagaaaagaaaaaaaaaaagaaagtagaatagaggatactaggggcgggagagaggagt

SEQ ID NO: 22010 - DNA, 601 bp, Human
ccaaatgtccatcaactgatggccagattaacaaaatgtacgtccaaagaaatgtccgtgcaatggaatattacccagccgtagaaaggagtgaagttctgacacgtgctacagcacggacgaacctcagaaccatgatgctgagtgaaatagatcagtcacaaagggacaaatattatatgactccacctaaatcaaatatctaaggcaagttcatagagacagaaaggcatggctcacgcctgtcatcccagcactttgggagttcgaggtgggtggatcagctgaggtcaggagttcragaccagccagtcaacatggtaaaaccccgtctctactaaaaatacaataattagctgggtgtggtggtgcgtgcctataatctcagctactcagaaggctgaggcaggagaatcacttgaacctgggaggcggaggttgcagtgagctgagatcgcaccactgcactccagcctgggcgacacagcgagactccatcccaaacaaaaagaaaagaaaaaaaaaaagaaagtagaatagaggatactaggggcgggagagaggagtggagagttactgtttaatgggtacagaattccgt

SEQ ID NO: 22011 - DNA, 601 bp, Human
acctaaatcaaatatctaaggcaagttcatagagacagaaaggcatggctcacgcctgtcatcccagcactttgggagttcgaggtgggtggatcagctgaggtcaggagttcgagaccagccagtcaacatggtaaaaccccgtctctactaaaaatacaataattagctgggtgtggtggtgcgtgcctataatctcagctactcagaaggctgaggcaggagaatcacttgaacctgggaggcggaggttgcagtgagctgagatcgcaccactgcactccagcctgggcgacacagygagactccatcccaaacaaaaagaaaagaaaaaaaaaaagaaagtagaatagaggatactaggggcgggagagaggagtggagagttactgtttaatgggtacagaattccgtttggggtgatggaaatgtttcagaaatacatcatggtgatggttatcccccacggtcgatgtgattaatgccaccaaattgtcccctaaaggatggctaaaatggcaaattttatgtcgtgtatatcttaccacaataatagcaaagaagtaggcagcaatcatgaggacagtcactcaccgaagcc

SEQ ID NO: 22012 - DNA, 601 bp, Human
tagagacagaaaggcatggctcacgcctgtcatcccagcactttgggagttcgaggtgggtggatcagctgaggtcaggagttcgagaccagccagtcaacatggtaaaaccccgtctctactaaaaatacaataattagctgggtgtggtggtgcgtgcctataatctcagctactcagaaggctgaggcaggagaatcacttgaacctgggaggcggaggttgcagtgagctgagatcgcaccactgcactccagcctgggcgacacagcgagactccatcccaaacaaaaagaaaagaaaaaaaaaaagaaagtagaatagaggatactaggggcgggagagaggagtggagagttactgtttaatgggtacagaattccgtttggggtgatggaaatgtttcagaaatacatcatggtgatggttatcccccacggtcgatgtgattaatgccaccaaattgtcccctaaaggatggctaaaatggcaaattttatgtcgtgtatatcttaccacaataatagcaaagaagtaggcagcaatcatgaggacagtcactcaccgaagccttcgtatttccctcagccccatggcagag

SEQ ID NO: 22013 - DNA, 601 bp, Human
tgtttaatgggtacagaattccgtttggggtgatggaaatgtttcagaaatacatcatggtgatggttatcccccacggtcgatgtgattaatgccaccaaattgtcccctaaaggatggctaaaatggcaaattttatgtcgtgtatatcttaccacaataatagcaaagaagtaggcagcaatcatgaggacagtcactcaccgaagccttcgtatttccctcagccccatggcagagcttccttataagcttacagtgtggccttcctagcatgcattttcctaataaaggatttttyatcagatgaatcctaggggaaaactccaaaagagactcatcagtaaaaatgtccatttttctctctttaatataaaagaaaacaaattatctttaagagtctcaacaaggtttgagaaaatatcctgccttaatgattattcctccgtttgaaaacggctattttttccagtttactttaaaaatcaattgtacttccccttggcttatttaaagcaacagccacagtgactgctatggctaatgacttcatgtcatacgactgtggattttcctgtggaaagagatgggaagctgggtg

SEQ ID NO: 22014 - DNA, 601 bp, Human
catttttctctctttaatataaaagaaaacaaattatctttaagagtctcaacaaggtttgagaaaatatcctgccttaatgattattcctccgtttgaaaacggctattttttccagtttactttaaaaatcaattgtacttccccttggcttatttaaagcaacagccacagtgactgctatggctaatgacttcatgtcatacgactgtggattttcctgtggaaagagatgggaagctgggtggctggtcggcgtgttagactttgcttagtgaatctctccaggtgataactgcargggtgactgcaggggcctggcttggcttcgaaagcagtagcagcagcagcggagacggtcctgtggcacccagctgtttaacttccaccgaggcagggggcccgagcagggacagaagaggccggggtgaacatcaccctttctacagtggctcgatgccttgcttcacactccagttttagtgttcgtgtgatacttgctattctctttctagaacattgccgttaggagagggtcccaccctttgtgttcgctccctccctgccctcatctgctctgttgacaaacgttttctgccag

SEQ ID NO: 22015 - DNA, 601 bp, Human
agaaaacaaattatctttaagagtctcaacaaggtttgagaaaatatcctgccttaatgattattcctccgtttgaaaacggctattttttccagtttactttaaaaatcaattgtacttccccttggcttatttaaagcaacagccacagtgactgctatggctaatgacttcatgtcatacgactgtggattttcctgtggaaagagatgggaagctgggtggctggtcggcgtgttagactttgcttagtgaatctctccaggtgataactgcaggggtgactgcaggggcctggctkggcttcgaaagcagtagcagcagcagcggagacggtcctgtggcacccagctgtttaacttccaccgaggcagggggcccgagcagggacagaagaggccggggtgaacatcaccctttctacagtggctcgatgccttgcttcacactccagttttagtgttcgtgtgatacttgctattctctttctagaacattgccgttaggagagggtcccaccctttgtgttcgctccctccctgccctcatctgctctgttgacaaacgttttctgccagatgaagtgtttctgctgtgcctg

SEQ ID NO: 22016 - DNA, 601 bp, Human
atggctaatgacttcatgtcatacgactgtggattttcctgtggaaagagatgggaagctgggtggctggtcggcgtgttagactttgcttagtgaatctctccaggtgataactgcaggggtgactgcaggggcctggcttggcttcgaaagcagtagcagcagcagcggagacggtcctgtggcacccagctgtttaacttccaccgaggcagggggcccgagcagggacagaagaggccggggtgaacatcaccctttctacagtggctcgatgccttgcttcacactccagttttartgttcgtgtgatacttgctattctctttctagaacattgccgttaggagagggtcccaccctttgtgttcgctccctccctgccctcatctgctctgttgacaaacgttttctgccagatgaagtgtttctgctgtgcctgcctctctgggagggaacgtggagcagctccctgagcattcaggctccgtggggaagtcggactgattttaaatagatcccggttttccaggcttggagctgaacggcatgacggggacggacgtggccgatgtcccaccccctctgcctctcaaaggca

SEQ ID NO: 22017 - DNA, 601 bp, Human
tccaccgaggcagggggcccgagcagggacagaagaggccggggtgaacatcaccctttctacagtggctcgatgccttgcttcacactccagttttagtgttcgtgtgatacttgctattctctttctagaacattgccgttaggagagggtcccaccctttgtgttcgctccctccctgccctcatctgctctgttgacaaacgttttctgccagatgaagtgtttctgctgtgcctgcctctctgggagggaacgtggagcagctccctgagcattcaggctccgtggggaagtcggrctgattttaaatagatcccggttttccaggcttggagctgaacggcatgacggggacggacgtggccgatgtcccaccccctctgcctctcaaaggcagcgtggcagattacgggaatttgatggaaaaccaggacttgctgggctcgccaacacctccacctccccctccacaccagagggtaagtcggcaatctgaaacacaggctttcattgcttcgcctccacaaagtaggacgagtccctcattccagatactagcaggtttacttcgggctagtgagcacatgaggaaaaccat

SEQ ID NO: 22018 - DNA, 601 bp, Human
tgaacggcatgacggggacggacgtggccgatgtcccaccccctctgcctctcaaaggcagcgtggcagattacgggaatttgatggaaaaccaggacttgctgggctcgccaacacctccacctccccctccacaccagagggtaagtcggcaatctgaaacacaggctttcattgcttcgcctccacaaagtaggacgagtccctcattccagatactagcaggtttacttcgggctagtgagcacatgaggaaaaccatgtatgatgggcccgggtttgattttgcaaaaagatatcraagcagtaaggactccagtgggtaagatctgtggctctgcgtcattatcaataactgcatcaaaaagcacattttgatatcatgcctcagaacgaggaagaggatagacattccaaggttgtcatcggttatcatcaccatggagatcattccactggagatgcaattctaatgacattttgatttttgagaagtagcttttctatcaagaggtctgactttttaaagaggttggccaatatcgccctgtatggcaggcacctgttgtacacctgcttggccctggagaagcttgtctcc

SEQ ID NO: 22019 - DNA, 601 bp, Human
gcctttgtaagcctaagcaacctgctggaacccctcttcagcgtgagtccctgaagctggtaccccccagcagctgttttagtcattcatgccacctaaagtgccttttgccaaacagcccctgggcctgcctgcccgtacaaatattagtcaaagtcatgaaaagccatttaaacaagcacctcagttaccagttgacagttctagaaacattcttttgagatccaccccgttcctctcctggttctcaaggatgctgtcaggcgtcactcatccctgcgggtcccagccccatcctcaygtcgggcccaggcatgtgtggagggcagcatgagtgggatggaggcgggcgagcgattgactcagccacggcgggaacttctgcttctaggctcaggcctccccaggccatgttattcacagcctttgacaattaaatcagtggtgtctgaagggtaaaatatccctcttcatatgtggacagctggccgtattttttttgctatccagccttagtgaagtaattatatggccgcaaaactcctgtagaacattgaaaacatgagattgttgggtggctctgtttttttcataatggtga

SEQ ID NO: 22020 - DNA, 601 bp, Human
tatgagaggagtggaagagagagggtgtttgtgtacagcatacgtatttcatcattccctttgtatcagaaaactaaacaagcagtcatctttaatatcaaagaggcagattgctcttctgagacccaagtgccatttaaacaggctccctctccctagagacgcctcgatggggaaccggtcctggaggaggcaccaggttcccctgtgaagagggctttctggcaggctggaatggtttgttgcaccacagaaatggaagccggaccttccccggccatttctaactacttgtgagagyaaaaggagattcgggggggtctaacaagaatattgggttgcttggagtattgtttccctaacagcttcgttaattggtcacattttcatctctctattttattgcaaaggcaggaatgttccccctagtctccctacactagtaaactgaaaattctaaacttagaattacagccaattcctcttgttacaaatcaactccggggtaacattttattgtctcaatttcttggatacaccattgtgggttactgatgccacatacagttgattaagtaagggataacatggattagctctc

SEQ ID NO: 22021 - DNA, 601 bp, Human
ggtctaacaagaatattgggttgcttggagtattgtttccctaacagcttcgttaattggtcacattttcatctctctattttattgcaaaggcaggaatgttccccctagtctccctacactagtaaactgaaaattctaaacttagaattacagccaattcctcttgttacaaatcaactccggggtaacattttattgtctcaatttcttggatacaccattgtgggttactgatgccacatacagttgattaagtaagggataacatggattagctctctctcaattgataaagggsgtgtgaattcaattagattaatgacccaggtgtctttggtctttgtttcttgtttaatttacttgcagcctgagtgcatgctcaggtgacacgctggtggttagtatgtcatcattaggcagaagcggttgcatttcctggggtgcctccctttgcacaggccctgagagctgttctaggataatgatcatccatctgccatgatgggggtgtgatcaatatcctcctgtcactctcattgatcagcctcaggcttgtaggcaactctgtctttagttgttgccactaagctgtcatttc

SEQ ID NO: 22022 - DNA, 601 bp, Human
cgaagctcagaaagcaaaagaaggtctctcatctcacccctggagagtgcctctaaggacttatttatcccttagacaatagatggataacttggtcgatagcatctagatttaaaaaggccacgcaaagggcaatggtacctctcaggggctgtgcagacggtgggagagtgctcagaggcgtcagaaaggcccaggcccatagcagcccagtcttgagcctagtagacctgccagccccaagtcggacaggatggagcccaactcatgtggggaggatggttccggctgagtggctgtrccaggtcagaccccacctggagacggtgtcttttctgtcaggacatcagttatgtgacatcttccccatcctcatgttttttagcatctgccacctccactgcccagcaaaactccgcctcctccccctccaaagacaactcgcaagcagacatcggtggactccgggatcgtgcagtgacatcgcaaggctctctggaaagagtgtgctgcccctccccatctccatgccctctccttctgtgtcccctgagtctgctgtttacctcattgggcctgtgatgttaacatttcgtgcgac

SEQ ID NO: 22023 - DNA, 601 bp, Human
ggagagtgctcagaggcgtcagaaaggcccaggcccatagcagcccagtcttgagcctagtagacctgccagccccaagtcggacaggatggagcccaactcatgtggggaggatggttccggctgagtggctgtgccaggtcagaccccacctggagacggtgtcttttctgtcaggacatcagttatgtgacatcttccccatcctcatgttttttagcatctgccacctccactgcccagcaaaactccgcctcctccccctccaaagacaactcgcaagcagacatcggtggactcygggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttg

SEQ ID NO: 22024 - DNA, 601 bp, Human
cccagcaaaactccgcctcctccccctccaaagacaactcgcaagcagacatcggtggactccgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgcyatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaa

SEQ ID NO: 22025 - DNA, 601 bp, Human
tccgcctcctccccctccaaagacaactcgcaagcagacatcggtggactccgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttaycagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccaggg

SEQ ID NO: 22026 - DNA, 601 bp, Human
acctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttrggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctga

SEQ ID NO: 22027 - DNA, 601 bp, Human
cgtgctgcgaggctggactcctccagcagcgatggggagatggggacttggatcctccccgggtcttccgcccccacccaaaaagggctttctggagccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgcccccccccggttttctcgccctgtagttcggggctggggccctggcggggattcgggctctttttcacgtctcttttccgccccttctgccgctcaggaggcgtccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaatt

SEQ ID NO: 22028 - DNA, 601 bp, Human
agccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgcccccccccggttttctcgccctgtagttcggggctggggccctggcggggattcgggctctttttcacgtctcttttccgccccttctgccgctcaggaggcstccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctat

SEQ ID NO: 22029 - DNA, 601 bp, Human
cgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaarcagtcaggatgtgtttttagggctggatataaggacgctctttggttctggttttccctttagccatgggcaccccggcttcctctccgtgcacaagggcacacccatccgcaggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgctggaggaaggagtggtgactctggggagg

SEQ ID NO: 22030 - DNA, 601 bp, Human
tgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaagcagtcaggatgtgtttttagggctggatataaggacgctctttggttctggttttccytttagccatgggcaccccggcttcctctccgtgcacaagggcacacccatccgcaggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgctggaggaaggagtggtgactctggggagggaggatggaaagcagatttgcagcaagcctcaaataatttgctgtcttcgtgaatgaa

SEQ ID NO: 22031 - DNA, 601 bp, Human
tcattttgacagtgtggggagaaaaaaaaaattaaaagcaaacgatcaacaagacttttttttttttttttttttaaagagcgcccccccccccacaccctttaaaaaatctggttgcattatcataggacctatagcatggtattcctccctccctcaccactggcagcctcttatgtaagagccttctggaaggcactagagtgaacgggggtgtggtgtttcactttttttcatggcatcatgttggctcgggatattcgcggtgatggctggggcaggtaccacagtgactgtggargcaggaggtgaagggggaggcctctccttgccttccaggtgatatttattccatggaagcttagagatctgggagagaagtggaggtcattgtagacagaggacaagtgcactgatttgagtgacctgggcaagtggcctaacctctctgagcctcagtttccttatgtgtcatgggaatagaacctggcctcatctacctcacagatttctttcgaggctctgatgtcatgatgtgcacggctttgtaaaggtctttacacttaccttatacaggtgcaggaattattgttggctattc

SEQ ID NO: 22032 - DNA, 601 bp, Human
attttgagttaactattgccaaaagaatgtcattctttgaaatgtgttgcatattaaaagggcaatgtatggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagratttgctatctcagatacttattcgtgggagtttacctttttcttaacagcctagttaaaatggcatcaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgt

SEQ ID NO: 22033 - DNA, 601 bp, Human
atggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatmaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttgg

SEQ ID NO: 22034 - DNA, 601 bp, Human
agcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatcaatggcrtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttg

SEQ ID NO: 22035 - DNA, 601 bp, Human
aaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccrtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtt

SEQ ID NO: 22036 - DNA, 601 bp, Human
tactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgccyggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcaga

SEQ ID NO: 22037 - DNA, 601 bp, Human
acgcaaacgtgaaagacagtctcctctattgagacagcacatctgctttcttcatcaagaatccaagttggaggggccaaagaaagataccaagttaattactaagtaatacagacaaattactgcctaaatcctgagggaattttaggttttattctaagtggcaactagtgcaaataagactgcccttgtgtttattgtgttaatgttacaaaggagaagcaacagggcagttcctgagtttgggtatttttggacgccagagggttaaggaagctgagttcatcccagtatctgcctrccctttctactggggtagctcccggggctctggagaaatagcacatctgtttgaagacaaacactgcagccagtgacagcttttaaataagcagcattcatcaagggatagctgtaaaccggtccagaggagtggaaaactggagtggctgtgactgttgcctgggagctcacacccagatttatgaacctaaaatagattttaacatttccacgtttaatgttttctccatgtgtgtttgctgtgacagtctcagctccaggctctcaaatgccatgactttgatgttccattttcccc

SEQ ID NO: 22038 - DNA, 601 bp, Human
agaatgacactggcccagaagtgtgcaggcctgtgtgctgtttttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccttctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtag

SEQ ID NO: 22039 - DNA, 601 bp, Human
tttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccytctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaa

SEQ ID NO: 22040 - DNA, 601 bp, Human
taattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaaaagcccacggcacagagcggaggatagtttataggttagtgaaagtagctgtcagatcccatttgagtccacrtttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcagtaagaagcttaaaaatcatcattgtagtgcttaggaagtgtgagagtttgcaaataagtctattgtttgattctc

SEQ ID NO: 22041 - DNA, 601 bp, Human
attatgaatcgtaacaatgatctgaaaagcccacggcacagagcggaggatagtttataggttagtgaaagtagctgtcagatcccatttgagtccacgtttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctrgctgggggaaccactatgatcagtaagaagcttaaaaatcatcattgtagtgcttaggaagtgtgagagtttgcaaataagtctattgtttgattctctccttctaaaacttgctgtcctgagccacagttcaatctaccaaataagggggtgaggatgtgttaaccatttgtcttatttatttatgctcattttctgtcaaattttaagttctcccattgaactagagaatatggttctaaggagtttggtaagatgaatgacttcttgctttctctccatgtggacttttgtcttcct

SEQ ID NO: 22042 - DNA, 601 bp, Human
aacacctattgctttagggttctggggacttccaggcttagaaacaccatgtgctgtgagtgacatggcaagagggaaatctctaggtactagaatgatagaaaatgccccggaatgaaaagcaagagtcttgggtttatttctctgatcttccacagactaactgtgtgaccctgggtaatttgctgaaattttatgggtctcagttttttaaacatttctcatatatgagggtcttggactagatgtcctctaagattctttccagcacaaagcttccacataaaagaaaataggtaamctttgacttttctcacttttgatcatgcggagactccaagtggtttaactgtggatacttagactgaatctgctccaaaccaggcaggagggttaccatggtaactgttgcctggcaacgggagaagggccaggatgtccagaggcatttaactcaggcagctcccagcaccccccaggtggcttgaattaagctccaaggctgcgaggttgtcaggacaattgtttaaaattgtgatgaatgttgggcagggatgtttggtctggtgcctagggaggcaagaactccaagacgccagga

SEQ ID NO: 22043 - DNA, 601 bp, Human
agactgaatctgctccaaaccaggcaggagggttaccatggtaactgttgcctggcaacgggagaagggccaggatgtccagaggcatttaactcaggcagctcccagcaccccccaggtggcttgaattaagctccaaggctgcgaggttgtcaggacaattgtttaaaattgtgatgaatgttgggcagggatgtttggtctggtgcctagggaggcaagaactccaagacgccaggatgagaattgcgacatctgcttgttgaactaatggaccttttcttacttaaaaaatcatttkcttaaaaatcagcatggaaggcagtctgtctgccaaagaaaagacatttatcacagttcttcataggcagaaacttctaattcattttcttgttacagtcgcaacagacttgtttggtagaggcagcttaaaaaattaactgtggtaaaataaatataacattcaagttaccatcttaaccatttttaagtgtgtgtgcagttcattgttttaaaatacactcataatgttgttgcaaccatcaccaccctccatccacaggtctctttatcttgcaaaactaaaacactacactcactc

SEQ ID NO: 22044 - DNA, 601 bp, Human
accatcttaaccatttttaagtgtgtgtgcagttcattgttttaaaatacactcataatgttgttgcaaccatcaccaccctccatccacaggtctctttatcttgcaaaactaaaacactacactcactcattaaacactaactctccactgtccttcaccccagtccctggcaactgctgttgtactttctgtctgtgaaattgacttctagggacctcatacaagtggaatcatatagtatttgtccttttgcaactggcttatttcatttaccatgatgtccttaaggtttctccawgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctg

SEQ ID NO: 22045 - DNA, 601 bp, Human
actggcttatttcatttaccatgatgtccttaaggtttctccatgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacawtcacaggttatttatatggtactctgcttcctttaccattctgtgtctccatttctctcctctctctttctctgtactgaaacacacacacacacacacacacacacacacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggca

SEQ ID NO: 22046 - DNA, 601 bp, Human
gaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacccacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgt

SEQ ID NO: 22047 - DNA, 601 bp, Human
ggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacacacacacgtacacacacagacagtattatcackttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtg

SEQ ID NO: 22048 - DNA, 601 bp, Human
cttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtgccctggcccscagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatagaatcgcctaggtgtcctgtttctcatcccagaaatgcctctggtggggagatgattgtctt

SEQ ID NO: 22049 - DNA, 601 bp, Human
tggatgcagttactgatgtaactgagccttggaagagagtatgaacgcagtgccctggcccccagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatasaatcgcctaggtgtcctgtttctcatcccagaaatgcctctggtggggagatgattgtctttgtgaacaggaagatggaagtccctgtctctgatcccacccttgtctctctctcagatttatgaagtactgagtgtgatccgggatattggcgccatagcccaagtccacgcagaaaatggcgacatcattgcagaggtacagggctttctttttcgtcatttcttcatcacctggagggtgagaggcaggctcaagaaagggaagctgcatctgtagcttaacaccaaggtggaaaag

SEQ ID NO: 22050 - DNA, 601 bp, Human
ctgactgtggtctttctgagaagctgtgggtcacgtgtgtgtctgtctgtctacgcaggcaaagtgaagtgttagattgctcctgagggtaaggtggtgtggactgtttcgccagaagattcttctttctgtctgtaattcttcaagcccttgcttgtatagacacaaacagttcttcattggcatcctgcaatgtagattttagtggttcacaacttatggtctccaatatcttaccaaaattcaccaaaacgtagttggaaggatggaaaagctcttctaaatgcctagaaggcgtgtkgggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcct

SEQ ID NO: 22051 - DNA, 601 bp, Human
accaaaacgtagttggaaggatggaaaagctcttctaaatgcctagaaggcgtgtggggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggytccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcccgggagggaggagcttggcaagagctccctgcagggctgtggccactgagtcactgagtgtcagcaccgtgccaccaccctgagttt

SEQ ID NO: 22052 - DNA, 601 bp, Human
cagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgcygagcagtgggggaagatcaccaagggcctgagtggaggctgacagtgaggaggctccagaagcccgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgagggg

SEQ ID NO: 22053 - DNA, 601 bp, Human
aagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagccygggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccact

SEQ ID NO: 22054 - DNA, 601 bp, Human
tcactatattgcccaggcaggtctcgaactcctgggctcaagctatcctcccacctcttagcctccctgagagctgggattacaggcgtgagccaccgtgcccggccgaggctgattttatgcacatttgtgtgcacacagatccacgtgcacaagcacacacacgtgcacacactcacgttcacacacatatacatacacacatccataggcacagacatgcacgtgtacacacacagacacattttagcatacgcacatgtgcacaggcacagacacgcacatatgtgttgtacccacrtattttcacatacacatatacacatgtacaagcacagacacgcataggtgtacacacacattttcacacacacatgcacatatgcgcttgcacacacctatgcaggcaccatccccctttgcagacaccgcaagggttcgtttctgtggtttcacttctccctctgggccggcttctgtgactgccctcgccagattccccaggatccacctgtcgggtggtttaaaccatggcagcataagccatggttgctctcagccctgacctccctggaattgggctttgttcccagggctttgt

SEQ ID NO: 22055 - DNA, 601 bp, Human
tgggccttggaaatgcacagagtccgggagaggtggagggctgacacagttctcacgtgagccctgttcaaagctgccttcatttagtgctcacgtgtgctggacactgtgttcctggcccacatttcagttttgtaactgtcctgtgcaggaggtacaacatctccttcccacaactccaggggatgccattcatgcaggctgcatggctgtattcagggagcaccatttacattctactgcccatgagtggtggtaccagagctgtgctgcagtgggctccttggttatctctctttakatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccc

SEQ ID NO: 22056 - DNA, 601 bp, Human
cttctgcaaatgctacatgaggctcctgctgagaccctcactcttcaagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttayaatcatggtggaaggtgaaggggaagcaggttccgtcttatgtggcggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagc

SEQ ID NO: 22057 - DNA, 601 bp, Human
aagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttataatcatggtggaaggtgaaggggaagcaggttccgtcttatgtggyggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtc

SEQ ID NO: 22058 - DNA, 601 bp, Human
cattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggccyctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaact

SEQ ID NO: 22059 - DNA, 601 bp, Human
gatgcaccagtatgggatgcagtttttcagctgatttagaggcctctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacytggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgccaatccgggcagtgcctggcattg

SEQ ID NO: 22060 - DNA, 601 bp, Human
gaatttgacagtggctctgagctgtaagactgatgtctgggaagagagtggggacttggagatgaggataatgaagaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcraaaccccgtgttgggacaataaatggagtagtcacctgtatctctgggaggtgctgagggttctagtggagtccatctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatga

SEQ ID NO: 22061 - DNA, 601 bp, Human
gaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcgaaaccccgtgttgggacaataaatggagtagtcacctgtatctctgggaggtgctgagggttctagtggagtccrtctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatgaagttgtctcagctctgctaaattagattaccagttaatgcaattacagaatttaatcttttggccaagctctggt

SEQ ID NO: 22062 - DNA, 601 bp, Human
tcagctcactgcaacctccgcctcctgggttccagcgattctcctgcctcagcctcctgagtagttggaattacaggcatgcgccaccatgcctggctaattttttttttttttaatttttaatagagacagagtttcaccatgttggtcaggctggtctcgaactcctgacctcaggtgatccacactcctcagcctcccaaagtgctgggattacaggtgtgagccaccacactgactggaacatccgatttaaagcgccagattatttactcaagcagttcttcaatcttgtgctgarggtcgtaccaggctgtggctggccatgtctgtgcttcacacacagggggccattggtgtagacaaacggggcccactccgttcctagagccctgtgaggctgcattgtttcgtgggtgatgctgacttcattcatgagcatttaatgggagcccagcacaaactccacatcactgaatatcttgactcaagaccctgggagcagaatgaatatatggaattgagagcaatcagtgtctgtgtgtggcggttctcaaacgttagtaagtgtgaaaatcacccacattgctgggtcccgccc

SEQ ID NO: 22063 - DNA, 601 bp, Human
ctgtgagtttctagtccagggcagagccagaaaatctgcatttcttacagactctgggccagtgctgatgtcacaggcttgctgcctgcacctggagaagggtcagaagggagttttcttttctttttcttttgagacttagtctcactttgttgcccaggttggagtatggtggtgcaatctcagcttactgccacctctgcctgctgggttcaagtgattctcctgccttatactcccaagtagctgggattacagtcacctgctgccatgcccagcttttttttttttttttttttttaattgtatttgtagtagatacggagtttcaccatgttggccaggctggtcttgaactcctgatctcaggtaatccacctgcctcagcctcccaaagtgctgggattacaggcatgagccactgtgtccagccacaggagggaattagttcaaccaaaccaatgttgagagacacaaggcaagtcatactcctttgaattgtcccctggggtaggaccttggagaccagcagcctcgccttcatcttagcctctctctggggtggaggataaaggtagcggctcgtggggtgggctgagcc

SEQ ID NO: 22064 - DNA, 601 bp, Human
tgagccacattctcatgctctgctgctgttttgcaggtcgaggccgaagccgtgaatcgtgccatcaccatcgccaaccagaccaactgcccgctgtatatcaccaaggtgatgagcaaaagctctgctgaggtcatcgcccaggcacggaagaagggtgagtgctgtggccggactggctgatggcaggtggggaggtttggaggggaggggggctcctcactagggagggctccttttccagaccctcatgccaagtgggccacttgcaccatgttctggcattaacctaattacagcmgggcaaggcaggagctccagtttcctcctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccag

SEQ ID NO: 22065 - DNA, 601 bp, Human
ctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccagacactatcacatccagatgttttggtgyttgataaactctcttgatgcattctgaactggggctgggtctctggtattactagggtgtccactgtaactaattgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaa

SEQ ID NO: 22066 - DNA, 601 bp, Human
ttgatgcattctgaactggggctgggtctctggtattactagggtgtccactgtaactaattgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttctcccttcctttctcccttttatgttccctcctcccctttgcttgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaatt

SEQ ID NO: 22067 - DNA, 601 bp, Human
agggtgtccactgtaactaattgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttcttccttcctttctcccttttatgttccctcctcccctttgcytgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatga

SEQ ID NO: 22068 - DNA, 601 bp, Human
tttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatgacttccagacggacccagcgactcctggccctggttctttggagtgctcctggggcctctgtccttaggctacacatcaaatggttgccgcctttctgtcttctcctggcaccttgaaggaattgccttttagaaataagaaagcattcacctaaaataatgtaacctactcagaatgagctttgagttgttttctaggagatattgtggatgacgatggaatcggtggccttgggccacccagacacgcatttgcaagaaggcagcgcatttgtgggaatcagcctctgtacagaaggccggccacagcactgctgcccccacgtagtgtggggatggttggcatagtgtctgaaagggggaaagaatgagacggcttattttctgtattttactactgcgctgtacctagatgatgatgatacgtgagttaggctaacatttca

SEQ ID NO: 22069 - DNA, 601 bp, Human
aattttggatagagaacttgtctaaagtttacttcatattcaaacctgtccaaatgagaagacggaggggtcctacatgtcccagactttagttgggggaggtggagtcgtgggccagccctgccgcaggcctcctcctctctgtccctcagggttcttctcaggtggagttgcggagctggagtgtgttgttgcggtgcccagtatggacctattaccccaactcagtgcctggtagcccccgttgttgttttttttaatttattttattttatttttgagatggagtctcactctgtcrcccaggcaggcgtgcagtggtgccatctcagctcactgcagtctccgcctcctggactcaagcgattctcccgcctcagcctccttagttgctgggattacaggcgcccccccatcacacccatctaatttttatatttttagtagagacggggtttcaccatgttgaccaggctggtctggaactcctgacctcaggtgatctgcccgcctcggtctcccaaaatactgggattacaggcatgagccactgcacctggccacccctattgtctttataaccttgacacactgtgtgtct

SEQ ID NO: 22070 - DNA, 601 bp, Human
taaccttgagcttgcgaggaaagcagagtaaagatgcctgctgaccctggacaagggttttctgctcagaattgtttgtccacttcaggtgggttcttctggccccctgaggcaagtgtgtgcactgccacagccccctttctgatgctgcatttcttcctctgtgaatggagagattctgaattcattgaatgcattttcatgatgtgatactttaggcctgcgtaccaggaaaataaatggtcccaaccacagttagctcctcgacttgcaggggaaggatgctgagtggaaagtcacrttgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggagaaacgaatgagaactgttttcacgtgcctgcttgagccagcacga

SEQ ID NO: 22071 - DNA, 601 bp, Human
gttagctcctcgacttgcaggggaaggatgctgagtggaaagtcacgttgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggwgaaacgaatgagaactgttttcacgtgcctgcttgagccagcacgactgcatcctgccttccctgagagacatgctgagagacacgctgcttccatcagccgctctgtggctgttcagcaggatggcgtgttcagccggggagtggtgtgtcatcaacccaatttggcagctgaggcaatgaacacagagccaggaccagaagacctgggggcatttttactcttgaaaagaacttagacattgatcaacttaataggctcatttcatggaagaagtagaaatgcagaaattgaaaatct

SEQ ID NO: 22072 - DNA, 601 bp, Human
ccccttgtggggatttcttctctagaatgggctccctctgaccacattttgtccatgtgtgaaatccagcatgactgctgatgccttccatgtgtgagtggtggccgtgggcagtgcctgatgacctcatctgatggacattcttttccgtcctcctcctcacccctctcccataacccgggtgcagaaacattcaggacattaaaccctgggaacctcaatttgagataagacctcttatgtcctgtgggtcaataggagtgactcaaacgttatgagaagcacatggtcgcagggcctstgaggaccacctcagcttggggatgagtccttagttaagcttatgcttgatgttgcaatcttgaacagaaaagggggatgagagaggagagaggacagtagagaaagggggaagatttattttaaagaattatatttaaggaatcaactcacacgattgtggggatggcaagtctgaaatctgcagatcaggccacagactggagaaccaaggaagagctgatgttggcatcggagtccaaaggcagaattccttcccaatctatgccctcacttttaacggcagatggtctgcaaggtt

SEQ ID NO: 22073 - DNA, 601 bp, Human
acaaaaatgtttaaggtatctgctacacacccacctagaaccttgcctcttagaagcctttgggagtatttaataatattttctgtgtctctattgtcccatcatgccctgtactctcctctttttactactggacgtagaatcattagtgcctttcaacccaatcagatctgagaacgaatttcagaaacctcagaacccattcagaaaactcatttttaagatgatgttcttctagaaccactcttgctacgaaaacctgacagcacagtccccaggctgtttgttagggtctggcatraattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggcctta

SEQ ID NO: 22074 - DNA, 601 bp, Human
ccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctgkctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactg

SEQ ID NO: 22075 - DNA, 601 bp, Human
ggctggtctcgagttcccgggtttaagcaatgcctcggcctcccaaagtgctgggattacaggtgtgagccaccacgcctggcttacctgtatatttcttatcattatcatcaatggaacagtaaagactgaaaacctacacagctttagatgtgactctgggtcagtcaggaacaaacttccttagcaaccaggtgacttactcagttaatcctcgtctactcttggaaatgggctcaatttccttaaaagtgtcttttagggctctctggacttagcatgtcttctactgccagcttcyagtaggcctgctatgaacatacactgacctttagaggatctttgggctttttcattttaatgttttaaaatatattaacagaataggttttctgttttttagtgaattgtttagattatatgaagaatatatccttatttccagaagaataaggaagtaaataaaagtcactgtgtttcagatataaccacaattaacattttggcaaatgtctttccattttttgctactacacaggcacacacatgtatatgtgacatgcgtgagtgtgtaaataatattggcatcatacagctgggc

SEQ ID NO: 22076 - DNA, 601 bp, Human
tgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtctcattgttttacatttaatttattcaattactgattagagtgaaaa

SEQ ID NO: 22077 - DNA, 601 bp, Human
gagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagraatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctgggacc

SEQ ID NO: 22078 - DNA, 601 bp, Human
tgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttkcaatttgctgggaaaagaatagttatttcattttctttagtgaggtcaataagattgttactctcataatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccag

SEQ ID NO: 22079 - DNA, 601 bp, Human
tacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttgcaatttgctgggaaaagaatagttatttcattttctttagtgaggtcaataagattgttactctcayaatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccagtatccatgcagaaaactggatgacagccattcttattatcttaaaggaattgattgactgacttctc

SEQ ID NO: 22080 - DNA, 601 bp, Human
ctctcctgagatgcccactggggactttgatcctcttaagccattgttttctcaggccagtatccatgcagaaaactggatgacagccattcttattatcttaaaggaattgattgactgacttctccctaacagaagtaccccccagccatttgattgttgttttaggatctgccgctttgggtatctcttccctctgggtctgggctttagagcttagagatgtcctctcttgttaacaggacccagggcaagtctgttaatgtcttacgctcctcagctgagagtgaggggttcagamgaggtctccaagtgtcctgtgattctgtgaggtcagcagacattaagcagagttgttagacactgccgattcctcacaagcaacatggtataggcagaaaaactgaaggaatatgcccagagggagagctttggaaaagaaatgggcctcgggcagaagagtttcgtgtcaggaactcatttgaatcttgaagacagctcaggccagcaagcactgacacctcccccacacaccacgacagcttagggcaggtttctggcatttctccgggacaaccctgggactttgccctgtcccagt

SEQ ID NO: 22081 - DNA, 601 bp, Human
catatccccctagaagaacttggatttagtctaggctggcagtacccgcgtggctccggctgctataagacacattctgacttcagggatgagtgtcttagaattgatgaaagacaattttaagtcttgggtctcagtaatccaagtgcagagtcctcttccctccctgctggcgcctctctgctatggttcctttggtagcttctgcatgactgctttgagactcagagcaatgtactgacagccctcgtggttgttttcacccaacattgtatgcggggcattgtgcatttacatgccygatgtgagctgctgagctggccgaatccgtgttaccagccgctgcactaagcagaaatgtcatcttgaactgcagggtgctagcacagctctctgttcagaggccagctccctgagtgctgataacctggtctgaactttcccagaagcccagggtgctttttatggttggagcaacctattaatcctctagtccagactcagccacagccattggtccccgtgaaccaaacaggcaggaagaagcgggaggcatttgggatctgggaagtagcactgggttagcagaagctgcaggatg

SEQ ID NO: 22082 - DNA, 601 bp, Human
ggatgagtgtcttagaattgatgaaagacaattttaagtcttgggtctcagtaatccaagtgcagagtcctcttccctccctgctggcgcctctctgctatggttcctttggtagcttctgcatgactgctttgagactcagagcaatgtactgacagccctcgtggttgttttcacccaacattgtatgcggggcattgtgcatttacatgcccgatgtgagctgctgagctggccgaatccgtgttaccagccgctgcactaagcagaaatgtcatcttgaactgcagggtgctagcacagctctctgttcagaggccagctccctgagtgctgataacctggtctgaactttcccagaagcccagggtgctttttatggttggagcaacctattaatcctctagtccagactcagccacagccattggtccccgtgaaccaaacaggcaggaagaagcgggaggcatttgggatctgggaagtagcactgggttagcagaagctgcaggatggaatgactcctgtgcaatgactcctgtgttctgttgcttcattaccaaccacaaactcacatccatatggagaccccacctatttt

SEQ ID NO: 22083 - DNA, 601 bp, Human
gtagcactgggttagcagaagctgcaggatggaatgactcctgtgcaatgactcctgtgttctgttgcttcattaccaaccacaaactcacatccatatggagaccccacctattttccaagagggcacacagatatgtctctgttttacccggaaaaacttgaaaccagaaggatagctacatagctacattgttctggaaattaactagccctcaatcattttatcggaggcatgtctcttcagtgaccacaatcctttcatttagggacttcagtttaaccacaccgcaaacagactrgaaaaccaggctagccagtgggaaaacctacttgtggatggctcatttcaagattaaatttagaacttggtcagagaaggcctttggaattcaaccggaatggagctggagatggtgggaacacagtctctgttaataggaagaatcattttctttatatttgtgtagcatttacaaacatgcacccttttcacacaattattctgtttaattatttttctttctaatgtggagaggtagaaaaagttatttcatattctagacagggaaatggagacacagcaagtaagtgcctgctgg

SEQ ID NO: 22084 - DNA, 601 bp, Human
cgaattaagttcaaggccacaaacatttattaagcaccttgagacagaatattaagatgaatttagtggattccagggataagagggagcctgaattttttattcctggcatttaaaatactggagaaggagtcagtcgtgtccacagagagccctagcaaagtgagatcatggtatatgctatgataaggagtgtggagtaaggacccagaggagggagccactgctgtagttggggagagtgtcatggggagaggacattttgagttgggctttgaaggttaagtaggagtttgtcaartcaaagaagggagatgagggaatttgataagagtatcatgagcatagaaaatgtacagtgtattcagggcatgtgaagcaggaaagagatggagctataagggaattaaaaggagagaatgcaattggaaagaaagtttggggccagatcttgaacatgataccagatccgcctcacagcatgcttaggggattcttacagggtttaaagttgaagtgtcttgggggaaaaattgtaaggtgtgttagtttttgtagagttaaccagttactggaccttgtggggagttttggcctggca

SEQ ID NO: 22085 - DNA, 601 bp, Human
attcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacaygtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacacta

SEQ ID NO: 22086 - DNA, 601 bp, Human
tcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagatactagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcct

SEQ ID NO: 22087 - DNA, 601 bp, Human
ttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggayttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaggggtgtgtctgtattgagatgttcgggaggcggctgcttgacttgggcctccaaccagacttcccc

SEQ ID NO: 22088 - DNA, 601 bp, Human
ttctccattagcaggaagcaacaagcatgaactatgcctctgtacaactcctaggtagtttttctagaacttgtttctcaagttgacatagctctttctttccaattctgacaggtatacaataaaaggcatcaggaacctgattttctatgaactgccgacatatccacacttttacagtgaaatctgtaatatgctgagagccaccaacagaggagaagaggccacgtggacctgcactgttctctactccaaatatgatgcccagaggttagctgccgtggttggtgtggagcgggcrgcacagatgctacagtccaacaagaatgtccacctcttcattactggagaaaaatgaaattttgttgggcaggaagtggtatttggcatgatacataatgtttgattctatgccatttggacccaattctgattacttacagaagaaggactgatacaaagaaagtgcatgaggcaatgtcagtattatctgacatctttcttttcaggtcatgtgtccctgaaaagttaaatgtaaaccagattttggtaaatcccatctttcagaagtgaagagggggctagaaggactctgagaagt

SEQ ID NO: 22089 - DNA, 601 bp, Human
agaaagcatgcaaaacatttaacattgtgcctggcacatactacacactcaataaaaagtagctcttatcaaaattttttgtgctaagtcctgggttaagaattgggatgtggaataaacaagatatgtaagatatgagagtaagtaagtctccttactctcaaaggagactaacagtgtcagaattgctatgattgatgaaagcacaagctggttttgtttgtttgtttgtttgtttgtttttgagacagagcctagctctgtcacccagggtggagtgctggagtgcagtggcgccatmttggctcactgcaacctctacctcctgggttcaagtgattcccttgcctcaggtccctgagtagctgggactgcaggcatacaccagcacacccgggtaatttttgtattagtaaagacagggtttcaccatgttgcccaggctgatctcatactcctgagctcaagtgatctgtccgcctcggcctcccaaagtgctgggattacaggcacttaattacagccgccatgcccggccgaccgcaagctgttttgaaagcacacagaagggaaagctagcctagacttgggggctggtaaa

SEQ ID NO: 22090 - DNA, 601 bp, Human
ctatgtgctgctttctcctcatctcaggaaacagaataataatagtacagtacttacttcagagggctgctggctgattgagagaaagcatgcaaaacatttaacattgtgcctggcacatactacacactcaataaaaagtagctcttatcaaaattttttgtgctaagtcctgggttaagaattgggatgtggaataaacaagatatgtaagatatgagagtaagtaagtctccttactctcaaaggagactaacagtgtcagaattgctatgattgatgaaagcacaagctggttttttttgtttgtttgtttgtttgtttttgagacagagcctagctctgtcacccagggtggagtgctggagtgcagtggcgccatcttggctcactgcaacctctacctcctgggttcaagtgattcccttgcctcaggtccctgagtagctgggactgcaggcatacaccagcacacccgggtaatttttgtattagtaaagacagggtttcaccatgttgcccaggctgatctcatactcctgagctcaagtgatctgtccgcctcggcctcccaaagtgctgggattacaggcacttaatt

SEQ ID NO: 22091 - DNA, 601 bp, Human
atatacacagaaaacaatgtttatagtcacagaatgatctgatatgccattcggtgggaccacgtgtcctggtttagtactataaccccaggggtctgatagtgtctagaatatagtgtgtgtaatacttttttcatataaatatttttattattcctttcattttgttctttaagttaaggtgagaaataacatttggagaagaatctaaagagtataaaatagtgcactgttagaagagactgaagaagataatagtaaatcatttaaagaacaggtatgggaactcagctatcttttaagtggggtcatctttgctcctaacaaaagattctgtctgggttatttcccacctaagtcttcactcccaattccaccctttcctgaccatttatcagccaatcacagctgatggcagattcaccaggaggaagtcaaagatgcagatgcctccagcaccagctgcctttatgacatggtcagtgtcccagtagaagcttttagccgagctgagtgattatgagaaccgccactagacacggcttcgcccaggaagcttcagagcatcttagggaggaataggggggagactcaggcagaa

SEQ ID NO: 22092 - DNA, 601 bp, Human
tttattttctttttgcatctctaggtttcctaatttatctatgaaggacacaattgcttttgtggttctttgtaagttttactctcgtcacggggaatctgacttccctaatgcagatggccaagcataatacaaatctcaaggatgccaaacaggtccaactccttgcccagatggcagaaagccaagccaagatcactcattcccgtagtcttctatcaaaagcagcctgagtgcacttatcggaaagcaaatgcgtggagctacattactaatgtctggggcaacaccaggactttcrtcagcaggcagctgctgagaagtcagcaggcttccacccttcagctggagaattgcaccctgaattgcaccttttatggctttggtgcaatttttctgggcttccacacccaactagctgaagctgaaccctgcttatgctcctgtcaaaaggaagtaaaagacagtgaataattctacagctcaggctgtcctgtgttctcaggggatgtatatggtgttaaaataaacagtgctctctgcctgaccaagtttggggccagcactgggatggggcccaattcatcaggattcctttggg

SEQ ID NO: 22093 - DNA, 601 bp, Human
taaatgaggctgtatacaaaattttggttccaaggatgtttgctacttatttatctaagtgaaaaattggaaacaattgaaattgttaacaatagagaagttaggttaaatacataaatgctttataaaatggatgactaggaatccactttaaatgttggggtagaacaaaaatgaatgcaaagatacccatgacatattatttagcaaaaatggaaggttaaaatataatacatatactgtgatcctagtttggccaaataggattttaaaaatgtgtacaatatacagccaaactctmacagcgatgtgggattaggaggtttattttctttttgcatctctaggtttcctaatttatctatgaaggacacaattgcttttgtggttctttgtaagttttactctcgtcacggggaatctgacttccctaatgcagatggccaagcataatacaaatctcaaggatgccaaacaggtccaactccttgcccagatggcagaaagccaagccaagatcactcattcccgtagtcttctatcaaaagcagcctgagtgcacttatcggaaagcaaatgcgtggagctacattactaatgt

SEQ ID NO: 22094 - DNA, 601 bp, Human
agctggtgtcagttacataaacctgatactgggcccgcagatcttatttccatggaaacttcttgtcaagaatctggtttctttgaggcccaaatctactctttcacccacaaccatggatacattttttttaaacaatggcatctacagttgatgaagaaaaggcaaaagttacactttcatagttcccctgaacagctgaggcaaagtacaagtaaggacaaagtacagctaaggacaactttccagagagcagctctgaaatatacataaaaaacccggacatttttcaaaccttaacccaacatttattcccacacctacgaattattcctagggaaataaatgaggctgtatacaaaattttggttccaaggatgtttgctacttatttatctaagtgaaaaattggaaacaattgaaattgttaacaatagagaagttaggttaaatacataaatgctttataaaatggatgactaggaatccactttaaatgttggggtagaacaaaaatgaatgcaaagatacccatgacatattatttagcaaaaatggaaggttaaaatataatacatatactgtgatcctagtttggcca

SEQ ID NO: 22095 - DNA, 601 bp, Human
attatcaaatggatgaagaaagctcactctttttttttcgggctgtctcctcctagcaaaggccaatcttgagatgtttctgagaaacaaaacccttcctaagacacatctgtccatctattccattaagcagcccaggagatggagagataactgcttccttcttccttacaaatgatcaatttgggccttggggccctcactttcgtcactctttcctcaagtttctcaatatgatttctaggaatccagtgagacctttgctcctcatgagacctaaattctctattatctaaggctrtgagttccacagacttggatccaatctctggcttctgagaaatgctgccttacggtctttctttatgacagagaatgtcttgtagctttgacacattttcagaagagaatcagcaaatgctctcccattaaatgttccaatttgaaatcctcctcttccaggatgccttttctgattctccaacaatggccagccctctttctgttttacctcatcttctagtttcattgcttgtctacattcccctctgtttcttccacctaaattgtgaggtaccttggagcaggttctgtctttagc

SEQ ID NO: 22096 - DNA, 601 bp, Human
aacattcaagggtgatttgtttttattagaagaaagatagttgtctgttagactattttttgtctatactgcccttcaagaatcataccaggtcacttattgttcatctctctcagtctcagctgcctctgaaactatacttgcttatctcatttgtttattcactcatgctctttaagccatttcactcaacaaaatgtattgagcaactgcttcctcctaggctctgggtaagtacctgcattaaagcaatgttagcccctgacctcacggggcttataatttagtgctatgtttcccraagtgtgggccactcatcacttacatcagaattgcctgaattgtttttgtagaaatgcagatttctcacccatcctagcctaacatatcagaagatgtcaggttgaatcctagaaatgcatattttaataagccactcaggagttttgatgttttaaatctatggcttaaatgaatggattcaaaatttaacgaaacaaaatagtgcctccaaacagcattacctaagttagtgtcttggtgaaattctgtttaaccaagttgtggacatggcagaagaagtgcatgtcccttgtggttg

SEQ ID NO: 22097 - DNA, 601 bp, Human
gttgcaatatagggtagactcaactaaaaggataaaaagaaaaaacattcaagggtgatttgtttttattagaagaaagatagttgtctgttagactattttttgtctatactgcccttcaagaatcataccaggtcacttattgttcatctctctcagtctcagctgcctctgaaactatacttgcttatctcatttgtttattcactcatgctctttaagccatttcactcaacaaaatgtattgagcaactgcttcctcctaggctctgggtaagtacctgcattaaagcaatgttakcccctgacctcacggggcttataatttagtgctatgtttcccgaagtgtgggccactcatcacttacatcagaattgcctgaattgtttttgtagaaatgcagatttctcacccatcctagcctaacatatcagaagatgtcaggttgaatcctagaaatgcatattttaataagccactcaggagttttgatgttttaaatctatggcttaaatgaatggattcaaaatttaacgaaacaaaatagtgcctccaaacagcattacctaagttagtgtcttggtgaaattctgtttaacc

SEQ ID NO: 22098 - DNA, 601 bp, Human
aagatctaaagaataaatatgcgtatgttgaacagatgtattaatcctatatttggagttgcaatatagggtagactcaactaaaaggataaaaagaaaaaacattcaagggtgatttgtttttattagaagaaagatagttgtctgttagactattttttgtctatactgcccttcaagaatcataccaggtcacttattgttcatctctctcagtctcagctgcctctgaaactatacttgcttatctcatttgtttattcactcatgctctttaagccatttcactcaacaaaatgtwttgagcaactgcttcctcctaggctctgggtaagtacctgcattaaagcaatgttagcccctgacctcacggggcttataatttagtgctatgtttcccgaagtgtgggccactcatcacttacatcagaattgcctgaattgtttttgtagaaatgcagatttctcacccatcctagcctaacatatcagaagatgtcaggttgaatcctagaaatgcatattttaataagccactcaggagttttgatgttttaaatctatggcttaaatgaatggattcaaaatttaacgaaacaaa

SEQ ID NO: 22099 - DNA, 601 bp, Human
agatttggaaaaattacgctggtatgttctgatctaaagatctaaagaataaatatgcgtatgttgaacagatgtattaatcctatatttggagttgcaatatagggtagactcaactaaaaggataaaaagaaaaaacattcaagggtgatttgtttttattagaagaaagatagttgtctgttagactattttttgtctatactgcccttcaagaatcataccaggtcacttattgttcatctctctcagtctcagctgcctctgaaactatacttgcttatctcatttgtttattcaytcatgctctttaagccatttcactcaacaaaatgtattgagcaactgcttcctcctaggctctgggtaagtacctgcattaaagcaatgttagcccctgacctcacggggcttataatttagtgctatgtttcccgaagtgtgggccactcatcacttacatcagaattgcctgaattgtttttgtagaaatgcagatttctcacccatcctagcctaacatatcagaagatgtcaggttgaatcctagaaatgcatattttaataagccactcaggagttttgatgttttaaatctatg

SEQ ID NO: 22100 - DNA, 601 bp, Human
caatattttgcaggactcgaaataagggaataagtggaaatgtctatgagattcacactgagatttccttaagaaagggattagaaatttaacactcctgaatagctgtgaaggacactccaacttgtgttatctgtagggagattaggggtcagaaataagcatgtctcttacattcctttctaattttctcacgggctcctgagttagagtcaatcagaagtggtctttggaagaaatgttccaatactgcaacctggtactcacattctcgtcgccttttaacaatgtttattcatgmgttgtgtgtgcaccttcatcccctgtaacttacctcttctggcctgctcagtacatggccttctgggccagttatccccatttccaacatgcgggtttgctcctgaaatgaaaaaagaaaatagttcttcaataagctcaagtgagatttggaaaaattacgctggtatgttctgatctaaagatctaaagaataaatatgcgtatgttgaacagatgtattaatcctatatttggagttgcaatatagggtagactcaactaaaaggataaaaagaaaaaacattcaagggtgatttgt

SEQ ID NO: 22101 - DNA, 601 bp, Human
gtgagggcagaaggagttcctacacacttcttctttttcttttctttgcttttctccaagaatgagtgaggagcactgggctgctttcctggttctcgcccaatgactcatacccagtggagcaaccactccatgtcagttgaaacttctaaaagctaaggagaaaacagcaggcctacgaagaacagaggaaggaaggaggtgccccagaatctgtcagctaggaagagtgtctagacaatgtgaaagcctcccctcttgtaagaaaaatagggtcaccctgtgccagaaggccaggcakctgaacactcagccatcagcgtcagctgagactatttttagctactgcaatcactcacacgtggagtttcacaggccagtttggtagatgaatcacccatgttgggcctctctactaccagaatggccactggcacgcagcagtagcaaccacatcactgggcctggtaaatcctctcacaacccaacacagagccacacatctgcagcttctcacctgcactcgtcccttacccagcctcacaactgagcccacgagtctgacactgaggatgagaaccagaaacagaaaagaaagctc

SEQ ID NO: 22102 - DNA, 601 bp, Human
cctgtcccgagcggccctaggtcaccctaagaatgggtcccgggcagaatgcagcctcagcagagggcatgagggcggtgggtggtcacagttggcaggggtgtgtgtgtgcggcactgggtgagggcagaaggagttcctacacacttcttctttttcttttctttgcttttctccaagaatgagtgaggagcactgggctgctttcctggttctcgcccaatgactcatacccagtggagcaaccactccatgtcagttgaaacttctaaaagctaaggagaaaacagcaggcctacgragaacagaggaaggaaggaggtgccccagaatctgtcagctaggaagagtgtctagacaatgtgaaagcctcccctcttgtaagaaaaatagggtcaccctgtgccagaaggccaggcatctgaacactcagccatcagcgtcagctgagactatttttagctactgcaatcactcacacgtggagtttcacaggccagtttggtagatgaatcacccatgttgggcctctctactaccagaatggccactggcacgcagcagtagcaaccacatcactgggcctggtaaatcctctcac

SEQ ID NO: 22103 - DNA, 601 bp, Human
aaaagtcacccaataacctaggacacatcaaatatgagactagcttcttggattctgcctcaaaaattagaggcctaactacccaaaccatggagaggggataaaggctattggaatatacactgatctaagctgtttagcttctttaagaagaaggaatagtgatatagaaagcaaatgctagctcatagctaggtggttggtaccaagtttctctatgccaaaatctggggccaaagctaccctatacagccctgcacttctttaactttggtcctccaacttccacagttaaattctgcacaagtttgcactctatggccaggatcacaaatagattttgccttgtttcaactccattcaactggtaatagttgcctagaattccatgaagggaaaaattctaataatgcgcggggtctcagtagaaaagactcatgattaattagtaatgtctgccataggcaaaagaaggaagcgatggcaatgattcacattggacagccctgcttttgggggtgagagtaaaaaaaaatccaagtgatgagaattcaagggctctccaaaaatacttacacactaaaggatacaggaccataaa

SEQ ID NO: 22104 - DNA, 601 bp, Human
cggcctcccaaagtgctgggattacaggcgtgagccaccgcgcccggcctatgacttttttttttatcatgtttgttactcctaacatgatgacttggtaaaagtcacccaataacctaggacacatcaaatatgagactagcttcttggattctgcctcaaaaattagaggcctaactacccaaaccatggagaggggataaaggctattggaatatacactgatctaagctgtttagcttctttaagaagaaggaatagtgatatagaaagcaaatgctagctcatagctaggtggttggtaccaagtttctctatgccaaaatctggggccaaagctaccctatacagccctgcacttctttaactttggtcctccaacttccacagttaaattctccacaagtttgcactctatggccaggatcacaaatagattttgccttgtttcaactccattcaactggtaatagttgcctagaattccatgaagggaaaaattctaataatgcgcggggtctcagtagaaaagactcatgattaattagtaatgtctgccataggcaaaagaaggaagcgatggcaatgattcacattggac

SEQ ID NO: 22105 - DNA, 601 bp, Human
atgctcccattataatgatatgctttggttccacaaagtaaaatccattcctgtggattagagactctcatgacttttttttttttctttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctygatctcctgacctcgtgatccgcccgcctcggcctcccaaagtgctgggattacaggcgtgagccaccgcgcccggcctatgacttttttttttatcatgtttgttactcctaacatgatgacttggtaaaagtcacccaataacctaggacacatcaaatatgagactagcttcttggattctgcctcaaaaattagaggcctaactacccaaaccatggagaggggataaaggctattggaatatacactgatctaagctgtttagcttctttaagaagaaggaatagtgatatagaa

SEQ ID NO: 22106 - DNA, 601 bp, Human
tccatgtataccaaggctgaaatagatatattctgaaattgatgaaacaagatgatgtctacttcttaggcttgtgaaaatgaaaagatatggcatacgtgaagcatctggcacctagaggatgtttggtaaatatcgctttctttacctgttatgccttcccacagtaggggcccaaagtcccaaatgtgcacccaccactgggaattgctagatgctcccattataatgatatgctttggttccacaaagtaaaatccattcctgtggattagagactctcatgacttttttttttttytttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtcttgatctcctgacctcgtgatccgcccgcctcggcctcccaaagtgctgggattacaggcgtgagccaccgcgcccggcctatgactt

SEQ ID NO: 22107 - DNA, 601 bp, Human
ggtcagggctcaggggtggggatgtcacaaatgcagccgccttggcccagttcttgctccaataatgggttccatctatgccgaggctggcagtgatgggctcaccaaagactacatttcctagaaggggcaggaaacagacaaggggttagcataaagtatatgctgcactgggccaagcctatttaatttagctcctaagcctacccaggactgtgtctcagagtcagactgacctgggttcaagtccatgttcccacctttttaaagcccctgctttcctatctgctaaatgtgaccmagtttgtattctctagattaaaagaagccattggttgttagatgcagtgttaattctcaaattttgaggcaaattaaaatttgaggcaaaagaaaataaaatatacatattgatttcaagattcatcctcatttcagaaatactaaaatgctccagttcttgctctagtaatgggttccatgtataccaaggctgaaatagatatattctgaaattgatgaaacaagatgatgtctacttcttaggcttgtgaaaatgaaaagatatggcatacgtgaagcatctggcacctagaggatg

SEQ ID NO: 22108 - DNA, 601 bp, Human
tagaaagtgagggggtgggattagctcatctcttttgtagcaaaataaaatgtactcaaatgagcaatgtcatgatcctatatgtctgcagagggcagcaacaaaggagtctccctataattttgattgtcatcatgaccaactatttgaacttaggcaaatgatttagcttctctgaccttcagttgcttaatatgtaaatgctgataagagtgcctcactcataaagttgttaggagaaataaatgagattgtgagtgtagtcttaccatagagcttggtacataataggttttaactrctattaccattattaatattatgactgtattaatgtttaaaacaggatggggaagagcctgctttctacgctcaagactgtaaaagaattcccaatacactgttcacactgcagactctggtcaagtttatagatgggactgctcctgtcctcaacccccagctggactcaagagatgttttcacaaaacgcctgctgctgggcattcctgcaccaacctggccagcaaggagttgatgtagtccggagtagttgggtcagggctcaggggtggggatgtcacaaatgcagccgccttgg

SEQ ID NO: 22109 - DNA, 601 bp, Human
ctctggccaccctcccatgacctccatgccttaccacagccttgtcccagatgacagacatccgctcctccacaccattggtgccctcaggaatggctgtgaagttgtccttcccaattgctttctgggcagtgctgaaggtgcagtgggcactcccagatagctgcagatccccgctggcaaaggagaaaagctccacatgaacaggggagatggctggaggcacactgggagcttagagtcttgtgtttactgtgagggtttgcactctgactatttgggtttggaatgcctcctctayctcttactagatatatgagcttggatgagtttcttcccctccctgggctcagttaccccatctagaaagtgagggggtgggattagctcatctcttttgtagcaaaataaaatgtactcaaatgagcaatgtcatgatcctatatgtctgcagagggcagcaacaaaggagtctccctataattttgattgtcatcatgaccaactatttgaacttaggcaaatgatttagcttctctgaccttcagttgcttaatatgtaaatgctgataagagtgcctcactcataaagttgttagga

SEQ ID NO: 22110 - DNA, 601 bp, Human
ccttgtgatgtgaacaaggaaaataaaacaggccacttgccagaagacatttagagacaatcacttgtatcgcctgaatgaccacatgccctcagtacagggcgtccttgataagcaagatgactttggtctagacacagactcattgcttatcatttcaaaggattatatccagttctttcaaaagaagtcataaaactatccaaacaaaaagaattaactcactattattttaagtacaggctattcgtacactcagatgaaggagttgcatgtctggttcctagtcctaacagtctasataaggaagcctccttcagaatgctaggccttaggattcatcacactagaaggaaattttccacactgccagagccacatggttccagagacatctcagcaagtacgagatcccatctgcactcgcagtgtcaccagcccaactggtggcaggaggttctgatctggcccatggatgttttggctctggccaccctcccatgacctccatgccttaccacagccttgtcccagatgacagacatccgctcctccacaccattggtgccctcaggaatggctgtgaagttgtccttcccaa

SEQ ID NO: 22111 - DNA, 601 bp, Human
actaaaatctttgaaagagtcttaatttgaatggctatttctttcgtcagtccttgtgatgtgaacaaggaaaataaaacaggccacttgccagaagacatttagagacaatcacttgtatcgcctgaatgaccacatgccctcagtacagggcgtccttgataagcaagatgactttggtctagacacagactcattgcttatcatttcaaaggattatatccagttctttcaaaagaagtcataaaactatccaaacaaaaagaattaactcactattattttaagtacaggctattcrtacactcagatgaaggagttgcatgtctggttcctagtcctaacagtctagataaggaagcctccttcagaatgctaggccttaggattcatcacactagaaggaaattttccacactgccagagccacatggttccagagacatctcagcaagtacgagatcccatctgcactcgcagtgtcaccagcccaactggtggcaggaggttctgatctggcccatggatgttttggctctggccaccctcccatgacctccatgccttaccacagccttgtcccagatgacagacatccgct

SEQ ID NO: 22112 - DNA, 601 bp, Human
tattccaaatagtgccaggataaatacatacgtactgctctgcagtatatgaaaaaggaaacactatgtgagagaacagacaacaatatttatattttccctcttttcaaaccaaaaagcctctttacggaaagaattgagtttaaaacctagctctgagcttcctgggagcaaagaagaaaaagaaaactcagtgaaattacactgtgtagattaatgaggctttagtatacataactttgataagaatgtttttaggatttttgaaatgaaacatagagcagtaatcaacttaataatragataattattgattttactaaaatctttgaaagagtcttaatttgaatggctatttctttcgtcagtccttgtgatgtgaacaaggaaaataaaacaggccacttgccagaagacatttagagacaatcacttgtatcgcctgaatgaccacatgccctcagtacagggcgtccttgataagcaagatgactttggtctagacacagactcattgcttatcatttcaaaggattatatccagttctttcaaaagaagtcataaaactatccaaacaaaaagaattaactcactattatt

SEQ ID NO: 22113 - DNA, 601 bp, Human
aaatattctttactgagcatgtgtcatgttggtaatttaaaaatatatattatcttggaactattccaaatagtgccaggataaatacatacgtactgctctgcagtatatgaaaaaggaaacactatgtgagagaacagacaacaatatttatattttccctcttttcaaaccaaaaagcctctttacggaaagaattgagtttaaaacctagctctgagcttcctgggagcaaagaagaaaaagaaaactcagtgaaattacactgtgtagattaatgaggctttagtatacataactytgataagaatgtttttaggatttttgaaatgaaacatagagcagtaatcaacttaataatgagataattattgattttactaaaatctttgaaagagtcttaatttgaatggctatttctttcgtcagtccttgtgatgtgaacaaggaaaataaaacaggccacttgccagaagacatttagagacaatcacttgtatcgcctgaatgaccacatgccctcagtacagggcgtccttgataagcaagatgactttggtctagacacagactcattgcttatcatttcaaaggattatat

SEQ ID NO: 22114 - DNA, 601 bp, Human
aaaggagccacctgaaaagctggtgagctacagaacctcactcagcaagctcgaattagctgggctgttgtgactactcaggtaaaatggtcaaacacatggtttaagatagaagttactgccccgaagtatgcatttttttctatatgttcttacatttacttactcattttcttcttctaatttcaaaaaggattatggagagttcacagtaaaaacaaatgtgattataatcccatcctttagatatgtatttgtgtttgcatatgttgtatgcatagaataaatacaaaagaacctyacccaaatgataacaatgggttccctgggttgtggaattgagatatttttgttttctttcaagtgtgtgcttgtctgtagtttccaaatattctttactgagcatgtgtcatgttggtaatttaaaaatatatattatcttggaactattccaaatagtgccaggataaatacatacgtactgctctgcagtatatgaaaaaggaaacactatgtgagagaacagacaacaatatttatattttccctcttttcaaaccaaaaagcctctttacggaaagaattgagtttaaaacctagc

SEQ ID NO: 22115 - DNA, 601 bp, Human
aggttgaagatcttggcagcgtttgtgcttgtcacagccacgaactggttttcgtccattttccctgtggcctattgaaatataagaaattatatctatatctatagctacatatatatcaattcagggcttctgaactcagagaaagacaacccacaaaggcatagaaatacaaaaaggagccacctgaaaagctggtgagctacagaacctcactcagcaagctcgaattagctgggctgttgtgactactcaggtaaaatggtcaaacacatggtttaagatagaagttactgcccctaagtatgcatttttttctatatgttcttacatttacttactcattttcttcttctaatttcaaaaaggattatggagagttcacagtaaaaacaaatgtgattataatcccatcctttagatatgtatttgtgtttgcatatgttgtatgcatagaataaatacaaaagaacctcacccaaatgataacaatgggttccctgggttgtggaattgagatatttttgttttctttcaagtgtgtgcttgtctgtagtttccaaatattctttactgagcatgtgtcatgttggtaatttaa

SEQ ID NO: 22116 - DNA, 601 bp, Human
tcccagatgacgaggtcgctgtcagaacccacagatattcttcccttgcggggatacaggttgaagatcttggcagcgtttgtgcttgtcacagccacgaactggttttcgtccattttccctgtggcctattgaaatataagaaattatatctatatctatagctacatatatatcaattcagggcttctgaactcagagaaagacaacccacaaaggcatagaaatacaaaaaggagccacctgaaaagctggtgagctacagaacctcactcagcaagctcgaattagctgggctgtygtgactactcaggtaaaatggtcaaacacatggtttaagatagaagttactgccccgaagtatgcatttttttctatatgttcttacatttacttactcattttcttcttctaatttcaaaaaggattatggagagttcacagtaaaaacaaatgtgattataatcccatcctttagatatgtatttgtgtttgcatatgttgtatgcatagaataaatacaaaagaacctcacccaaatgataacaatgggttccctgggttgtggaattgagatatttttgttttctttcaagtgtgt

SEQ ID NO: 22117 - DNA, 601 bp, Human
agaagactactatggaaatccagtgaattcaaagcacagtgcctgaaacataagtgcttaaaaatattaactatttttaacaacagtgtcgagcccgtttctgttaggtactgcactttaattatcatcctccatgtgaaactcatcgtgaagaagtcatcactgctgtttaccagttatttcctattctttccctttccaggcacaaaggatcattgcacgccctgacttccggaagttaggtatagccacaggactggctaagactagtgccatgtgagaggcagtgacgtacaccacrtctaggggaagctttcagagccagtagaccattcaccaggtcatgttcccctgtctcagcaatcatgaaaacatatgtagagaggaagcctctattggcctctgtccctgagtgactggaatgggcagagcccatctgctttggaaagcaggagaaacacagttgaggttttgagccactgagatttaggggatggattattattgcaacccgtcctagtctaactaccctggcacaccacataaacacatttctcctgaccaagttccttgcatgcattctccattctactccactccc

SEQ ID NO: 22118 - DNA, 601 bp, Human
tctataaaacggaggataatagtccctacctgtagaagactactatggaaatccagtgaattcaaagcacagtgcctgaaacataagtgcttaaaaatattaactatttttaacaacagtgtcgagcccgtttctgttaggtactgcactttaattatcatcctccatgtgaaactcatcgtgaagaagtcatcactgctgtttaccagttatttcctattctttccctttccaggcacaaaggatcattgcacgccctgacttccggaagttaggtatagccacaggactggctaagacyagtgccatgtgagaggcagtgacgtacaccacgtctaggggaagctttcagagccagtagaccattcaccaggtcatgttcccctgtctcagcaatcatgaaaacatatgtagagaggaagcctctattggcctctgtccctgagtgactggaatgggcagagcccatctgctttggaaagcaggagaaacacagttgaggttttgagccactgagatttaggggatggattattattgcaacccgtcctagtctaactaccctggcacaccacataaacacatttctcctgaccaagtt

SEQ ID NO: 22119 - DNA, 601 bp, Human
cttgctgcacaaattatttaatttttctgtacctccaatttttaatctataaaacggaggataatagtccctacctgtagaagactactatggaaatccagtgaattcaaagcacagtgcctgaaacataagtgcttaaaaatattaactatttttaacaacagtgtcgagcccgtttctgttaggtactgcactttaattatcatcctccatgtgaaactcatcgtgaagaagtcatcactgctgtttaccagttatttcctattctttccctttccaggcacaaaggatcattgcacgycctgacttccggaagttaggtatagccacaggactggctaagactagtgccatgtgagaggcagtgacgtacaccacgtctaggggaagctttcagagccagtagaccattcaccaggtcatgttcccctgtctcagcaatcatgaaaacatatgtagagaggaagcctctattggcctctgtccctgagtgactggaatgggcagagcccatctgctttggaaagcaggagaaacacagttgaggttttgagccactgagatttaggggatggattattattgcaacccgtcctagtct

SEQ ID NO: 22120 - DNA, 601 bp, Human
aattaagaacatcagtttagagtcagcttgtctgggtttcaatgctagcttcaccattcgcttgctgcacaaattatttaatttttctgtacctccaatttttaatctataaaacggaggataatagtccctacctgtagaagactactatggaaatccagtgaattcaaagcacagtgcctgaaacataagtgcttaaaaatattaactatttttaacaacagtgtcgagcccgtttctgttaggtactgcactttaattatcatcctccatgtgaaactcatcgtgaagaagtcatcastgctgtttaccagttatttcctattctttccctttccaggcacaaaggatcattgcacgccctgacttccggaagttaggtatagccacaggactggctaagactagtgccatgtgagaggcagtgacgtacaccacgtctaggggaagctttcagagccagtagaccattcaccaggtcatgttcccctgtctcagcaatcatgaaaacatatgtagagaggaagcctctattggcctctgtccctgagtgactggaatgggcagagcccatctgctttggaaagcaggagaaacacag

SEQ ID NO: 22121 - DNA, 601 bp, Human
acatttgcacacatgtatgtatctatagacctatatatatatatatacacacatatctctgtgtgtgtttatatataaaatcagagaaataaagttttattgaaaatacagtagctaaaatgttataagtgtttgcccctgtggagcagcactggacagaatgacacagggatgtgtcggtgtggattctcggttctcaccttcagacttgaagagtcatttattttttaaaaaaatacactggccttattttgaattattcgaatttaaattatttttaataaagtactataaaaatgtkggaaaagtcatttgggaaaaaaagctctctttgaacaaaaattttcaacaccctctttaatagtacattaagtctgtgtagttgttcttggggacaagactgtcactgaatttctctgtgagagtctagagatcacagtgccctgtgttcatggttactatctctgagcgtgagtggaacacaaagctcctgcaccacctcagagctccaatgctttttaccttcctccgtgctttaatgcgcttgtagacatagtcggagaacgggctgcagggtatgaagcggccagccccctgggtc

SEQ ID NO: 22122 - DNA, 601 bp, Human
cgcatgcatacatttgcacacatgtatgtatctatagacctatatatatatatatacacacatatctctgtgtgtgtttatatataaaatcagagaaataaagttttattgaaaatacagtagctaaaatgttataagtgtttgcccctgtggagcagcactggacagaatgacacagggatgtgtcggtgtggattctcggttctcaccttcagacttgaagagtcatttattttttaaaaaaatacactggccttattttgaattattcgaatttaaattatttttaataaagtactayaaaaatgtgggaaaagtcatttgggaaaaaaagctctctttgaacaaaaattttcaacaccctctttaatagtacattaagtctgtgtagttgttcttggggacaagactgtcactgaatttctctgtgagagtctagagatcacagtgccctgtgttcatggttactatctctgagcgtgagtggaacacaaagctcctgcaccacctcagagctccaatgctttttaccttcctccgtgctttaatgcgcttgtagacatagtcggagaacgggctgcagggtatgaagcggccagcc

SEQ ID NO: 22123 - DNA, 601 bp, Human
gagtgattatgaaatagaagaacagcagtacagctggagcagagggataggaagggtaggtcatgacacgaggtcgcaggtcctggccaggatgggatcacatgggagctccaccctcacactcttcagcacacaccagggtgggcaggccttgaagtgagtgtctgtggtctgacccactgacctctgtctgtggctgtgaacttgccctgggactgtggagccagccagcaacttccacccagcacatgctctgctaggccttgtgccaggcactagggcctttggccatgggaaacayggtacctcctgcaaaggggcttacagtcaactggacaaacactgcaagaccacccatggcagcggcacacaacctccacccatttcttaactttggccagaggggaggcaatgaggacgcgctgccagaggagcctgaccgtgcaggatggatcatcacaagaagtcctgtcagagcctccttccctgttagtgactcaaatgccagcacagaagccgagcccatcaaatgtgcagatgctaatgattctagtgatgtgatgactgtatctgtactccccaaaaccaagaactctacatc

SEQ ID NO: 22124 - DNA, 601 bp, Human
ttgccagagggaggaggttggagggataccggggagtggtgtggatgacagagaagccagcaaagagaagagcaagggcagacagctgaagtgggagtgattatgaaatagaagaacagcagtacagctggagcagagggataggaagggtaggtcatgacacgaggtcgcaggtcctggccaggatgggatcacatgggagctccaccctcacactcttcagcacacaccagggtgggcaggccttgaagtgagtgtctgtggtctgacccactgacctctgtctgtggctgtgaacttkccctgggactgtggagccagccagcaacttccacccagcacatgctctgctaggccttgtgccaggcactagggcctttggccatgggaaacacggtacctcctgcaaaggggcttacagtcaactggacaaacactgcaagaccacccatggcagcggcacacaacctccacccatttcttaactttggccagaggggaggcaatgaggacgcgctgccagaggagcctgaccgtgcaggatggatcatcacaagaagtcctgtcagagcctccttccctgttagtgactcaaatgcca

SEQ ID NO: 22125 - DNA, 601 bp, Human
agggagaagtagtataaaataaataaaggaggatgtgatgatagagtgacaatggatgtggtcagtgaaggcccttctaaatagatgagcttcgatcagaaggatcaaaggacgttgctatggggttggggttgccagagggaggaggttggagggataccggggagtggtgtggatgacagagaagccagcaaagagaagagcaagggcagacagctgaagtgggagtgattatgaaatagaagaacagcagtacagctggagcagagggataggaagggtaggtcatgacacgaggtcrcaggtcctggccaggatgggatcacatgggagctccaccctcacactcttcagcacacaccagggtgggcaggccttgaagtgagtgtctgtggtctgacccactgacctctgtctgtggctgtgaacttgccctgggactgtggagccagccagcaacttccacccagcacatgctctgctaggccttgtgccaggcactagggcctttggccatgggaaacacggtacctcctgcaaaggggcttacagtcaactggacaaacactgcaagaccacccatggcagcggcacacaacct

SEQ ID NO: 22126 - DNA, 601 bp, Human
agagcctgcgggggtgccacctttgggggtggtggtcaggtcaaacacaggcccatcgtacatgccccttgggacggcatgcaggtctgccatctgcagccagagaagagcatgtcaccattcattcattcagcattttagggtctgttctaggtatcataaatatattagtgaatacagtgtgtggtgggagctaggaattaacaataataaagataatttgaggaagggagaagtagtataaaataaataaaggaggatgtgatgatagagtgacaatggatgtggtcagtgaaggccyttctaaatagatgagcttcgatcagaaggatcaaaggacgttgctatggggttggggttgccagagggaggaggttggagggataccggggagtggtgtggatgacagagaagccagcaaagagaagagcaagggcagacagctgaagtgggagtgattatgaaatagaagaacagcagtacagctggagcagagggataggaagggtaggtcatgacacgaggtcgcaggtcctggccaggatgggatcacatgggagctccaccctcacactcttcagcacacaccagggtgggcagg

SEQ ID NO: 22127 - DNA, 601 bp, Human
gtaggagagccccgagcagagcctgcgggggtgccacctttgggggtggtggtcaggtcaaacacaggcccatcgtacatgccccttgggacggcatgcaggtctgccatctgcagccagagaagagcatgtcaccattcattcattcagcattttagggtctgttctaggtatcataaatatattagtgaatacagtgtgtggtgggagctaggaattaacaataataaagataatttgaggaagggagaagtagtataaaataaataaaggaggatgtgatgatagagtgacaatggakgtggtcagtgaaggcccttctaaatagatgagcttcgatcagaaggatcaaaggacgttgctatggggttggggttgccagagggaggaggttggagggataccggggagtggtgtggatgacagagaagccagcaaagagaagagcaagggcagacagctgaagtgggagtgattatgaaatagaagaacagcagtacagctggagcagagggataggaagggtaggtcatgacacgaggtcgcaggtcctggccaggatgggatcacatgggagctccaccctcacactcttcagcac

SEQ ID NO: 22128 - DNA, 601 bp, Human
cccttctcttatcttttgatgagcctgtcccactcacctgacaggctaaatcccgactgatgaagattcctcacaggtgggttcggccgagtaggagagccccgagcagagcctgcgggggtgccacctttgggggtggtggtcaggtcaaacacaggcccatcgtacatgccccttgggacggcatgcaggtctgccatctgcagccagagaagagcatgtcaccattcattcattcagcattttagggtctgttctaggtatcataaatatattagtgaatacagtgtgtggtgggagmtaggaattaacaataataaagataatttgaggaagggagaagtagtataaaataaataaaggaggatgtgatgatagagtgacaatggatgtggtcagtgaaggcccttctaaatagatgagcttcgatcagaaggatcaaaggacgttgctatggggttggggttgccagagggaggaggttggagggataccggggagtggtgtggatgacagagaagccagcaaagagaagagcaagggcagacagctgaagtgggagtgattatgaaatagaagaacagcagtacagctggagcag

SEQ ID NO: 22129 - DNA, 601 bp, Human
ccccttcccccttctcttatcttttgatgagcctgtcccactcacctgacaggctaaatcccgactgatgaagattcctcacaggtgggttcggccgagtaggagagccccgagcagagcctgcgggggtgccacctttgggggtggtggtcaggtcaaacacaggcccatcgtacatgccccttgggacggcatgcaggtctgccatctgcagccagagaagagcatgtcaccattcattcattcagcattttagggtctgttctaggtatcataaatatattagtgaatacagtgtgtsgtgggagctaggaattaacaataataaagataatttgaggaagggagaagtagtataaaataaataaaggaggatgtgatgatagagtgacaatggatgtggtcagtgaaggcccttctaaatagatgagcttcgatcagaaggatcaaaggacgttgctatggggttggggttgccagagggaggaggttggagggataccggggagtggtgtggatgacagagaagccagcaaagagaagagcaagggcagacagctgaagtgggagtgattatgaaatagaagaacagcagtacagc

SEQ ID NO: 22130 - DNA, 601 bp, Human
ctaggctggaaaactccttcaggttgagttctgaggaacaccctgtggcctcagaacattgatcttccccttcccccttctcttatcttttgatgagcctgtcccactcacctgacaggctaaatcccgactgatgaagattcctcacaggtgggttcggccgagtaggagagccccgagcagagcctgcgggggtgccacctttgggggtggtggtcaggtcaaacacaggcccatcgtacatgccccttgggacggcatgcaggtctgccatctgcagccagagaagagcatgtcaccwttcattcattcagcattttagggtctgttctaggtatcataaatatattagtgaatacagtgtgtggtgggagctaggaattaacaataataaagataatttgaggaagggagaagtagtataaaataaataaaggaggatgtgatgatagagtgacaatggatgtggtcagtgaaggcccttctaaatagatgagcttcgatcagaaggatcaaaggacgttgctatggggttggggttgccagagggaggaggttggagggataccggggagtggtgtggatgacagagaagccagca

SEQ ID NO: 22131 - DNA, 601 bp, Human
agaatgtgacctctggcaaagttacctccaaactttaaactcttttcctttgtctttcttcccctaggtctcccttacctctttctcccatgtttctgtttctcccattccataccctttcctcatatgctgtaattttacctttaaatgtctttcttttcttgttatcttacttccttcacatttaaattattcattataggaatgcgaatctacatttatttttctccattttaagactactggttatggagcaactgaatgattattttctaattatatcagagagttcgtaaagaayaggtaagactaatcacatggctaacacatagtagatgttcaatcagtggtagctagtgttagcattattataattactaggaatgggagaatataataaaaatcctaggttagaagacgctactgcaatttgagcataaaaataatttaagctatcttttaatctggacaaataaagaaaacatactatgttgcatagcgctcataggctaatgctggaaatcactatcaattcatagaggggaccagctccccgaccctgcccccaaccagggctgatctctaggcagaatcagttacc

SEQ ID NO: 22132 - DNA, 601 bp, Human
gcccaagatcccacagtgcaaagcagtgatggtcaggtctttgtgacaacagcacaaaaagaaatttcaatgtgtgcttgggtctattcagaaaggagcctctaaaagcttaagaattaaggtagccagagaacaacaacaacaaaaaaaaaaaggcaaaaactttgaaaaaaattgcttatgactagcagaatgtgacctctggcaaagttacctccaaactttaaactcttttcctttgtctttcttcccctaggtctcccttacctctttctcccatgtttctgtttctcccattccwtaccctttcctcatatgctgtaattttacctttaaatgtctttcttttcttgttatcttacttccttcacatttaaattattcattataggaatgcgaatctacatttatttttctccattttaagactactggttatggagcaactgaatgattattttctaattatatcagagagttcgtaaagaataggtaagactaatcacatggctaacacatagtagatgttcaatcagtggtagctagtgttagcattattataattactaggaatgggagaatataataaaaatcctaggtt

SEQ ID NO: 22133 - DNA, 601 bp, Human
agaagaacaatgacaaagacgtgacactcattgtggcaggcaatgttttccgtgcttaaccattatctcctttaatcctcaccaccatggtttgagagaggtgcccttatctgttttacagaggagataactgaggttctgaaaggttaggtcacttgcccaagatcccacagtgcaaagcagtgatggtcaggtctttgtgacaacagcacaaaaagaaatttcaatgtgtgcttgggtctattcagaaaggagcctctaaaagcttaagaattaaggtagccagagaacaacaacaacaaaaaaaaaaaggcaaaaactttgaaaaaaattgcttatgactagcagaatgtgacctctggcaaagttacctccaaactttaaactcttttcctttgtctttcttcccctaggtctcccttacctctttctcccatgtttctgtttctcccattccataccctttcctcatatgctgtaattttacctttaaatgtctttcttttcttgttatcttacttccttcacatttaaattattcattataggaatgcgaatctacatttatttttctccattttaagactactggttatggagc

SEQ ID NO: 22134 - DNA, 601 bp, Human
ttggattcgctttccttcttaaatatcggtgtaccattttggcttcaaaacaatctcttcttgcttctgcccctctctttgaggaaggcttgcttaactcagagatgtgatattagaacggccgcctgggggcgccacgatgcgcttgctggctgagcgaaccccctcatccacttgggtgcctacagttggaaataaattcccagggggaaaaaaaaaacagagtggcgggtagggggatgtgggcaagagagaaactgggttaattttaagagtgcaagatatgaagtgccttgctggyctcacctcccaagaaacttccattccagtctatcaggtcttctagacttttcttatggccccgaaaactagcctctggtaggaaaagccaagttcttatctagatttcatctgacccagagcatgataataatactgggaagaagaacaatgacaaagacgtgacactcattgtggcaggcaatgttttccgtgcttaaccattatctcctttaatcctcaccaccatggtttgagagaggtgcccttatctgttttacagaggagataactgaggttctgaaaggttaggtcacttgcc

SEQ ID NO: 22135 - DNA, 601 bp, Human
gtcaaacaaatcaaggctatgcataaacagaaaacaaagcaatattcgtaaagctaggcaagcgagcgtaacattggagaaacataaggcttgaggcttattgattctttagatcacaaccgtttggattcgctttccttcttaaatatcggtgtaccattttggcttcaaaacaatctcttcttgcttctgcccctctctttgaggaaggcttgcttaactcagagatgtgatattagaacggccgcctgggggcgccacgatgcgcttgctggctgagcgaaccccctcatccacttgrgtgcctacagttggaaataaattcccagggggaaaaaaaaaacagagtggcgggtagggggatgtgggcaagagagaaactgggttaattttaagagtgcaagatatgaagtgccttgctggcctcacctcccaagaaacttccattccagtctatcaggtcttctagacttttcttatggccccgaaaactagcctctggtaggaaaagccaagttcttatctagatttcatctgacccagagcatgataataatactgggaagaagaacaatgacaaagacgtgacactcattgtggc

SEQ ID NO: 22136 - DNA, 601 bp, Human
ggcaaactctctctgcacataaaactgttattcttagttctctgaaagacccccacatctttgaagtgtaaactaagagctacattttcccttttactacatctcccttaaaagaaaagcactacaagagctttaaaatagcaagcttccctattctaaggggaaatagtcttttttcatgatttgaacagaaggtagcttgctaggggaaatcctgttccttggctatctccaaattcctttgtagcccagtgtgtacttttctctggtcttcaacttattcaaacctgcagtcagagayaatggtttctcctaagcaattaaaaggtgtctgaggcctgctcttctcttcaaagcacttagtacacagggttacaggtgctaccacttggattccccagagcatggaagtctgatcccaggttgaacatatttcttctgaaaatgagcatcttggttctatagattcttatcttgctcacaggacttgctccaaaactgaattttcagaagcagcatgatagggaaagagatattcaactctgacagacaaggtagatcgaagcacccacactaatttctttcaggtgccccatgagga

SEQ ID NO: 22137 - DNA, 601 bp, Human
agacagtcgtgaagaacaaggctgagggattttgaagtaaacccattttcaggatgactacaatccttccacttctagaaaacttagaagtacaagaaatagctctactacgggtaactgatttaacaatttcccaaacaccctttccactacccaagcccgtggccctcagagagaaccgggatggattgccatctgggttcagaggcaatatgaggaggttggggggatggcaggggcatcctcagggttggggggcaggccaagggatgagatggcaaaggacagctttggaatcagmtagacgatccagcgtgccttcctacacttgcatgaggtgccagtgaattcgaagagggccgggactcaccattgttttcttttcctaaaccttttgtataggcctgtttgatgtgtcttatgaaacgaaacaaatctgaatataaattttaaaatagtgggagttattctcgcaattcccagggatttctatgcttggagagttagtaatggtaagtgaagaaagagaggcttcctgagctcatgttgttcctcccaagggcatttgggggttgttcccagagcaaggaaatcttgtgca

SEQ ID NO: 22138 - DNA, 601 bp, Human
atgactgagtcggaagaccaagtagggctccatctgctggcaagaggaaagagcgtcctccatgttaggatgataaagggctgggatctgaccctgggggaggccaggtcttctgtgtccctggagctaagcagaaaggcagcgaggggagcctggatggtcacctgtttgaaagatgacttcttgctttcctccccgaggcccacactgaccatcactgaccttacccacagagggaaatccaatcagcgccacacgggcatcacccgacttcatgacatcaaagccctctcctttggaygaggccgatttggacggttccaggagctgggcccgatacttggcgagcttagctttcagcaggcccagatgatactcagtggctaaaggatggaaagcaagacagaagatgagtggccagggtgtccaagcccaggggtcaggcagggcccacatgtcgccaagtgctggctgggaagcaactgctgtcaaggagatcaggagaaaaaaaaaaaatctctctgcttaaaaggcccccttggcttctcacttcatttaagataaaatccagtctcttagaccgggcgcagtggctgacgcc

SEQ ID NO: 22139 - DNA, 601 bp, Human
gggcctgtgctcactgttccctctgtctggaaggttctcacccaggactctgcaagctcactcacttccttcaggcccctgcccaaatactcactcaccagagaaacctgccgggacctgtcgtaactagcagaccttcaccctgtcactcaccagcccccactcctcaccactggatgcaccttattacttatttactgtcctttctcttcaagaatgggagatctatgtgggcagggacagagctctgtctcattcatgctatgtctctagtccctggcacagtgcccagcacatgacmccgctagagatacacactcgagaagtatttgtgtgtgatgactgagtcggaagaccaagtagggctccatctgctggcaagaggaaagagcgtcctccatgttaggatgataaagggctgggatctgaccctgggggaggccaggtcttctgtgtccctggagctaagcagaaaggcagcgaggggagcctggatggtcacctgtttgaaagatgacttcttgctttcctccccgaggcccacactgaccatcactgaccttacccacagagggaaatccaatcagcgccacacgggcat

SEQ ID NO: 22140 - DNA, 601 bp, Human
actttctacaaaatatgggaatggtactccttaaaaccgtcaaggttatcaaatcaaggcaagtctaaggaactgtctagaagagcctaaggagacataacaactgaactgtgatgtgggatctcaggacagaaaaaggacagtggggaggagctaaggaaatctgcataaagccagacttgaggcaagaacagatcaatattcattggtgtaaaatgttaactgccagggaaaatgggtgtggggtatatgggaactctgtattacctttgcaatttttctgtaaatctaagactattckaaaataaaaagtttactttaggccgggcgcggtggctcacgcctgtaatcccagcactttgggaggccaagggcgggtggatcacctgaggtcaggagttcaaaaccagccttgccaacatggtgaaaccctgtctctactaaaaaaggatacaaaaaattagccgggcggggtggtgcatgcctgtaatcccagctacttgggagactgaggcaggagaattgcttgaacctgggaggcggaggttgtagtgagctgagatcgtgccattgtactccagcttgggcaacaagagtgaaa

SEQ ID NO: 22141 - DNA, 601 bp, Human
agagacaaatctcccatgcagaagaattccaaacagtttctgtagatgctcccctcaaggaggcgatggaattggactgcacacagtcacctccctccccaaagcggcatggcaaggggagaagagagcgtctccacggtggagaaacctgacacacctcagccaggtggtcaagatcaacatcagcaggggtaagtcatgttgacagtatgtggccttcatgcgatgtgataaaaatggcactttacctctgtggccttccttgctaactataaccccagattaaccacgagaaaaacaytggacacaccccaactgaaggactttctacaaaatatgggaatggtactccttaaaaccgtcaaggttatcaaatcaaggcaagtctaaggaactgtctagaagagcctaaggagacataacaactgaactgtgatgtgggatctcaggacagaaaaaggacagtggggaggagctaaggaaatctgcataaagccagacttgaggcaagaacagatcaatattcattggtgtaaaatgttaactgccagggaaaatgggtgtggggtatatgggaactctgtattacctttgcaatttt

SEQ ID NO: 22142 - DNA, 601 bp, Human
cccagatggtagtttctaatgctattctccaatcaaaggaaccagggctccttagagaaatggcagattctaggccagggcagggaatatacaaaatgagcctgaggcatcttgcagtgtcagaaagtgaggaagtgctggaaaaacacaatggtggaagtacatcaaagaagccaactaaaatagctccaaagctaaaaagatttgagcagcaaaagaacatggtatgggtttagaccccaaagcacaaaataaccccccacgaatccatacggatatcaataaatgattgaataaaacraatgaatgggagaagagagacaaatctcccatgcagaagaattccaaacagtttctgtagatgctcccctcaaggaggcgatggaattggactgcacacagtcacctccctccccaaagcggcatggcaaggggagaagagagcgtctccacggtggagaaacctgacacacctcagccaggtggtcaagatcaacatcagcaggggtaagtcatgttgacagtatgtggccttcatgcgatgtgataaaaatggcactttacctctgtggccttccttgctaactataaccccagatta

SEQ ID NO: 22143 - DNA, 601 bp, Human
gcatgtgatggaaatacatcgagttcccaaatccagaaaccctcagccttggggatctcctggaaactcaagaaatgagaaaaacctggtggagtggacaggtatagggatagacacggtggccccaagagcaatggctgttgagacagccagcaaccaacctcggggccactccctgattctgtctggcccctgtaagacctgggccctcccacggtgggagagcctatactcccaataaggcaggtgggatctgccatgggcccagacttcaagggtcacggctcttggtaactagagyggcttctctatcaatctctctctctctgatacatataccaatcatataggcagacagtacaacaaataaaactaaacactgcccagcctgcagcaagcactcaagaaaaggtagctgttaaccaccatcccctgtgcctggcccagagcaatggaaactgggtgtgggctcaaattgttcagctgaactgagttagaagctgctccccagcacctgtccagagctttggttgttgctcacttggcctatattctagcaacctctccactgtcccacttcactttgccctgctataacctg

SEQ ID NO: 22144 - DNA, 601 bp, Human
atgtggcagggcccaggctaaatgcttcctgaacatttcctcacttaatcctcaaaactatgctgtaaattatgtattattatgcccattctacagctgaggaaactgaggcttggcttagagatacccaatcacttgcccaagatcacaaggctagtttggtgccaaggatttgaactggaacctgtcttttctggaaagcgggataatggaccagggatccagagtgatctccatgacagccacacccaatttcaacgatcagtaacagagctccagtctgcttcccacacacctgccctgcctcccaccttgggctgcgccttcaatgattccaggaaggtccaggagctggatgttggcacctttgtactaggatgcagaagagaagaaaggtaaggcaaggctgggcctccactggaaaggtcctgtctggatctgggacatctggaatggccccggggctcaggggctgagggaaacccagatgccaacctgtggccaagtctgagccttgtcaccaccccagcccagtgcagaccacagcctatgagctgagtagccgcctagggagggctcaagatcttccaatcccacaaca

SEQ ID NO: 22145 - DNA, 601 bp, Human
gctgcagacctggcagtctggagcttgcccagaggctacttgaatggacagcaggggcagtgggggtgacctgctgccaccctgctccatgaggcctcctgtcttagtcagtccccccgctgcgctgacggtggtggctgccctccttcacgtgtctttcagggaaggatactgtattcgtgcaggatgagctgcaccagcttttccgagcactgggtcagcgtgactgtcgagttaaaggagatgccaccacctttcttgggctgaaagaggagaaagggatggggagaactgctgaccraggggtcacagcaatggtcccacagcctcagccgccagccaatgcagtctcaaaactgccacacccctggcctgaaggccagagaggtgcctcaccttgaagtagatgttaggcttgtgcttgttgaggcggatgcccacagactccagctccttctccagcagagacctaggcagagtaccccttaagcccctcacaggctgtccacagagccagatgcacagcttccctgttacgcaggatgtcactgcccacccagagactgactctctcctccacccccttccccagcaacccaga

SEQ ID NO: 22146 - DNA, 601 bp, Human
tgacgactggggtcagaacccacagcaaggacagcagagtggcaggatgccagtggcctcacctgatgaccacactgttgggttttcgggccaggcggtccacctcttccatggagatctggtcgattttgttataaacctgagattgagaaggtggaggccggtgctgaggacaggagcaaggcatccaggaaagggccctccatcgccctgtgccggctgcagcccttccttggagagctgagtctacgcccttcctccccttgctgcctcagggttgggaaggctgggctggaacccyggtttcaagctctctatgtctgcaagatccaagcagccactgaggtgaggtgaggtgaggggagagcctcagactctttctgcttctctcacaaggttccgggagctgaggaaatgcatgtggtagaaaggccgagtggccaggccagggctcccctcctgcacttacatacaggcagggcatgtacacccggttgcccacgatcacatcgatgaactcgtccggggagcagtcttctcggaaaagcacttctgcattgaagatctctgaggggctccgattaagggcaacctgtgcacc

SEQ ID NO: 22147 - DNA, 601 bp, Human
gaaaccagcaaagtggagcacctgaatcagtctgccccaaagaggagcctgccaggctgtggtggcaagtgaacaaacatccagagtgcaggcggtaccccagggacccaccctgcaaaggagggcaggaagtgagtggccagggcctgagaacattagttccctttttccctttgagctgtgatcagacagaagccacaccttccagagcaccaggagaggtaggctcacacccagggcttcttggggggaccttggttcactactaagttaagaagcctctttttttttttttttttttgagatggagtcttgctctgtcgcccaggctggagtgcagtggcatgatctcggctcactgcaacctccacctcccgggttcaagtgatcctcctgcctcagcctcctgagtagctggaggcacacgccaccacgcccagctaatttttgtatttttagtagagacagggtttcaccatgttggccaggatagtctcgatctcctgacctcatgatccacccgccacagccccccaaagtgctgggattacaggcatgagccaccacgcctggcctaagttaagaagcctcttagccattc

SEQ ID NO: 22148 - DNA, 601 bp, Human
gatttcagcaagaagaggggagaaccaaggctctggagacaccagagcctttacatgtagaacaggcatgaacccagtccctacctcgcaggactgcagagggattaaaaagataaggcccgggatgtgccttgctccaaatactgggtggaccgtggcttgaaggtttgcgccgtgaccccgagctgtgtcctgacctctgtagagctattctgagcacaagcaggtaaaggtgtagaagctctcacgccctgaggatggcagcccctcaaaggcctgggacacagcaggaggagaggasctgaggctgtgctgtagaactgacactgctctttgtggtggctacaaccaccacaaaatggtccttgtgctcaggccgggaccctcatccatcatttgcgctgtccagcctcttggtccctgagctctcagtactgttggccaagcttcactgtgaagctgtggagtgcctgcctcaagtcaggaaaccagcaaagtggagcacctgaatcagtctgccccaaagaggagcctgccaggctgtggtggcaagtgaacaaacatccagagtgcaggcggtaccccagggacccaccctgca

SEQ ID NO: 22149 - DNA, 601 bp, Human
gggctgccatggcgagatggccgggggctgtgacgggaccatgggcaaaggctaggaaccctgacacccagagttcactccttgagaggagcaagggactgccaggaagtccagcagggatttcagcaagaagaggggagaaccaaggctctggagacaccagagcctttacatgtagaacaggcatgaacccagtccctacctcgcaggactgcagagggattaaaaagataaggcccgggatgtgccttgctccaaatactgggtggaccgtggcttgaaggtttgcgccgtgaccccragctgtgtcctgacctctgtagagctattctgagcacaagcaggtaaaggtgtagaagctctcacgccctgaggatggcagcccctcaaaggcctgggacacagcaggaggagaggagctgaggctgtgctgtagaactgacactgctctttgtggtggctacaaccaccacaaaatggtccttgtgctcaggccgggaccctcatccatcatttgcgctgtccagcctcttggtccctgagctctcagtactgttggccaagcttcactgtgaagctgtggagtgcctgcctcaagtca

SEQ ID NO: 22150 - DNA, 601 bp, Human
accaatcatggtcacactcaaccagggtcagcatctctcctaggggctggcaagcctgtgctctgtggagggttgcagcatgtgtgattagtgaagggctgccatggcgagatggccgggggctgtgacgggaccatgggcaaaggctaggaaccctgacacccagagttcactccttgagaggagcaagggactgccaggaagtccagcagggatttcagcaagaagaggggagaaccaaggctctggagacaccagagcctttacatgtagaacaggcatgaacccagtccctacctcrcaggactgcagagggattaaaaagataaggcccgggatgtgccttgctccaaatactgggtggaccgtggcttgaaggtttgcgccgtgaccccgagctgtgtcctgacctctgtagagctattctgagcacaagcaggtaaaggtgtagaagctctcacgccctgaggatggcagcccctcaaaggcctgggacacagcaggaggagaggagctgaggctgtgctgtagaactgacactgctctttgtggtggctacaaccaccacaaaatggtccttgtgctcaggccgggaccctca

SEQ ID NO: 22151 - DNA, 601 bp, Human
ccagattacaggccctgccaccactgtcctaaggggctgcagggacagctgggtctacagcatcccttgcctccaggatacagatcccaagaagaaatgagctagaggaaaacaacaccaggaaagcatcagcccaggaggacggccatgtgacccgaaggttggccaccatctgtgcctgcagggtcatgttcaggtgacagaatcctggacagggaaaggcagcctcttgctccctgagcccagaccacctcccctggggcctgtgcatgcctgctcccctacctgggatgctccccaycccaactcttcactgccagacccactagtcctataagccggctcaggttgcctccttgaagccgctgtcctgacctctgtgttaagctggtgccactccctactctccttgactgatgcctgaatggcatggaagcagggttactggcatctctgcagagccaggcagcatgctgagtgccctacacactggacctcattcaacgtgtcctcctgactatccagggggcaggcagcacacccccctcacagtagaggtcagagcctcggcacatggctaagaaggggtgctgcagacgca

SEQ ID NO: 22152 - DNA, 601 bp, Human
gtgagtctccttggctcctcctgctgtgatctcaagcctaggccctgagggagatgggactttgcctggcctcctttgtttaacacctctagggtggcactcagagacctggggctgggcttgcggaatgaatgaatgcatgagaccagattacaggccctgccaccactgtcctaaggggctgcagggacagctgggtctacagcatcccttgcctccaggatacagatcccaagaagaaatgagctagaggaaaacaacaccaggaaagcatcagcccaggaggacggccatgtgaccygaaggttggccaccatctgtgcctgcagggtcatgttcaggtgacagaatcctggacagggaaaggcagcctcttgctccctgagcccagaccacctcccctggggcctgtgcatgcctgctcccctacctgggatgctccccatcccaactcttcactgccagacccactagtcctataagccggctcaggttgcctccttgaagccgctgtcctgacctctgtgttaagctggtgccactccctactctccttgactgatgcctgaatggcatggaagcagggttactggcatctctg

SEQ ID NO: 22153 - DNA, 601 bp, Human
tagcttggagtcccccctgcttggtcaccatctctcactcctcctggccccacctgtggcctgaagcttcccacacatcacatcacccccaactcccagggcagtgtataaacttcagtgctccttggtaggggtgaagatcccaggggtcccagatgtcatataaaactggaaggagaccctggaggaggcagccagcaattgccctgagagtgtagacctctggttgccacgctgatggtggcacagtggagggcggtggggaggggactctgcaattgtgcaatgtgactcctcctcycacatgcccacaggtcttccaggccctggtgggagacccaacacctcagcccagcgtccctggggcggaggccggcgccaggcctgcaggaacacttccttgacacagatgggaaggtggctgactctggtctgcagatgggttttgttttactcagcttgcccagcattgccacttgtgagtgactgaagggattcaggagggtaatcgtgagtctccttggctcctcctgctgtgatctcaagcctaggccctgagggagatgggactttgcctggcctcctttgtttaacacctcta

SEQ ID NO: 22154 - DNA, 601 bp, Human
gttggggagggccaggcacagtggctaatgcctgtaatcccagcacttctggaggtcaaggtgggaggatcacttgagctcaggtgtttgagacagcctgggccagatagcgaaaccttgtctccatgaaaaattagccaggcatggtggtgtgtgcctgtagtcccagctacttgtgatgctgaggtgggaggatcgcttttgcacagatgtcgaggctgcactgggccatgatcgtgccactgcactccagcgtgggagacagagccagaccctgtctcaaaaaaaaaaaaaaaaaaaaccagaaaaaaaaaagggtggggaaggcccatgtctaccctgggttggcatgtacattctatggaggacagacacacagacatgccaatccccacaggaaggacaggaacaccacgcagagagtgtgaatgccttgcttcatgcctaacccaggggctgtcctgggtctacccccctggttgctttccacccagagactcacccacaccagggcgtacttgaactggctggcgagtgaccggtggatgcggtggcactggaggacaggagagagtcaggtagagaggtgaggcttcaccta

SEQ ID NO: 22155 - DNA, 601 bp, Human
gtgtgtgtcctgaagggtaaatgccatggcataaggtgggggcctcaggcagcaggatgtccgcagttgtctgaccatccctgatctcaaaggttggggagggccaggcacagtggctaatgcctgtaatcccagcacttctggaggtcaaggtgggaggatcacttgagctcaggtgtttgagacagcctgggccagatagcgaaaccttgtctccatgaaaaattagccaggcatggtggtgtgtgcctgtagtcccagctacttgtgatgctgaggtgggaggatcgcttttgcacasatgtcgaggctgcactgggccatgatcgtgccactgcactccagcgtgggagacagagccagaccctgtctcaaaaaaaaaaaaaaaaaaaaccagaaaaaaaaaagggtggggaaggcccatgtctaccctgggttggcatgtacattctatggaggacagacacacagacatgccaatccccacaggaaggacaggaacaccacgcagagagtgtgaatgccttgcttcatgcctaacccaggggctgtcctgggtctacccccctggttgctttccacccagagactcacccacacc

SEQ ID NO: 22156 - DNA, 601 bp, Human
aaccctgcagtctccttgccacacaaggcctgggtctgccttggggcccaggctgcaccctctccgacccccaggcccaatgcctgacctgtgcccacctgactcaacctggctactgttcagcaagtttacaaagtgttctcagtctgaacaggaaccgttttcaatcctttatttcagaaaggagagccaggagaactggggacttagaaaatacagatcctaaactcaaaagtccctgccccaggcgtgcagagccagggtcctggggttttgtgctgggcaggggctgccctgggarggggaatacagggggaggcactttaggacaccccttaggctgtggagggtgtcagctgggcctttgaagccactaaccactggttcccatcatggagagccctgtgtggggcacccaagggggtttcctcctggaagggcccccaacccaagtgtcagagaagctggcaagagctgagggagtgaggtgccatgacagcagccacagcctccagggacccaaacaggcccagctaccagcctggcactgagcatgccatctgctttaggccctggctggcgggcatgtgggcaacttgct

SEQ ID NO: 22157 - DNA, 601 bp, Human
ttggccaggctggtcttaaactcctgacctcgtgatctgcccacctctgcctcccaaagtgctgggattacaggtgtgagccaccgcgcctggccctattttttaaattattttaaaatgtatgtttgtagattaaaccaaaaagtaatataataacctggatttttctttagaaaattatcttcatggagatgttctccctctctccctctctccttctctttccccataccatctctcaccctcctccctctttctgtctctctctcatagtgttctcttacctggtaacacattatarcttgattctactccaggaaaacttgaaaaggattcaaacttttcctccatgctataatcaaagttaacaataggaagtcttgctactggtgtaaaaactgttgtttgctgaattccaagctgtctgtttgatctgtgcttgtgtgaggttgaacttttcctcaaccttctgtggtagatcttcctcctttgcttcctaggaatttcttcattttttccaaagtcagtttgaaaaatgataagcagaaaaaaacaaaacaaaactgcaatcttcatgtttgatttttttccaccagccaat

SEQ ID NO: 22158 - DNA, 601 bp, Human
caggaatttgagaacggcttggacaacataatgggatgctgtctctacagaaaaagttaaaaagttagccaggtgtggtggtgcattcttgtagtcccagctacttgggaggctgaggcagaggatcactgaagcccaggagttcaagactgcagtgagctatgattgtaccaccgtattccagcctggacagcagagcaagaccccatctcttaaaaaaagaaagaaataggcataggggttgaatagatatttctccaaggaagatatgcagatagacaacatgcacataaaaagatgyttaacatcattagttgttagggaaatgcaaatcaaaagcacaatgagataccacttcatacaagaacagctataattaaaaataaataacaattgttggcaggaatgtagagaaactggagtcctcttccattgctggtgggcatataacagcatagccactttggaaaacatttggcagttcatcaataaattaaatatagaattaccaaatggcccaacagttcccctcctaagtatatacccaaaagaattgaaaataggtgttgaaagaaaacttatattaatgttcatagctgtg

SEQ ID NO: 22159 - DNA, 601 bp, Human
catgagctcttaaagtgtctaattatactgaccaaagcaaatcgtatggccacaccagacttcccaagccgccagccaatccagttccctcatgtgaccagagagctgagctagcactaatgatgagctcacagcccacccttgatatgcacatgggaataggtgaaaccagacagcatgcttccgtggtgcttctcaatgagacactgagctatgtcttttatggtttattatgctattgaaatatgattcacatactataatattcacccttttgaagtgtataatactgtctgggcayggtggctcatgcctgtaatcccagcactttgggagtctgaggtcacttgagaccaagagtttgagaccagcctgggcaacatggtgaaaccccatctcctctaaaaatacaaaaattagccgagtatggtggcacatgcctgaagtcccagctactcagaaagctgaggcataagaatcgcttgaacccaggaggtggaggttgcagtgagccaagatcgttccactgtactccagtctggatgacagagcaagactgtccctaaataaataaataaacaaataaagttcatgatgcagt

SEQ ID NO: 22160 - DNA, 601 bp, Human
gacataagaaatgctgaaatgcttttcacaggctctcctctcagccctttcacgtaggctctaagagtgaactcctcatggtaacttggggctgaactgcgcttccattttgtatccatcaggatagattaaattatacaacatcaacaaacaatccccaaatctcagttatttttcatttatactttgtgtctaatgtggggacacaggggctcagctcatcatattcactcaggattcatctataagcaggctgtcctgatcactgcggtagtggaaatgtgaggttacaaatcacacrtgagctcttaaagtgtctaattatactgaccaaagcaaatcgtatggccacaccagacttcccaagccgccagccaatccagttccctcatgtgaccagagagctgagctagcactaatgatgagctcacagcccacccttgatatgcacatgggaataggtgaaaccagacagcatgcttccgtggtgcttctcaatgagacactgagctatgtcttttatggtttattatgctattgaaatatgattcacatactataatattcacccttttgaagtgtataatactgtctgggcacg

SEQ ID NO: 22161 - DNA, 601 bp, Human
gtaaacagctatctcttctgcaaagtttatatatttgaagattatgaaattagtctattcaggatcaatttttaggatgaaattaaaatacagtcttcacagagcaatgagaatcgttcacttttttttttttttttttaagagacaggatctcgctctgttgcctagactagtctgaaactactgggctgaagccattcccccacctcagcctcctgagtagctgggactacaagtgtatacaactgcatgtggcttagagtcatttacttttttttttttttttttgagatggagtctygctcaagtgcccaggctagagaacagtggctcaatctcagctcactgcaacctccgcctcctggattcaaacgattctcctgcctcggccttctgagtagctgggattacaggcatgccccaccacgcccggctaatttttgtatttttggtagagatggggtttcaccatattgtccaggctggtctcaaacccctgacctcaggtgatctggccacctcagcctttcaaagtgctgagattataggcgtgagccaccgtgcccagctgctaagagtcatttacttttaaagcacaaaa

SEQ ID NO: 22162 - DNA, 601 bp, Human
acaacaaaggtgtggaaggttacacagaaactgatttttattcttcatattttcccatagccattttcctggactagaaacatgcctctgtttttgtccatgaatgctcatgccaatcactcacctcctctgagcctgtctccatctctgcataagaagcttggggagatcatctcccagactctctcagatctaatgttatgcctctacggcttcaatctacaaaggttcctgtatgctttaattttataggtttttgttttaacatttagttaagttcagtagtcaatttttaaacccrgaaagtgagcataccagtagtacataccataaaagccacgtggtgaccttcttataaaaccataacagtgtagctcagcatgggtcatttatcttttccaaggctttagactttcacaaatggggttttcttagggcagagcatacctggtgtataggccacaggaggaagggactttcctgagcatgagaggagttccttaggtgatcatatgaaagtaggatgaaatcctttgtcagagaggccatggaagcttctattatgtttgacactggcagtgtgctgtcacagatggccatc

SEQ ID NO: 22163 - DNA, 601 bp, Human
aatttgtttccagaaaatacttcagatgctaaaagaccagattttagcatgttttcagttacttgggaagaaactactccataaattaaaatcattacttttgtcactgatgctattgttggtgtccttacagcaaagctaaaagtatgtaaaatagtaaactatattcaagggaaaacttgaattcaaattagggacatcagagaggaaactttcttagaagaagactaccaattagaagcattttccttttcctcccttccccatctccaaccaatgcaagtcatagtgaagccattcrtccaaatagacaaatcagagcatgtatttaccttgaatgcttttggacctatgcctgaagaagtgatattatttttactcagatcaagcctttccaaatttggtaatccattaaatgcttcatctgggatggaggcgatggaattgcctaggacacacagcggttatgttttaggcatgtgtgcatatacatacatgtacacacatgtatgggcatgtgtgcatagatatcaagagagagctttgtctggaggagaaagcaatactcagaacaaggacagaatatatattatataaccaa

SEQ ID NO: 22164 - DNA, 601 bp, Human
ttacaaacataaaccccttttctcttggctctgaaattccttgaattctctcttcttttctcctttttgttgtttgagacagggtcttcctctgtcgcccaggctggagtgcaatggcgcgatctcggctcactgcaacctccgcctcccgaattcaagcgattctcctgcctcagcctcccgagtagctgggactacaggtgcatgccaccacgctcggctaattttttgtatttttagtagagacggggtttcaccatgttggccaggctggtctcaaactcctgacctcatgatccgcccatcttggcctcccaaagtgccgggattacaggcatgagccactgtgcctggcctgtttttttttttttttaaatatataattagtccaatctgtatctttcaaaggtttactctgtgctgtttcctgttctctctctttccctcttcttccccaagctatccctaatttttatatgagcctatttgtttttccagaacccccttctgccaaagtatcctccatcaggttttgttgattgcacacacaaaaaaaggaagcagtgtcttgctggcctgaaaaatgttaacagaggttcca

SEQ ID NO: 22165 - DNA, 601 bp, Human
aaaattgccaaagtcaaagttaataccatgaagagcatgtgctttctttgtaggacagcatctcagccgcatatgcagtgcccatttattcatattccatgcataattcccatgtgcttagttttgtttttaggttccaacacatgataaatgaaaatagcaaggtgtatggaggcagcaagagttgtgggtggggtctgttgaccatcagagtgataaaggagatccaatcaacaaacatggcactggttagtcgctacaaagaaccgacaaaattgtcgatccataacacaaaacacayggcagtgcagggaatatttagcgtaattcttcagatattttggatttgtagtaaatttattgccttgtgaataataagaacctggaatcattgagaaacaatgttattcatgggtaaggtacaaagacaataggcagtttaaaattcattttacgttttaccagtcaatagttaaaagaagttttatcaactcaaatggttaagtgacctaaaaatatttactatttattcatttggcaatacagtaaataaaatttctacaggactatataggaaagattataaggaagcatatcattg

SEQ ID NO: 22166 - DNA, 601 bp, Human
aggggccagtactgcagtagctcttagaactcagcccacccagggagtgcagccgggggtatctgagccggaggacagaagcactgccggcatggggccgaggctcctcgggtgctcggactgtggagaaaggtgggctaagaaaggcaggcagacagcccgttcaccctggcttcctgtcaacactctgggaatctagaagcatttgtgagtgagggaggagaagagtactctggaaggcagttccaggggtgtgtgaaagcacgttcacaatcaggagtgcatgttttataacatctcrttttgataacccaactaaaagtgtgactgacttatagttcatatacagcctgttagtacagttgttctaaattgctgacaccctttggtcttcagcagttagaaactgaattttctaatgtctttcccatttggcagtctgcatcaaaatttgtgtttattaatgtttttctgtgtgtcctgaaatccatctggaaattgagtatttccataactaatcctcagatttggcaattctcattattattgttcttttctcaataccagaagtgttttgttcctgtgaagttttttgggagct

SEQ ID NO: 22167 - DNA, 601 bp, Human
aggaggaacttccaagctgaaatagccagctgagcacatgtaggtgaaagaccatgtgggtttgctcagggagagaggagactagccctggagtggctgtgcacagtggagtgaaggttggtgctcagagagaagtacactgggagggcctttttttacattttttaaattttattttattttatttagagacagagtcttgctctgtcacccaggctggagtgcaatagcgtggtcttggctcactgcaacctccgcctcccgggttcaagcaattctcctgcctcagcctcccgagtakctggcattgcaggcccccaccaccacactcagctaattctgggagggcctttgcaccctggacaacaacgtctggctctcattctctaggcagcaagatggggatggcaggacaagggccacattttacaaaggttaacctggtggtggtgctcaggattaatggaagtgctgagcaacaggaagtagccaggccagccagtaaattgggataagtggttatatttcctcatattctctttcatttccaaaactaaaggtactgagaatctgacatctttctctagtacataggtgaagt

SEQ ID NO: 22168 - DNA, 601 bp, Human
gtttggggcctggagttagtcacaggacagttttggtaggaactgggtgaaaacttgtaagctacagagttgctgaaacagtcagaggccttctttgtacaacacttgtatccatgcaagttactgttaggtcagagtgtctgtggttttgcctggaatttgtgagtggacactctgttacggttaatacctgtttgagcttctgtgataagcgtcacatttctagattggggcagtttacactgtcttgagagtcagagtacctcatggaagttgtggtttcatttaaattctcaattcmtttctcccatttcccccaagagctatcagaagtaccatttttcactgtatcaggtgtctctactagtaattataatttcgattcagaattttgtattgcttgaagaaaaaacaatgcttaaattacaggaaattctgtatacagcatgaaactagagtttaatttacatcacaatagtcttaaaatatattttgttgtagtgtaccatatttcaaatataatacatttaaaacactaaaaaaatatattgttacctcaatagaaccaggaagaccctgcggtataattctaaatttattt

SEQ ID NO: 22169 - DNA, 601 bp, Human
agaacccaggagattctgatggaaagccagcctactgataaatgtcagtgttacataactctgtcacttaatctggaaataggaagaagaggaagggtggtagccatgacagccacataagatcacaatagatgaccctcttttctggcttgctggggctgcagccggagaatgctccatcctgacttctggctggatgatcatgtggtctaggagaaacggagcttagtaaggaaacctgggttcccacggggtctgccagtatgtatagactctctggacctcagtgttctttttggcrggcagggtggggtgtggtttgtagagacagggtctctctgtgttgcccaggctggagtgtagtggtacgatcctagcttactgcagcctcaaactcctgggctcaagtgatcctccacctcagcctcctgagcagctacgactacaggtgtgcaccaccatgactggctatttttttttaatatatcttttagagacaaggtctcactatgttgcccaggctactctcaaactcctggcctcaagccatcttcctgcctcagcctcccagagtgctgggattactggcgtgagccactgc

SEQ ID NO: 22170 - DNA, 601 bp, Human
gggtctcaccatgttgctcaggctggtctcgaactcctaagctcaagtgatctacccgcctcggcctcccaaagtgctggaattacaggaaagttgtcaaattttataactaattagtaaaataaaacacactgccatggttatggaatcaaatgaattttatttaaaatgtattagctataatatgttgcaagaaatggcataccaaaataattatacaaggctctctattttataaaacttattcacataaattatctcatttgggcttaaaaactctgaaaagtagacagatattttwatctctacttaccagtggagttaagttgggcctggagagacagggaagcccacccgtggttacatgactaatgctgagaggggcttgtcctagccgagcctccagctcccaggctgcctgtttcctactatttcatgtggtctataatattttaggctcatgtttttagatttgcttttgttataattaattaaagttaattaacagccttaatttacaaccaaggagaagttttctagaactgttaataagtttttaatagctagctgccttcaagttaagtttagttggcattagagg

SEQ ID NO: 22171 - DNA, 601 bp, Human
accaggctgtgaccacttcaatccagtgatcaattttagaatcaaaaaaggtgggacaaacattagacgccttctgatgcaatgcagtatgaagcatatggcacaacctgtgaagtatttttgccaaaaaattttgaaactgaattttacaaagtcttcccaaacccccatctcttcctccagtacctttaaaaacacgaacttttctgtgtttttgttttgtctttgtaggcatttagtttatttggacttttagagaaggggaaagactaagaggcataattctcagggacagaacaayaaggttattgtctccctcactgccaatgataaagaccttactaacaaaatattctggattaattctcaagacactcatgccatctaggcaggagtgatgattcagtatataagctgaacacatgcagaaaaatgtgttcccaaaagtagggaaagtgagtcttaataaatgtattcagaaatctgacttcagaaaaaactagatagaagcagttttaattttagcatatatttaggttttatgctttatagattagttttatttatttatacatggaggtaggagtagtaacataatcta

SEQ ID NO: 22172 - DNA, 601 bp, Human
tgagcagtaataatgatgtcattttgaaacaattgtttacatattgtaagatcatccaagttaatattgttgggaacctagattttcagtgtaagagaaacaagttttaataaaaggaattaatattcaattatgttaaatttgatttgggaatgtcagtctgaacttactttcttttcaaaatacggaatttcctggcagtccactgaaaggcctcaaaacaatagcaacacaattgaaaggaccacgtctcgttcccacttggggcttctcaatactattccccaaagaaagaggccargctctttggaggaaggtctgcagtaggtaatgcagaaagtaagcctgaggcccacgtgtgcccaaaagcaagtgagcagacacaagagccagtttgaatggcgaccattgtccagatgactgcaattgattgaaacataactgcttacatgaaagcctaagtatatattgattcaccagaaaaagagagaaccctaaaacaaaataaagcaaaaacattcaggctccaacttcttactcccactggtggtttaaaggaaagaactgagcttttttctttcctttcaaagtgacaaagcag

SEQ ID NO: 22173 - DNA, 601 bp, Human
tgactttggaattaaaaatatttaacacagtcaaaaataatattaattcaaaaagaaaagagcaatttctaaaaaccaaaaataaactaaataacatgtctgaatattaagttgttgacatattacagaggaaaccactgtatttcagctgtacttctttagtggaacttatcctaaagacaaatagagctaccaaaaaataataaacttcaagcttttattatgagcagtaataatgatgtcattttgaaacaattgtttacatattgtaagatcatccaagttaatattgttgggaacytagattttcagtgtaagagaaacaagttttaataaaaggaattaatattcaattatgttaaatttgatttgggaatgtcagtctgaacttactttcttttcaaaatacggaatttcctggcagtccactgaaaggcctcaaaacaatagcaacacaattgaaaggaccacgtctcgttcccacttggggcttctcaatactattccccaaagaaagaggccaagctctttggaggaaggtctgcagtaggtaatgcagaaagtaagcctgaggcccacgtgtgcccaaaagcaagtgagc

SEQ ID NO: 22174 - DNA, 601 bp, Human
aagatgaagccatagaagcactagaacagactgtggtcacaccctctgactcgggagattctttctgtatgtgatttgaaaaccagaagcactgaatgaaaagatttaaaatttactgcaggttttaaaaagaaagtgcaaagttaaacaacatgacaaagaaggagaaagtaacttatatcgcagatacaaaggcttcctaagaatctaggaggaaaatggaaaatgctcagtttcattcagaagagaaatgtaaattgaaactttactggcataccactttttatttataaggtttgcaaaaaaaaaaaaaaatccagaagctcattaacatattctaatagtgagcctggaccgatcaaataccactgaagagaatgcaaaatggtgcgccacctctggagaggaatttggcaatatctagtaaaattacatacacactttaccctttgcactctgcattcccactcctaggattttatcccaaagttaaactggaaaaaaacaaaatgacatttatacaaacttatcttttgtggcattatttttagtagtaagagtggaaacacatgtctatcaatacggaactgattgaataaaa

SEQ ID NO: 22175 - DNA, 601 bp, Human
tactgcttttcaaaaaatgtcttaatcttgagtgaggaatagtgaaggtaatcttaatatactgtttaactttaaaaaataattttagaattatagaaaagtttcaaaaagagtatagaatttatgcacacccttctgccagctttccttaatgttaacaatgtacataaccataatatgattttcaaaaccaggaaattaacattacagtagtgttttaattttacacatgtaattaatggaagaaatgaaagctaccccaatattcagttatatttataccagtaattatagcacaggrccttataagaaattaacaaattattgttttaataataaacaacacttattcataaattctgcctgctttttttgttgtcattatgcttcttaatcttgaaccaaaagatacataatttttaaagggacttacagagttctcagctaacaccagtattcaagttgattataaaggctgtgtttattttgttccagactcttctggtctagctcagtatgcataatatcctattctagtgagatggcctctttctagaggtaggaaactgagagattttacctttactattaataaaactcc

SEQ ID NO: 22176 - DNA, 601 bp, Human
tatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggracacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccacta

SEQ ID NO: 22177 - DNA, 601 bp, Human
gctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccracatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaatt

SEQ ID NO: 22178 - DNA, 601 bp, Human
aatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatgrggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaa

SEQ ID NO: 22179 - DNA, 601 bp, Human
agtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttctttkgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccaccc

SEQ ID NO: 22180 - DNA, 601 bp, Human
tggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccckgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcag

SEQ ID NO: 22181 - DNA, 601 bp, Human
aattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgcyggctatgccccggtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcc

SEQ ID NO: 22182 - DNA, 601 bp, Human
ccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgcccaactgacaagcccttgcgcctgcctctccaggatgtctacaaaattgktggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggcta

SEQ ID NO: 22183 - DNA, 601 bp, Human
ttacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcaccttggaaaaaagatttgcgttcagtgcaaatccaaagtctcaaatgactttagcctctgcartaagttaatgttactttaaattgttacctgagcagtgaagccagctgcttccattggtgggtcatttttgctgtcaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtctccactcggccaacaggaacagtaccaatacctaaaaatatttacag

SEQ ID NO: 22184 - DNA, 601 bp, Human
ttttcatctttaacacaacttttttacatttaagtagtcatccttacccaaaggtggatagtctgagaagctctcaacacacatgggcttgccaggaaccatatcaacaatggcagcatcaccagacttcaagaatttagggccatcttccagctttttaccagaacggcgatcaatcttttccttcagctcagcaaacttgcatgcaatgtgagccgtgtggcaatccaatacaggggcatagccggcgcttatttggcctggatggttcaggataatcaccttggaaaaaagatttgcrttcagtgcaaatccaaagtctcaaatgactttagcctctgcagtaagttaatgttactttaaattgttacctgagcagtgaagccagctgcttccattggtgggtcatttttgctgtcaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtctcca

SEQ ID NO: 22185 - DNA, 601 bp, Human
ccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctyttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtgg

SEQ ID NO: 22186 - DNA, 601 bp, Human
ggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcgggrtatgccgtcacctcagtagttttactgtaaaagggaaatttgaacaacaaaaaccaaaaaaaataaaaataaaaaacttcaaaagttgacaagaaggctggagaatgactggacttgaattgggacaaaggcttggttagaatggctttcagctgagggttggattgcatgaaaccaaccaaggggggtgggtagggatagggctagtttggagtggtgaggttggcagtgcttggggaggcgaaaatgggctgggcgagaaggcagaggaaggtgtcacctctaggggagggagagagt

SEQ ID NO: 22187 - DNA, 601 bp, Human
tgcctgttgctgggggcagctcctcaatcctgatgtcggggtgcagggtggggtctcaacttgaattttcactatctggcctgtatgtaacccagagtcagggttctggggagagaggagccacattgctagtcctcctcattcaaggaacccaagagtccatctttggccctctccacccctccagccaatggggatctcaggaatccaggccccagcggtctcctccctgagagacccaggagtctgcacccatgcccttcctccatcaggagacatctcacctgcctttatgccaaatttttttttttttttgagacggagtctttctctgtcacccaggctggagtgcaatggcatgatcttggctcattgcaacctttgcctcctggattccagtgattctcctgcctcagcctcccgagtagctgggattacaggtgtgcaccaccacacccagctaattttgtatttttagtagagatggggtttcaccatgttggccaggctggtctcgatctcctgacctcaggtgatcctcccgcctcggcctcccaaagtgctggggttataggcgtgagtgtgcctggcctgtgccaac

SEQ ID NO: 22188 - DNA, 601 bp, Human
gattacaggcgtgagccaccacatccagccagtacctcctgttctgaagaggccatatagataaaagcatgctataggtttaaagaatagagaggggaggccaaggcgggtagatcacgaggccaggagttcgagaccagcctggccaagatgatgaaaccccgtctctactaaaaatacaaaaaaattagccgggcatggtggcgtgcgcctgtagtcccagctacttgggaggctgaggcagaagaatcgcttgaacccaggaggtggaggttgcagtgagctgagattgcactactgaactccagcctgggcaacagagcaagattctgtctcaaaaaaaaaaaaaaaaaaaaagaatagagaaaaatctcccaagattctgagaagacaagagtatttttccaaagctctaaggagatggggctggtgctctgaatggatgcctgggaccatttcatccaaattccaaggggatggggctgaaaccacttaaggttctaaaggggtggggccaggtgcattggagttctaaaggaatagagctgcatctatctaaagttctgtgtgaaagatttaatgcaaaactaagattaaagga

SEQ ID NO: 22189 - DNA, 601 bp, Human
attacaggcgtgagccaccacatccagccagtacctcctgttctgaagaggccatatagataaaagcatgctataggtttaaagaatagagaggggaggccaaggcgggtagatcacgaggccaggagttcgagaccagcctggccaagatgatgaaaccccgtctctactaaaaatacaaaaaaattagccgggcatggtggcgtgcgcctgtagtcccagctacttgggaggctgaggcagaagaatcgcttgaacccaggaggtggaggttgcagtgagctgagattgcactactgctctccagcctgggcaacagagcaagattctgtctcaaaaaaaaaaaaaaaaaaaaagaatagagaaaaatctcccaagattctgagaagacaagagtatttttccaaagctctaaggagatggggctggtgctctgaatggatgcctgggaccatttcatccaaattccaaggggatggggctgaaaccacttaaggttctaaaggggtggggccaggtgcattggagttctaaaggaatagagctgcatctatctaaagttctgtgtgaaagatttaatgcaaaactaagattaaaggaa

SEQ ID NO: 22190 - DNA, 601 bp, Human
ctgtggtcccagctactcaggaggcaggggtgagagaatttcttgagccctgaaggacgaggctgcagtgagccatgattataccactgcactccagcttgggcaacagagcaagacctggtttcagaaaaaaaagaaaaaggaaattggcaaagcaactactagaactgagaagggaatatagcaaggtaacagggctcaaggtcaaaataagtgatacatctaagtatctaggcttgtatgggcctaaacgggagcagggatggggcagagaagggtcacatggtgagcaagcaggtgragctggaactctggacccacggtgatgtccccctctgtgtcctccttactgcaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagtgagcactgcccctccccaaccctaatcccccaagaattgagcagaagggagtggggtgtgtcaagatgctgggggccctgagaatgggcctctcgtagaaaaa

SEQ ID NO: 22191 - DNA, 601 bp, Human
aaagaaccacaactcccagcaggcagcggcgctgcccacgggccctccggcgcttctttgcccccatgggatattgggaaatgtagtcttgagggggcactgcatgacgtgtggttttcatcttccgcaggcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgarcgccccgcctcgctcggctgcccccgccccttcccggcccccctcgccgcgcgtcctccaaaaaataaaaccttaaccgcgggctctgccttgatcttccttccttccgcctccagggacccaggctgcgcacgcttgacctctcctgaacctaacatggtccccaccgccagctgctcagccctcagaatgcccatctcccagcccccaaccccttcctcccgaggacacaggagccgggaccccaggcaccttttccctcccacagacccaagagcctgggccttccccgctcaaggc

SEQ ID NO: 22192 - DNA, 601 bp, Human
ccgccagcgccgggctgtttttttttttttttttttttttttttttttcaaatctctgacagctcggatctttgcacaaactctctcgcttaaaaaaaaaatcacccaggcacactttttgccttcaaaccggaagcacgtgagtcagggccgcacgtgtgcggagccaatggcgagccgggactcgcgctgacactcgggcctcggcccaatgggcgcgcgcgggactttgcggataaataatccgggggcgtcaaccgctggcggagagggggcgcctcggcgctggccctgtgcgtcsggtccgccctcccccacccgcgcccgcacccgcgtccctccccctccttcaggccgggactcaggagggggcagaagaaacccgggaggggtgaattttgggatgtaggcaaatggagaagcaactccataaacaacttgttagagaaatgcaggattatgggtctgtgagctccgggagcaggggcagtaggcaggagcctggctgttttgcacccccacgcctaagaaactcagctttttattttctcctctgtctctggttgctgttattgaaggatgggtggttgttgtcactgcc

SEQ ID NO: 22193 - DNA, 601 bp, Human
ttttctttctgcaaccagattcaatgatttgatttaaatggggagtaagccacggccaaaaaaatgaaggaaaaaaagaaaaagaaaaggaaaaagaaagcaagaaaaaaagctccaataatttttttcttaaagggaaaaaaatagtatttaaagtctagccatcttcctaggcagtagtgaggggtttgacttccccgagtgtcacgctcagctgtgcccagagcgtgaggctggcagcgcctttaatcgcctttgctttttttgcagggagagcgcgtctccgccagcgccgggctgkttttttttttttttttttttttttttttttcaaatctctgacagctcggatctttgcacaaactctctcgcttaaaaaaaaaatcacccaggcacactttttgccttcaaaccggaagcacgtgagtcagggccgcacgtgtgcggagccaatggcgagccgggactcgcgctgacactcgggcctcggcccaatgggcgcgcgcgggactttgcggataaataatccgggggcgtcaaccgctggcggagagggggcgcctcggcgctggccctgtgcgtcgggtccgccctcccccac

SEQ ID NO: 22194 - DNA, 601 bp, Human
cacaaaaatctattcatcatgccatgccacaatccacatatcaagctagctctcactcagctccctatctcacctccaggtcacagctgtattcggtgccatctaagagggtcactttacactggacagttttggtcttcttggtgactttttgagatgccttctctgctttcagctcattggtctgcacttccttggtctccctttttgctgctcctccttctaatttgtcttcctgtgtttcttttaccttctcttctctctccttacttactaattcagtaggctgttgaggaaaaaraaataaattcatactatagtcaaccaccttgcagatgacaacatactaaaaggaaaatctttcataagaattaggatcgttactttaaacactgtaactttcagatttttaaagacttgaaaattccaatagaaaggatatttcccctcatcctcttttcatggccaaaattctcattttgccaagttggttatttggcattaaatgaatcaaagaaactacatcccagcaactacaatttaagtatcatctcaaataataacatttccaattaaaatcttataccatggcaaaacctag

SEQ ID NO: 22195 - DNA, 601 bp, Human
aaggtaagcataatgtatctggtgtctacttattcctcttctttttctcccttttccatcatgaagcaagcataaatggatgaaacaccaagaaaataaatgcaagaaagagaatgtgggaaaccaggaataataatcaaaaggatagtgaccaaccattccagcctgcctgggactggttccagctttagcacttaaagtctcatatcctgagaagcccctcagtcctgggcaaatcaggaggttggtcactctaatcaaagacgtttttaaaaaggaaaagaaagatgagtctacaggragaggaaatgggaaaaataaggtatatgctcagaataaaaaaagagagtagggaagcaaagaaatgacaggaagactaccaaaaagataaataattcgagagagaaagaaataaagaaaacaaatgtgaagaacctaaaatgggagctagatggtagatgaaaagggcaagaagggaaaggacagattggtttcagtattttgaccttaggaataataagtaagtaaggaaatgaaatcaacagtacaaagggcatcttgcatgctggcacctggagaagaggtttctcctgggacaact

SEQ ID NO: 22196 - DNA, 601 bp, Human
taatccaactataaatcagcatgcagaatttttttatttaaataaaattaaaattgtttataaaataaaaatgaaataaaaaataaaatagaaatcaattacataaataagccaccattaaagagtaataggttctctttcttataaacatttactgatacctcaacatgtgttttatatggtgatctattatacaaaaattttaatataacctccatgtaatagttctgagataagattcaatttaaccacaggatctcctgttgccaaatattctccacccttttttttttttttaaaattcaggattttctacattgttgtggggaaggagagtaatgatcaagagataatagctattcaaaaaattattaatgggctatttgaagaaggtgttaaaagagatcccaagaagggaaagcatggtataatttcatgatactttaggacaatacaattatttcccaggttttagtagagtaggtgtaagtatattcgtatataacatacacttggctgtattgtgccataaagaatgaataagtcaagcaaccatatcataaatggcttgttaaaagttaaaacactgctatttatacgt

SEQ ID NO: 22197 - DNA, 601 bp, Human
caagcagactcttttgctaagcccctctagttttctaaaagtcatgcactgcacacagttgtacttgaccatgtaagtaaccttttaaaaatatggtatataaaaatcatcctttaaaaaaaaaaatcaaccctttatacttcctctcaccaaagctaagaaatgctatccctggtacccagtgtaatcaggctaagatttcaagctacttgttgattgattcacaatgtttctggtacccagtctaactgggctaagatttcaaggtacttgttgattcacaatgtttcttggttgccaytcaggtactcagaatcaataaatattctcttgctcctaaacagaatcctttctttgcaattcaagtgtatgttcttatagctcacacaatctccaaggagatggaaatgaactagctattgactctacataagaaatcctaccttgtttggttctggagggagaagagagaaagaaattaccagttcaattggacttttaaaataatttcattttgctaacctcatatcatctttgtaatatgagactagtatataagcacacatgagttatatacaataaaaatgaccttggtattaaa

SEQ ID NO: 22198 - DNA, 601 bp, Human
gattaccacccaaatacatcatcaggcagggcggggactctgtttatcatcactatagtcccacagttactggagggcttgccacatgacaagtgctcggtaattgagagactgaaagtcttctcgctatcactacagtattttgagtattttatgccttgcagatctccttttaaggaggattatatgtttccttgacccgtagaaaaacataagcattaacagtacatacttcagacaactgaattttcaaccatgggtccaggttatcctcaaattctctaataaacaacagtgatgkttctccacattttatggaagttttagaacctaaacacaaagatttcatcttgttgcttccttttatattattgtctctgcttttcacattggtcctttcctctgttttcaaagcctaagtctaaatcctaaaaacttcaaacaaaaaatggcatgagcttcctgaattacccaactgtaccttcacacagcactatgaagcattcttcaaacattattcgaaatagtgttcttgcccttctcagaagcctaccccagcttctaaatgttcactcaagtcatggtgaagatttcgatcatg

SEQ ID NO: 22199 - DNA, 601 bp, Human
ttagcagaaaaggcctgggctttgaagccaggaagacctgactctatatgaccttgagcaagttaatttacttgcctaagggtaatttcccacctataagacgctaagaactctacctccctttgaagatgagcatgaacattagataatataaataaaatatctggtacatgcttaagaatcaataactagtagctataataattagtggctataatgtttctcattcaatgttccatgtggctcactacggttataaaagaatttccgttttccatgaaataaaatgcagaaacatgtsatatataccctgtgggtttcccccaccttttaagccccactatcaattcctcttggtaacattttaaaatgtgatttctactctttaacttcaccacttgctatggtcaccatggatcctcccaaatcaacagcagagtcctcattctttaagaccttttagagactggcattcatactggcagctggccatcttagtcctgtggacacttgcctggcctgggttttagggcccaatcctcttcctgctctctaccctacacaatcaaatggggagtgctggcctctggtccaggccttg

SEQ ID NO: 22200 - DNA, 601 bp, Human
atcttagctaaaccaacgggtcatcttccaacggaatcacctgtacatttcagttactattcctacgtccatcaccacctacactggtaattcaaatcccaatgcctccttatctccctagctttcttaccacatatagtaataaggacaattataaggcagaagaaatataaagtaaatgtcaaataagtatgtggacatgtttgtctccaatgtgtatgtgttagggggatagggagaagaaggtgtcatggggaaaagtacatttttccaatacatgaaaacatacagtcttacaagyatagtttctcagacggtagttataaaaataatgaaaggatacctcaagggctccacgttgccttgattagtgctaggtgaaactccaaaaggaaaaattggataatcctgtaaatcatgctcaaatgtctagtaagtgctacaagagaagctatttaaatctcccatggccattctctccagtaagcaaggcaacagacctgtgggttttgtgcagctctgccaccttctcttccagctccttagtctgagtaggggcaaactggaattcactgaggtcgatgctgccatgttcttctgg

SEQ ID NO: 22201 - DNA, 601 bp, Human
tggtttgggaaagaagttaagtcaggaggcagctgatgagaatatcgaagtgaaacctaagaggagggatagtggaaagaagaatggtagcaggcatgaggcagtgtggctgtggtggaaggaaaggtggttagagtcagaaagtggagctctagacagctgcaggggcagctcagttataaatgacaatgcatggacagaaatggacctgggagggactgcagacaaaggagatgaggcaaggaggggagaaaagagttcaaagacagtgggttaatgcatctgccacattccccaccaytaccacctcctaattcacagaggttactaaaagcaataccaagctgttttctttctttcttagaaaaaaagagagatggagtctcagtatgttccccaggctggtctcaaactcctggggtcaagtgatcctcccacctctgcctcctgagtcagtggaattacaggcatgtgcgatcatgcccggcttccgagctgttttcctaaaattacctgtagaaagtatgatgctccacgcacactttccatagtcttttcgctgcccggtggtttggcagtttgaatccaatggtactctcaa

SEQ ID NO: 22202 - DNA, 601 bp, Human
aatgaatgctagcacttgccatttctgaacagattattgctttttttttttttttttttatcattatgtgacagggaaagctgttgtctgcccagcttggacctgtgtcataaatgtcatctactagctttatatgagctggctcatgttgtctggaggagaaatttgttatggctaccaagaaaaattataaagttttcaaagatttatatgatcagtgtaacttgagggattcaagcatattttatgagttatatttctcctcaaaaattaacatattagtcttgaaaaatagatattgtcaatttaacgtcaagaaagaatcatgtgtgccagctgataattcacattaaaaatagcaaactgtgataccaaacgaagaataatgataatggtgaagataaattttatgatatgccagaaatggttctaagttgtttcatgtgtgttatctcatttaattttcaaaacaatcctatgaggtagatactagtattactatcatatatggatgatggaagtgaagcagagaggttggtatcacggtgacacagctcgtatttggtagaacagtattagaccataagtccagagcaaaaac

SEQ ID NO: 22203 - DNA, 601 bp, Human
tccatggtacattagcaaaaatgaggaggcctgaggctttgcacagctaatgcacctcggaaactcctgctacaagaatacaagaagaggacagcacagaggtgaggaatacaggtgtcagaatcaggaagcccggtccccatctctgctcagatgcctggctgctgtgctcctccacaggcaccgatctctaagcatcagttgtcttgcctagggcgagaaatagaccacgatataaagcaatcaattctgtgtctgactctaataagtgttcaatgaatgctagcacttgccatttctraacagattattgctttttttttttttttttttatcattatgtgacagggaaagctgttgtctgcccagcttggacctgtgtcataaatgtcatctactagctttatatgagctggctcatgttgtctggaggagaaatttgttatggctaccaagaaaaattataaagttttcaaagatttatatgatcagtgtaacttgagggattcaagcatattttatgagttatatttctcctcaaaaattaacatattagtcttgaaaaatagatattatcaatttaacgtcaagaaagaatcat

SEQ ID NO: 22204 - DNA, 601 bp, Human
aaatttaaaactgcttttgttaaccattatatcaaaagtttgcaggagcaaattggtctacttttaaactggagtccatggtacattagcaaaaatgaggaggcctgaggctttgcacagctaatgcacctcggaaactcctgctacaagaatacaagaagaggacagcacagaggtgaggaatacaggtgtcagaatcaggaagcccggtccccatctctgctcagatgcctggctgctgtgctcctccacaggcaccgatctctaagcatcagttgtcttgcctagggcgagaaatagcccacgatataaagcaatcaattctgtgtctgactctaataagtgttcaatgaatgctagcacttgccatttctgaacagattattgctttttttttttttttttttatcattatgtgacagggaaagctgttgtctgcccagcttggacctgtgtcataaatgtcatctactagctttatatgagctggctcatgttgtctggaggagaaatttgttatggctaccaagaaaaattataaagttttcaaagatttatatgatcagtgtaacttgagggattcaagcatattttatgagtt

SEQ ID NO: 22205 - DNA, 601 bp, Human
agcctcccaatgtgctgggattacaggcatgagccactgtgcccggccatatcagttttattactacattcttattccactagtatcaatctagctgattggctatcaattaatagatctgtttacagattaatggcttcaatctgcaagccaccgtaattttctaaagaaatcatttgtacctttcatgataaactgaaacagaataaattccactgacctgattcaaagcaatctatagacaaagtatgactggccctttgtgttagatatattcttttatatagctttgtaagcagcrttatgcaaggtttaaaaatttaaaactgcttttgttaaccattatatcaaaagtttgcaggagcaaattggtctacttttaaactggagtccatggtacattagcaaaaatgaggaggcctgaggctttgcacagctaatgcacctcggaaactcctgctacaagaatacaagaagaggacagcacagaggtgaggaatacaggtgtcagaatcaggaagcccggtccccatctctgctcagatgcctggctgctgtgctcctccacaggcaccgatctctaagcatcagttgtcttgcc

SEQ ID NO: 22206 - DNA, 601 bp, Human
caatctttttgggagttcaactgaaattattttgctctctttgatcaaaagttgacaaatatcttaacagaaacataatctcagagctcttaatttattaaataggaagacttttgttgacaactcaaaaacatgaagaattccaccgaaacttttcctatcatttactatggaagagtgatttcttaaagaacactatcatttcaagtatttctagactttctgtacaatttttttagaaatcatcttctgcaataaagaaaaaaaaaagaatccctgtacaacactcagaatggtgacwggctctattaaatgctccaagcaagggtgtcagctttatttatttatttatttacttacttacttacttacttacttatttaattttttgagaaggagtctcgctctgtcacccaggctagagtgcagtgttgcaatctcggctcactgcaacctccgcctcccgggttcgagtgattctcctgcctcagcctcctgagtagctgggattacaaaggtacatgccaccatgcccagctaatttttgtatttttttaagtagagacacagtttcaccaggtcaggctggtctcaaactcct

SEQ ID NO: 22207 - DNA, 601 bp, Human
aaaaatggctatccctgtagggtatttctggtggctttattaactggattaacattttctgacctcatgggattagagaaagatgaatgaaaatcaaaattatcataaatgtgtttacctccatctagactcctggagacccgtttactagaagtgcgctcaaagtgtggtgctggcctatctatgagggtgctggcctggcgggtctgtgcttgggtgcggccactatagcgaaatttggaccccaaggtcaggaacttggcttttggtggctgctctggagaaacaagcctatgggaggaaaaaaaaaaaaaaagagagagagaaaggggaagcaaaattagactttacggaattttttaaaaaaactttaaagctatgtactttcatatctcattttaagtatgattactcaaaaactaaactttctaaagaacattatttataaaccctcctacacacacagctttatgatggtgatgagtaaatccacattcatgtattcatgaataatgttcttctccacctaagcaaagaaacagctgttctcagtatatcaaaggttatttatttgtattagcttaaatcatttatataaaca

SEQ ID NO: 22208 - DNA, 601 bp, Human
acacaaagagaaaaataatggattactgtgccatgtttgttgttttcacttggaaaaatcattgttttcagatacagacctcctgtaaccctctgcactaactgcccatacaagatggtggatttccttgagcacagtttgtatacctcaaagaaaatgctgttttactgctctttttaaatgctaaactttgcaatataagagttatacagcctcacagtttcaaacaaatgctgaaaacagacagtgttccagaaagagcaatcatttctctcagggtactaaacaacagtgactgcayttattcggcacttgtataaattctctgtggcaaggggcaaggcttgggaaatatttacatgggttggcacatttttcagatttacttggaaaagtgctcagttgttgaagacctaaaagatactttagcagtgatagtacattaacaatcaactgaatttaaatcatttccacaattctggaaatttgtttaaagcacagttcaccacccccttgcacatttcaggatttaataactatataccaaaatcccaaccaacaaatcctggcaaatatctctatgtgtccacctgcatttgtt

SEQ ID NO: 22209 - DNA, 601 bp, Human
aggaaaaagaaaatacaatacatgaagactacaacaacaaatggtatgttgataaggagtggtaaagaaaataaaagctcagtgccaggttacagcctagctttgctctgggggaaaaaacggagaatataagccctaatcaaagagttcactggctgtctggtcatgtattggcgttaaaagcctcctatttttcacaataacacaataatccttttgatgacttacccatctgatgaattacggcctccaaaacacaaagagaaaaataatggattactgtgccatgtttgttgttttyacttggaaaaatcattgttttcagatacagacctcctgtaaccctctgcactaactgcccatacaagatggtggatttccttgagcacagtttgtatacctcaaagaaaatgctgttttactgctctttttaaatgctaaactttgcaatataagagttatacagcctcacagtttcaaacaaatgctgaaaacagacagtgttccagaaagagcaatcatttctctcagggtactaaacaacagtgactgcatttattcggcacttgtataaattctctgtggcaaggggcaaggcttg

SEQ ID NO: 22210 - DNA, 601 bp, Human
gtcctttccttggctgcctccttctcatccttcaagtctcaactgacctggttcttcctcaaataggccttccttccctgatgatcctatttaagtaacgtccctgttcattttactttccaccttcaggaaatcacttggttcctcaacccccaaatgcatcttggttgttggttctcttaaatgactgatttgtcttctttggggtttgattttctaatctcggaggggactccctgtcctaaaacagctgttctagattgattttcattttgatatttgatctttagattgaatcccrcttttcacttgctatgtaatcataagaggatttattttaatttgccaaactttaaagtgaggctaatatacctaaattattctagccttacttaaaaagtaaacaggaaaaagaaaatacaatacatgaagactacaacaacaaatggtatgttgataaggagtggtaaagaaaataaaagctcagtgccaggttacagcctagctttgctctgggggaaaaaacggagaatataagccctaatcaaagagttcactggctgtctggtcatgtattggcgttaaaagcctcctatttttc

SEQ ID NO: 22211 - DNA, 601 bp, Human
tgaacctgggaggcagaggctgcagtgagctgagatcgagccattgcactccagcctgggcaacaagagcgaaacttcatctcgaaaaaataaaaaaaataaaatagaaaacactatgaaatcaatatgatggattcatttgtttttatctgtgcttacttccaatgttgcatgcaaaaaaaagtcgctttgtgcagacacagaaaagagatctgaagaattcaaaggcttctcaaatcaatattcaagtgatgttactgcccaaggtaacaaaagataacagtgacacatttgagaacamaatatgggttacttctccatttcaccatggtgtacgcacaagataaagccaaaagcaacacaccatgttctcactctctattcacaaaacaattaccttttcttgagaatttcattaattatagatcattaatgaatacatttgttcataaagattatctttggtgatgtaaaaaaattcaagtcaataattaaaataatcaagaagctacattttaaattttacttggaccaaaccaaaaataaatttcaaatcatcatagcttttctactttgaggattcaattagataaggtgatta

SEQ ID NO: 22212 - DNA, 601 bp, Human
attctcaaacagaatactgaaagtggaccacattcccaatcatggattttaaccaaaaaaacaaaaaaagtgggcacagatcaagatcaagagtcacatgatttaatgccagatcaataaacaaatctctgttctagttaatacatattaaggatgagattgtgttacctcaggttgatgccctagagttaaccctttaggagagaataggtttacttgtagaacaacttcaagagtactggataaaaacttgattcatttgactaaacttttttttcccacttgtcactttgagaacttstagtagatacagtcctgcctaagccacttgaaaggaacaccgtcaggctggtaacatgcactcccgagctgaattcccccatgcactgcatgcaccgtgcttgaagaacattgccagccagcctaggcgtgacctcccgtccacagcagccgggcagccattaggacagagttgttttcttagattatacaaacctccaacattaaattgctatgtctgacataaatattatccccttctactctcaaggaatttttctgtgaaattaaatcacacacaggggggaaaaggcaaataaac

SEQ ID NO: 22213 - DNA, 601 bp, Human
ttcttcaatgatttacattttaaagggttctgatttcttctctatttaggatttttaaaggaataattatttacattatcagaaagatgacatggaactgatcatcaaaatggctaataacacttccttccagtacctggatttgaaactcagactatgactttgttccagcaaatttacctttctgattaggactactcctaaaattgcattctgtgaatataggaaatcaagtacaaaatagaggaaggtagagactcagaagcacactggctggaagaaaaagccagaccaggatcawcccccagctggaaaagccaaggttttttgtttgtttgtttgttttcaggaaattccagtgatggcttttaattcttaaggaataaaaattactgcttccagaggctgcttctgtttagcctctttatagaataaataaaccacagactggtctcatgtacttgccaagcacaaaagtggggtctagcctccgcaactgccagatcgtccttatacagacaaatatacaagaaaaactaccaggtccattttcatgggagcaggccctgataaatggtatttgtggaatttttttcgactg

SEQ ID NO: 22214 - DNA, 601 bp, Human
cctatttcagatatcagtaactaaaaagcttattaaatacagtatgttagtttctaaattgtcctatataacaattcattactacaatttacctgagtaaaatagtgaaattatcctaaaactatttcaaaagtattttgaaactcatgcaatttacctaagaactaggccaataactattacattgttaatatttagtatttacaaaattgttagtaattacataaaaataattaaatgggaacattttgtaacttccctagactcaacatagagattaacaatttaagttttattgagyaactgaagtgagacagagccaacaaatagctaatgacataccccttgtgtctgtagggacagaggtgtgatacgtcgtttttcccattcattagggcgcggctcaggtgtggattccataaaattgcgcttgagttcactaatgctagcctgatgtttcagtatgtcctcctgggccttatccagttcctagcaatatgtaacgtaacaaaggggggaaaaatccaaaaggaaaaaacccagtaggacaaaaataaaaccaaaaaataagacaaagcaaacttacgattaaaaaaaaaac

SEQ ID NO: 22215 - DNA, 601 bp, Human
tcaaaaatcatttcaaaaaaattttagtatgacacacaggaaaaaagaaatcttatggctgtggatagaaacaaaaggaaagggggaaaaagcaagagtagatccaagggtgcaaggtgaacaccttgtccgtctcctgagctttttcttcaactgtccatattgtcggcatcaggtacttctccttcacggataaaatatccttgaaaagatggtctccttttctctattgttttaaacaatagacataatcaacaaataagacacatacattacacctatagcaacacaaacacaaaayactgacccagtgtgggtcaatgacacacaccaggagaagtggcacataatggaaggtgaaaaccttggcatggcatcagaccctttctccagaaaacacaacattctggaatagactgctgaaattgacattttttatcatcttcagaaaaatctgaaactaagaactgaagttgtattcaacttcataagactctaccaagcatgtcttaatattttcaaaagttctgtgtttcagttcagcaattctttttgctcatctgttcttaaagagctttctttttcaatggcacaaacttag

SEQ ID NO: 22216 - DNA, 601 bp, Human
agtgcatctcaaaaaaaaaaaaaagaagaaagaaaaaaaagaaacttttctaattaactatttccatgtctcctccactagactccaagctctccagtcccagcaaataacagactgaccacctggctaagtaaaatcagtagaaagagaagaatgaggatgtaaaagcaatggaaagtgaacttcctcaccagtgtcagaaatgtcacacatgcaggagcagagagagaggtgaggggctgctatggtgcatcaaaatctttgttcccattaaaaatcttacaagtgaaaactcaaaagrtttccatatgtaattagtaaactcatcatctaaggcacataagtggttattttaacaacacgacatgcataagtattgtacaaacagtgcactttcacatgaaatcagtttcccaactgtcagccacatacatcaaattaggaatcagttatcacctaaattggttgatgtttctgtatttcaaattttgacttttcaagtgcttctgcaatatggtatttctcatccaacaatcctatgcttctatacacaggggatttaactttttaaatgctcaaaaatcatttcaaaaaaatttta

SEQ ID NO: 22217 - DNA, 601 bp, Human
ttccaattttctgctctactctcaaaattgttcaaactacagccactttgaaaatgcaatgtattttttttttttaaaaagaaactattcctgcttttttaaaaagctataaaagcccatattatagaaatttggaaaagtggtcaaattatatacttatgcataatttttttattttactttcaataagaattacaattcaaagataaacgagaacccctgcagaattaacagtaaaatgaagatacaacaaagacagaaattgaaaaggtactctggtaaagtcaaaacactcccgtagacaaatgctcacatactttcaactaatagtagtatgttatttaaagaaaaacaaaaaagatacaatgtaggtggtcaataaatgtttgttgggcaaacggatgaatggatgattgtaataagaacaatctatatgaatgtcaaaaaagtatgtattttcctgcatgtattggagaggaaaagaacagaaaaacaagtaacttcaagtacagataaaccacttgggggcttttccagatttaaatttcacattaacatcactttaatgtgacttctatgacaagatattttacactgtaca

SEQ ID NO: 22218 - DNA, 601 bp, Human
gtttccaattttctgctctactctcaaaattgttcaaactacagccactttgaaaatgcaatgtattttttttttttaaaaagaaactattcctgcttttttaaaaagctataaaagcccatattatagaaatttggaaaagtggtcaaattatatacttatgcataatttttttattttactttcaataagaattacaattcaaagataaacgagaacccctgcagaattaacagtaaaatgaagatacaacaaagacagaaattgaaaaggtactctggtaaagtcaaaacactcccgtagacaaatgctcacatactttcaactaatagtagtatgttatttaaagaaaaacaaaaaagatacaatgtaggtggtcaataaatgtttgttgggcaaacggatgaatggatgattgtaataagaacaatctatatgaatgtcaaaaaagtatgtattttcctgcatgtattggagaggaaaagaacagaaaaacaagtaacttcaagtacagataaaccacttgggggcttttccagatttaaatttcacattaacatcactttaatgtgacttctatgacaagatattttacactgta

SEQ ID NO: 22219 - DNA, 601 bp, Human
ctcaatgtacataatctcttagactcaggagagaatagtctatgcaaatttaagtcatcataattcatacaacacgttaagaggattacaatagagttatttacccattaaagattaaatgacttggtttccaattttctgctctactctcaaaattgttcaaactacagccactttgaaaatgcaatgtattttttttttttaaaaagaaactattcctgcttttttaaaaagctataaaagcccatattatagaaatttggaaaagtggtcaaattatatacttatgcataatttttttattttactttcaataagaattacaattcaaagataaacgagaacccctgcagaattaacagtaaaatgaagatacaacaaagacagaaattgaaaaggtactctggtaaagtcaaaacactcccgtagacaaatgctcacatactttcaactaatagtagtatgttatttaaagaaaaacaaaaaagatacaatgtaggtggtcaataaatgtttgttgggcaaacggatgaatggatgattgtaataagaacaatctatatgaatgtcaaaaaagtatgtattttcctgcatgtattgg

SEQ ID NO: 22220 - DNA, 601 bp, Human
tttagtagagacggggttttgccatgttggccaggctggtctctaactcctgacttcaggtgatctatcctcctcggcctcccaaagtgctgggaatacaggcgtgagccaccgcacccagtcactattcagaaatcttaaagaaaaatcaatgacgctcctaaggggccccttcatactgtgagctaagaagggtgaggagcgcagaaagtgaggtgaggagggtgaggggagtaggcacttgcaatattcagcagaggaaaaagcttttggactgacttaacttcattaccatctctaygattacatcgtcccttggggaagtgggggtgggtgggatgcccttcccagtgagagatcactggggaatttaaagaagtgccacacatttcgttatccaatgacataccttcaaaagtaccttacaactcaatgtacataatctcttagactcaggagagaatagtctatgcaaatttaagtcatcataattcatacaacacgttaagaggattacaatagagttatttacccattaaagattaaatgacttggtttccaattttctgctctactctcaaaattgttcaaactacagcca

SEQ ID NO: 22221 - DNA, 601 bp, Human
aaacaaaattgatgttatctcctcttctaggctctagagaggtcagaaaaggaagagcaaagaattagcaataagtcagaacagacagcagtgacctattggaagaaaggaaaggttacacaagaaagaacaacagaacagcataaaatgaaagaaaagatgagaattctgacagattctggagcaggcttatgaagaggtttgtgagcgccagcttttccaccctgcttgagaatctttgatagttgcgacctccagaaaccagtgaaaactgcttggctgatcaccaactgagcacaaycgacccacccaaacgccatttcatatattcttgaggtagttccttggcctttctctgcacggaatggcctcttcagtggcccctacacttgaaatgcttattcctgtgttacagcttgggcagtcctccctctcctgcctccaaggcccttctttgcccttatctgcacattctgggcctttccagttttctaacctccctgaggcccacttcatagtctgcattttctgtaaggccttccctcaccactccaactcctacaatctccctcctcaataccaccttaactctctgtacaac

SEQ ID NO: 22222 - DNA, 601 bp, Human
attaataccatgtaaatcacattactaacagaagacagctatctttccagttttattgaaaactcagaggtttctagatattaaactgaaaaaactctcaatctattttgataagcaggtaaaatttaaccatgactacatataataaacatatccagtgaccagaacatttctgaaacacacatttcattattattatagatcagtgaattattattattgttatatcttaacctcaattagctggataggttctgcccaagttcagggaattccttagggtcattcaaaagcaattatktcatggagcatgggaggcacttcagattttttccatataaacagaattttaaaaataacatgccatcagaggatgcctgaaatttggggttttgaaaatgtcaactctgcaaagcatatctggttgagggtttccctctgcttaacagcccagactctggaacttaatgatttaaattattctctgaatttaggcagattttttttttctttgaccaaagaagcaggagaaacatccaatctatatcttttcttcatgttccaattcagtcattgtttcttgaatgtttctcccaggaag

SEQ ID NO: 22223 - DNA, 601 bp, Human
aaaaaatttaacttttaaaacctagtaacagttttggttttaatcagactataaagtctagcctggaacgctgattcttaaatgaacacagcaccaaggagatggcacttttattttttgctggttttctttaaaaaaaaaaaaaaagttttaattggcaaaattatagttagcctcagaaggctattaacatgaaaatgttcattccagaaatggttattaactttccaattcgtatcataggttggcaaaggctatattatacaatagggtgggtgtcaatggtgactccaagtgtttycttttacaatttagctcctctactagcatctttgaaatctaaactcagtcaagtttattatttgacatgttcactcctatccccttcagacatctacttcttgggagtaaagtaatttactccagttgagtaatatagcacctaaatgttcaataaatatctgttgacttaatacattaggaacaaattactatgttatgatattattaactagggtggaaacctttttgtacagaggggtttttaaagcttcacatttttctcacacttacaaaaagtctgctttacaatgatataact

SEQ ID NO: 22224 - DNA, 601 bp, Human
ctccctcagcctaactcccaaatgagagacactgcacttagtgaccaaaaagttctcttctttgaaaagaaaaagattcatgtccaatgtatagataatccacaaaacatataatcatctggcaaatactccagaattgacatcaggatagaatgagaagcgaggatatcctcctatcaaatagcctagcctctggctgcctggaagaaaagaaaggctcttaacaaaaccatacaacccctgcaatcccaaaacagaaatcacagtggcattcaagaaataacattctcatcactgctgkatactgcattcagagaaccacggtaatcagagactgctgtcatttctaaaactctgaagctgaagaatgagccaagaagtcaaacccaatcatgacatcaggggcacacacactcagcagtgaccattttttttttcaacattacatatacatttttctaattaaaccaaaaggggaaaaaaaggcatttagtgtgaggaagcagtgcaactgaagacaaaacagttgaaaacacccaaaacatgcaaagaaaaatttaaatgtgaaaagggaaggaaaaattgatgtggtgcttctagg

SEQ ID NO: 22225 - DNA, 601 bp, Human
cagactatactactaccaaaatactgcagtactttctttgagagaacattctcaacaggcataattatttaaagaggagtaacgatatgttaaatacagaatagttcaaagtgttcaaagactcttgaaaaatcttctctaaagtgaaacagaagtttaaaagtaacatggttaaaatccacttaattattttaagacaaagtcacttcaacattttccatcccatcgaagagaacaaaataaatctctgtactgtgggcatttaatattaaaatcaagaaatattcccaaggaaataaamcctccctcagcctaactcccaaatgagagacactgcacttagtgaccaaaaagttctcttctttgaaaagaaaaagattcatgtccaatgtatagataatccacaaaacatataatcatctggcaaatactccagaattgacatcaggatagaatgagaagcgaggatatcctcctatcaaatagcctagcctctggctgcctggaagaaaagaaaggctcttaacaaaaccatacaacccctgcaatcccaaaacagaaatcacagtggcattcaagaaataacattctcatcactgct

SEQ ID NO: 22226 - DNA, 601 bp, Human
taaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagttaaaatgctctatctaaaattactccatcaatgttacaccaatgctttgaacaatttaaaacattaaaggaaatattcaacggcttattaacattktagtctgccgagtatgcatgcttaatattaatgcaacaccagactatactactaccaaaatactgcagtactttctttgagagaacattctcaacaggcataattatttaaagaggagtaacgatatgttaaatacagaatagttcaaagtgttcaaagactcttgaaaaatcttctctaaagtgaaacagaagtttaaaagtaacatggttaaaatccacttaattattttaagacaaagtcacttcaacattttccatcccatcgaagagaacaaaataaatctctgtactgtgggca

SEQ ID NO: 22227 - DNA, 601 bp, Human
ctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagttaaaatgctctatctaaaattactccatcaatgttacaccaatgctttgaacaatttaaaacattaaaggaaatattcracggcttattaacattttagtctgccgagtatgcatgcttaatattaatgcaacaccagactatactactaccaaaatactgcagtactttctttgagagaacattctcaacaggcataattatttaaagaggagtaacgatatgttaaatacagaatagttcaaagtgttcaaagactcttgaaaaatcttctctaaagtgaaacagaagtttaaaagtaacatggttaaaatccacttaattattttaagacaaagtcacttcaacattttccatcccatcgaagagaacaaaataaa

SEQ ID NO: 22228 - DNA, 601 bp, Human
aaaagaaaagagtaaaagcaaacaacctaaaacaaacaaaagaaataaaagaaaaattttccttcaaatatatcatatatacacatacatacatgtgcacatagatacgtacatatatatgaatgtgtgtatgtgtacatacacatatatgaaaaataagttgacatgatggcttcctaaattatgttactctttaaattaagatggtcccaaactacttttatgtcaagcctagtgtatagtgacacacacacacacacacacacacacacacctctctctctctctctctcctcctccctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagttaaaatgct

SEQ ID NO: 22229 - DNA, 601 bp, Human
caaaagaaaagagtaaaagcaaacaacctaaaacaaacaaaagaaataaaagaaaaattttccttcaaatatatcatatatacacatacatacatgtgcacatagatacgtacatatatatgaatgtgtgtatgtgtacatacacatatatgaaaaataagttgacatgatggcttcctaaattatgttactctttaaattaagatggtcccaaactacttttatgtcaagcctagtgtatagtgacacacacacacacacacacacacacacacctctctctctctctctctcctcctctctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagttaaaatgc

SEQ ID NO: 22230 - DNA, 601 bp, Human
gcacaaaagaaaagagtaaaagcaaacaacctaaaacaaacaaaagaaataaaagaaaaattttccttcaaatatatcatatatacacatacatacatgtgcacatagatacgtacatatatatgaatgtgtgtatgtgtacatacacatatatgaaaaataagttgacatgatggcttcctaaattatgttactctttaaattaagatggtcccaaactacttttatgtcaagcctagtgtatagtgacacacacacacacacacacacacacacacctctctctctctctctctcctcctccctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagttaaaa

SEQ ID NO: 22231 - DNA, 601 bp, Human
tgcacaaaagaaaagagtaaaagcaaacaacctaaaacaaacaaaagaaataaaagaaaaattttccttcaaatatatcatatatacacatacatacatgtgcacatagatacgtacatatatatgaatgtgtgtatgtgtacatacacatatatgaaaaataagttgacatgatggcttcctaaattatgttactctttaaattaagatggtcccaaactacttttatgtcaagcctagtgtatagtgacacacacacacacacacacacacacacacctctctctctctctctctccttctccctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagttaaa

SEQ ID NO: 22232 - DNA, 601 bp, Human
tcatgcacaaaagaaaagagtaaaagcaaacaacctaaaacaaacaaaagaaataaaagaaaaattttccttcaaatatatcatatatacacatacatacatgtgcacatagatacgtacatatatatgaatgtgtgtatgtgtacatacacatatatgaaaaataagttgacatgatggcttcctaaattatgttactctttaaattaagatggtcccaaactacttttatgtcaagcctagtgtatagtgacacacacacacacacacacacacacacacctctctctctctctctcttctcctccctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgtttcttctgtattacctaagtt

SEQ ID NO: 22233 - DNA, 601 bp, Human
aacatatccaaacacacactcatgcacaaaagaaaagagtaaaagcaaacaacctaaaacaaacaaaagaaataaaagaaaaattttccttcaaatatatcatatatacacatacatacatgtgcacatagatacgtacatatatatgaatgtgtgtatgtgtacatacacatatatgaaaaataagttgacatgatggcttcctaaattatgttactctttaaattaagatggtcccaaactacttttatgtcaagcctagtgtatagtgacacacacacacacacacacacacacacaactctctctctctctctctcctcctccctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacacaccattttcagaaaggatgtcttcaagtattactgttttcagttatacctgtctaaaatttgcagtgttt

SEQ ID NO: 22234 - DNA, 601 bp, Human
tttagacacatggtatcaccattcacatatgaatgactacataggtctttagaaaataattccacacgaaggagaagcacaggtgtgtgtgcctgtgtgtgtttgtgtgtgtgtgtgtgtgtatgtgtgttattacaagcaagaatgagttgattgggtcaatcttcacggagttagagagggaaagaagcctaaatcacatccacaattagatcggattattattaatcgatgaattatatcagataaactttgcaagacaatttgtttcctaagtgtacacaaacattcttagatatgycaactcagaaatggctttcaatcatatgaacaagattgatactgtctgtcctaaataatcatatgtacagttcccctataattactgggttaccaatttaattgcagctctctgtctcaatctaagagaacatagcaaattatgttgttgaagtacacttacaaagtgcagatacaaaaagctacatcaaagccagaaacatgtaaactaagagaagaaagaatgaaaacatagatacactaagggaaaaaagagctcgaacagtccaagtctagagcttttgtacctgtggagactcat

SEQ ID NO: 22235 - DNA, 601 bp, Human
cctctagcgattgttttcatcaactacattgttcctgtaatagtttgcatgttgtgagcatatatacgggcacatatatttcaatactgcacatacgcatgtgctcctacatatatataaatcccatacatatgttaaaatagattttaacttgtttgctttgatattgaaagatgcagaagattctagagtttccaaggggaatcaatgaagcaaattaatagcctaacagtttatgttaagatcacgaaacatatttgccctctgtttcctgacactgacacgaggaaataactggacrgtccagagcctttctgactgtaagaggaaatctctttcaaacttgggtcatgcacctgtatgtcttcattctggcaacttatcacagcacagacacatcactaatgctcccccgccaagctgttcataagaaacctatttgtgcttatgtgggatcaaggcacacacaaggatgccatatccaaaataattttcagatgtgtttcacacatgcatgcattaaaccttttaaaaaatattctgagaggtcaataacctgacatcctccaccatgatacaattctaccacagaaggttcatc

SEQ ID NO: 22236 - DNA, 601 bp, Human
gggaaattctacattatttgaacaacttgctgaaaattctgaatgatggccttcattcattcgctttagtcaggagggctggtttaataaaagtagaagcacaagtttgtttttataaattataaattttattaaattatttatggttttgtagctatcttacatatagctattcgtaacatatttttacccccttgtacttcacaaaattgcaatttggcttgaatgcatttgtcaatggagcctaatttcttggatactttaaaccaaggcattttgattccgctggcactgtctgtakcttacttggaagtgtgtacaggaagagagaaacaattcagaaaagattctgtctgtaatgtaccatcctctccatatgatcccctgcattgctttaccttggtgatgtgtgtggttgtcgttgttgacacggactcagatgtgatggtttgtgcggtcagtaacgtgcccgaatcaccaccagccccgccatcaatctttggatagttgggggaaaaatacaaagtaatgcttaacttctgttatgttgtcagagaagatccccgccccatcgaatatgcatcttttaaaatccatgtgg

SEQ ID NO: 22237 - DNA, 601 bp, Human
agacaattctaaggtttcaggaggactggagtggggccacgctatttatacttctaacaatgccccgggtgaagctgatgctgctgatccagggatgactggttacccagtgctaaacatttagagaattatgcagggaggaacaggggaatgccccaaatcagtatactagcgatcttaaatgagggaaattctacattatttgaacaacttgctgaaaattctgaatgatggccttcattcattcgctttagtcaggagggctggtttaataaaagtagaagcacaagtttgtttttayaaattataaattttattaaattatttatggttttgtagctatcttacatatagctattcgtaacatatttttacccccttgtacttcacaaaattgcaatttggcttgaatgcatttgtcaatggagcctaatttcttggatactttaaaccaaggcattttgattccgctggcactgtctgtatcttacttggaagtgtgtacaggaagagagaaacaattcagaaaagattctgtctgtaatgtaccatcctctccatatgatcccctgcattgctttaccttggtgatgtgtgtggt

SEQ ID NO: 22238 - DNA, 601 bp, Human
aataactggatatgctttaaaatgagcaccaacagtaccttgcatttatgcggcatttttaaatttacaaattacttttgctgttttttaaattgttgttgaaacatgggttgggaagggcacaagggacacctttaagacctttagacacttatccaaagtaaaaaacagaagaaggaaatagtggaaaataaggctggagttagaaagctgatgacttcagcatgcatcagaatcactggaagcttcttaagacaattctaaggtttcaggaggactggagtggggccacgctatttakacttctaacaatgccccgggtgaagctgatgctgctgatccagggatgactggttacccagtgctaaacatttagagaattatgcagggaggaacaggggaatgccccaaatcagtatactagcgatcttaaatgagggaaattctacattatttgaacaacttgctgaaaattctgaatgatggccttcattcattcgctttagtcaggagggctggtttaataaaagtagaagcacaagtttgtttttataaattataaattttattaaattatttatggttttgtagctatcttaca

SEQ ID NO: 22239 - DNA, 601 bp, Human
ggaaagcttgtatccaggctgtgtctttatgtcctgcttaggaggtggacttcatccaggaggtttggggagaagaggtttacacaggtatgcgacatgatgacaaatgtgaaacttagaaaacaaacagggccatttccaaaactagaacttaacttatttacctggtcatgatcaatatctccatctcctgtgatcacaatgcgtttctcaattcttgtttcagaaattccaccttttacagtctaaaggtcataaaggagaagaagaaaaaacagcaatcactgaagcacgtttacayagtcagagcaaacagagatgggagtccacctagacctgtggatcattgtaaggccacacacaacaagcagcaaaagactgatattctagaaacactttgtgctttatttttaggctcaatagagaatcctattactaaagttatagcatccacaagtatccctcagctgagagcaaccttaaaactcatttatcaatattcaagatggcatctgtcccatcttaatctcacttgattaagataggacagatattatttaatccaagtagttcctttaagggaattctgttatagtttccc

SEQ ID NO: 22240 - DNA, 601 bp, Human
taaatatttgatcacttgcctttaaaccaggcccacacgaatcttatgttttccagaaatcctccagattacgttgacccaaaagtgcatgtaaagccagtgggaaataaagagaaatctgtgttttattctgattcagaggtaggaaagcttgtatccaggctgtgtctttatgtcctgcttaggaggtggacttcatccaggaggtttggggagaagaggtttacacaggtatgcgacatgatgacaaatgtgaaacttagaaaacaaacagggccatttccaaaactagaacttaacktatttacctggtcatgatcaatatctccatctcctgtgatcacaatgcgtttctcaattcttgtttcagaaattccaccttttacagtctaaaggtcataaaggagaagaagaaaaaacagcaatcactgaagcacgtttacacagtcagagcaaacagagatgggagtccacctagacctgtggatcattgtaaggccacacacaacaagcagcaaaagactgatattctagaaacactttgtgctttatttttaggctcaatagagaatcctattactaaagttatagcatccacaag

SEQ ID NO: 22241 - DNA, 601 bp, Human
tgcctcacatattctaggaattcaatgagtgcttattgagaagagtcccagagagaaagaagcaggtttactccaatttctcaggcgaaactcaagactgttccagtggatagtagaataaatcccctctggaaaactggaggcttgtttccacataagtcactcattttcccatggtaagcagacaagtgtactaatgttctctaggaatctccagtcctatgtcctatgtcaaaatccagagtcaaggcaaccttttaacctctaataactcttaagaaaattttaaaagtacattacraatatgtaagtcaaatcatacttacaaaggtcaaaaaaattgggagtaattttcttcttaggcatgaaaaatccatttatctctgatcacatataggctgcctttctcaaatgaggaattttgttctctaaaattttctttcctgagctcagtattgtgtccaaagctgtgtaactatcgttagctcctactccccagctgagatagtcaattgaatatttcttttccttttcttcaagttgttataaaaggaaaacagcttggtctcctttaaagctgagttaaaatcacttttaaaaa

SEQ ID NO: 22242 - DNA, 601 bp, Human
gtaaagggcctaggttcaatggggagaggggggtggaagaaacaatggctgggagaagaccctagtttgcactttccaccatgccaaaaaatgtgagcttgtgcctcacatattctaggaattcaatgagtgcttattgagaagagtcccagagagaaagaagcaggtttactccaatttctcaggcgaaactcaagactgttccagtggatagtagaataaatcccctctggaaaactggaggcttgtttccacataagtcactcattttcccatggtaagcagacaagtgtactaatgytctctaggaatctccagtcctatgtcctatgtcaaaatccagagtcaaggcaaccttttaacctctaataactcttaagaaaattttaaaagtacattacgaatatgtaagtcaaatcatacttacaaaggtcaaaaaaattgggagtaattttcttcttaggcatgaaaaatccatttatctctgatcacatataggctgcctttctcaaatgaggaattttgttctctaaaattttctttcctgagctcagtattgtgtccaaagctgtgtaactatcgttagctcctactccccagc

SEQ ID NO: 22243 - DNA, 601 bp, Human
aaaacctgagtactggaaaggtggcattttaaagtgtgtaaagggcctaggttcaatggggagaggggggtggaagaaacaatggctgggagaagaccctagtttgcactttccaccatgccaaaaaatgtgagcttgtgcctcacatattctaggaattcaatgagtgcttattgagaagagtcccagagagaaagaagcaggtttactccaatttctcaggcgaaactcaagactgttccagtggatagtagaataaatcccctctggaaaactggaggcttgtttccacataagtcaytcattttcccatggtaagcagacaagtgtactaatgttctctaggaatctccagtcctatgtcctatgtcaaaatccagagtcaaggcaaccttttaacctctaataactcttaagaaaattttaaaagtacattacgaatatgtaagtcaaatcatacttacaaaggtcaaaaaaattgggagtaattttcttcttaggcatgaaaaatccatttatctctgatcacatataggctgcctttctcaaatgaggaattttgttctctaaaattttctttcctgagctcagtattgtgtcc

SEQ ID NO: 22244 - DNA, 601 bp, Human
ttataaaaggcaaaacaatacacataagtaaaacctgagtactggaaaggtggcattttaaagtgtgtaaagggcctaggttcaatggggagaggggggtggaagaaacaatggctgggagaagaccctagtttgcactttccaccatgccaaaaaatgtgagcttgtgcctcacatattctaggaattcaatgagtgcttattgagaagagtcccagagagaaagaagcaggtttactccaatttctcaggcgaaactcaagactgttccagtggatagtagaataaatcccctctggaraactggaggcttgtttccacataagtcactcattttcccatggtaagcagacaagtgtactaatgttctctaggaatctccagtcctatgtcctatgtcaaaatccagagtcaaggcaaccttttaacctctaataactcttaagaaaattttaaaagtacattacgaatatgtaagtcaaatcatacttacaaaggtcaaaaaaattgggagtaattttcttcttaggcatgaaaaatccatttatctctgatcacatataggctgcctttctcaaatgaggaattttgttctctaaaa

SEQ ID NO: 22245 - DNA, 601 bp, Human
tggcacttgtatttcagattgtgtttttaatatttgcctttcagaagcagtactatctagatttgaattttggggtaaaacaggccaaaatattcttttgccttttataacaaaattattttggcttttgttataaaaggcaaaacaatacacataagtaaaacctgagtactggaaaggtggcattttaaagtgtgtaaagggcctaggttcaatggggagaggggggtggaagaaacaatggctgggagaagaccctagtttgcactttccaccatgccaaaaaatgtgagcttgtgcytcacatattctaggaattcaatgagtgcttattgagaagagtcccagagagaaagaagcaggtttactccaatttctcaggcgaaactcaagactgttccagtggatagtagaataaatcccctctggaaaactggaggcttgtttccacataagtcactcattttcccatggtaagcagacaagtgtactaatgttctctaggaatctccagtcctatgtcctatgtcaaaatccagagtcaaggcaaccttttaacctctaataactcttaagaaaattttaaaagtacattacgaat

SEQ ID NO: 22246 - DNA, 601 bp, Human
cactgcaagctccgcctcccgggttcacaccattctcctgcctcagcctcccgaatagctgcgactacaggcgcctgccactgcgcccggctaattttttttctatttttagtagagacggggtttcatcgtgttagccaggatggtctcgatctcctgacctcatgatctgcccgcctcggcctcccaaagtgctgggattacaggcttgagccaccgcgcccggctcttactgccaaattgagcaattatttcttagaaagaaatacactctgaagagacactgcagtgtattttaccyctccttggtatggagctgaaagtatcatgaccagcacagggtgaagaatctgcaaagcaagtttctgtaaaagcatgcctctttgatttgccaacacaaaaaagatttcttgttttctgtctggcccagtgaaagtgtccttccattttaagatgccttttttatttttaatttttttaattttgagatggaatcttgctctgtcgcccaggctggagtgcagtggcgccatctccgctcactgtaagctctgcctcccaggttcacaccattctcctgcctcagcctcccaagtagctg

SEQ ID NO: 22247 - DNA, 601 bp, Human
ggaaccagactccaatctgggcagtagcagaagtgtttgtcaaggcgggagagtgaatggctggagggctagcgtggagcaggagtgggagcaggtatctggttccagggaagggcagagaagcttttcaacgtgttgactggaatgggaataggaaagggagaggaggcacaggggtgcagttctacattgtgtttgtgtgtgtcttcagagggaaggagattggaatgatccaagccatttactacatgttggtttgtgcagtccacactgggaaaagtcaaagacaaggacaagctcygatgggagccaaacgtagctacagacaaatgatcaaatactttgagtatctgatctacaaagatctgcctacaataaagcagggcaactgttcaagagaaaatgtagatgatgcccaagggaaggcaacacatatgaaatacactctaattcacagaaagattgggaaaagcaaaaactgctacagtcatcttgaaacacattcaaaatcagtttgttaaaactcctttcattccataatatcagcatgcaaaattaaatactgtaaaatgttaatttattatggcaataataaggatta

SEQ ID NO: 22248 - DNA, 601 bp, Human
gaaagaattctaaaggccaggcgtggtggctcaggcctgtaatcccagcactttgggacgccaacgcgggcgatcacttgaggacaggagttcgaaaccagcctggccaacatggtgaaacccagtctctactaaaaacaccaggcttggctggcgcacgcctgtaatcccagctacttaggtggctgaggcaggagaattgcctgaaccgggaagtggaggctgcagtgagccaagactgcaccactgcactccagcctgggcaacagagtgagactttgtctcaaaaaaaaaaaaaaaagtctaggaaagaatgctaaaacaaagagaaaattttactaggacagagaataccatatctcataaggaaactgcatttgaaataaagccatgcaattttttcttttgctgtcagctgcctaaggggacaactgcatttcttgtttgcatgatagtttctgtcagctgtaaggatactaaacagaaaccctaagcctcgtttcgtttaaaaaaaggtaaagctaccaaaaaaaaaaaaaagacatcattttcatacagaaaattttttgcacagaaacttggaagacatttgagggtgctt

SEQ ID NO: 22249 - DNA, 601 bp, Human
aaacaaaacatcagagaacccttgaagtctaggaaagaattctaaaggccaggcgtggtggctcaggcctgtaatcccagcactttgggacgccaacgcgggcgatcacttgaggacaggagttcgaaaccagcctggccaacatggtgaaacccagtctctactaaaaacaccaggcttggctggcgcacgcctgtaatcccagctacttaggtggctgaggcaggagaattgcctgaaccgggaagtggaggctgcagtgagccaagactgcaccactgcactccagcctgggcaacasagtgagactttgtctcaaaaaaaaaaaaaaaagtctaggaaagaatgctaaaacaaagagaaaattttactaggacagagaataccatatctcataaggaaactgcatttgaaataaagccatgcaattttttcttttgctgtcagctgcctaaggggacaactgcatttcttgtttgcatgatagtttctgtcagctgtaaggatactaaacagaaaccctaagcctcgtttcgtttaaaaaaaggtaaagctaccaaaaaaaaaaaaaagacatcattttcatacagaaaattttttg

SEQ ID NO: 22250 - DNA, 601 bp, Human
gtcacccaattgcctgaaactgcaaggcagaggaccaggccttgctcatctttatcttcttaggctctcagtaattgtttgaactaaaatgtttgctgaactaaaagactgcaggaaagatgtctataaacctctaagacacagaactaaagagcagtagcaacaacatacaattagtaaagctaaagaacagagactgactaatcttcaggttataaaatacaggtccctatttgacagttgacaaaactgcaggcacaaagattaatgggtctttctcaaggccatccagcctgtgagyagcaggataggagcagggaggacccagagggctgactccagtggtttatggtccttccttggaccacgtggtaagaaagcaaagtttctctgtgttttatcagaaagtaaactgtaagagtgttgtggcacaatggaaagatcctatttttcagaggaggaaaatagctttcctaattattactcattttgtttttaaagtatgggtgagaaaacaaaacatcagagaacccttgaagtctaggaaagaattctaaaggccaggcgtggtggctcaggcctgtaatcccagcactttggg

SEQ ID NO: 22251 - DNA, 601 bp, Human
taatctgtattaatattttctcatacagtatatttgctgcaatttgaaaactccgtaaatatttactgtgagaattcaatgaaaagaatccagaagaaggaaagccactatctaaattagtcacagagtttcctttctgcgcaacagcacctgttcaagtgaacagcaccttaccagcttgggctggctttgttcactgtcatttgatcaaagtgagtcattaaaagcaggtagttgcacacaaagtaaacagaaaacaaaaccaaaaccccttaattaacaacaacaaaaagaaagaacygagaatatttagaagtggttataaaacaaaataatatattaaatgcatgggagcaatatagaccagagctggtaaggaaaggtttggtgttggcattttaattcttcaggcttctggtcattgttaccagttgtagcataaattcgctggaatagtggtgtggcattaagacttggaacggtcaaaaaatcttcaggggttcacaaagttgagtgttgtttaaaaaatgactttctagaagagaaaaaaaaaaaaaaaacagaaggcttaaatattccaaaaacacaggcttgaaaaaaa

SEQ ID NO: 22252 - DNA, 601 bp, Human
tggcatcgtaactatacatagggtcaaaggcaaaggaaaaaatgttcaatatagttaataagtccctatcgggtctctggtgccagctttaaatggtataactttcttgtaaccaacagaacaccaccacagccccctccccctctccccagcatcctcaaacctgtgtgaatcataaaactatctgaaagagataggcctgctcaataacaaaaggtaagttttacatgtgtagacaaagaggtttaatacaaagcaagagttctacccaagtgttcaaataatggaaagaattgaaatktgggtatgttaagaaagaaagcactaaggttttaagctgcctgaatcttttagtagaagggaagaaagttttctctttctcttccctcctgttctggaatgctgccgaagggcatgtgtctgacaagcattggcactgtggtgcggcagggtctctaagcacagtgcacagtcagtgaacttcttcattattctccagtccagagattctgactctctactaaaagtagaaagtcacaggactggaaagtcaaaagggtccaatataaaaaacatccctgtgaaattctcaaatattaga

SEQ ID NO: 22253 - DNA, 601 bp, Human
tgagtggggaggccgagggcgccctggtccccgggaagtcgagtctgagtggcagcgggacccagctggggcgagcccctccacttctgtggtcggaaccccaaggctgaggggaggcaccagctccccaaggtgtctcttggccccacctctcccccttcgaagagtgactaccgctcttgaccctagtttgggccaatctgtttctctttctgttcgaactccagctgccagctgctccaggcctgaccaggtaggctggtcctgagccagatgtcccagaccccagtgccctaagtcsttttgtgtcccttaagtcccctcacagcttggaaagatcctgggatggacccaaggctcccagcgctggccagatggctgtccctccctggtggtggccctcaggctgcctggagggctgcctctgcctggggctgggcggaacggaaggtgttaggcccaaagccgctgggccagcgctcagaggctcagccccggcctttcaggggaccagacctggcagacccacagctgagtccaggggcattttgtggtgactgaggcaggagggtgccgtggccaggccccggagggtcagagc

SEQ ID NO: 22254 - DNA, 601 bp, Human
cgaacatgcagaagcatctgccaagggagatgcagcagcctcgcctcctgattctgccccaggccccccgcagcctgcaggcccagctctggaaaaagctggagtgagcttgccagggccagtccagggtcagctgtcagcagccccaggaggcaggagccaggcctggaggccttaggcagcctctctgcgggggactccccggctccggggcctgttctctggagaagcttcttctcacccctgctgctggcccggcgctggccctgcactggcctctccttcaaccccgccggcagtygtagcctctgaggttgggggtggtggtagctgccctggcggtgacggccatgggcgttaggggccctccacttggtctccctcaccacttcccctatggctctggaagccctgggcccctgcacggtgtccgaggctggacaggcacgcagcaggcaggcaggcaggcaggcaggcaggccgtggcaagtgttctggagtcttttccttgggtgcgcagctggaaggccgggactcggggaggagagcggggaggcggccgtgctctggagccaggctgacaggccctgtgcgccccacg

SEQ ID NO: 22255 - DNA, 601 bp, Human
ttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccytcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaa

SEQ ID NO: 22256 - DNA, 601 bp, Human
cgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagccyccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctt

SEQ ID NO: 22257 - DNA, 601 bp, Human
ttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcgaaggagccacgaagcaagcggccgtccgggcgtccgcctccgtccccttccatgttcctcctcttccttcgcttcagcctcttctgttatgttttgtcttgaattttatttagactttttcagtgggtatttttctgtctyccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgt

SEQ ID NO: 22258 - DNA, 601 bp, Human
ccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttattgggactgagattgtagaataccttccagactcccaaagatagaggggggaaaaaagaaaaaacaggctttggatctctagacgcttaaaaattta

SEQ ID NO: 22259 - DNA, 601 bp, Human
ccacagggcactgggagcccggagtgctgtcggaggcttttgttccctgttgccgggatatctgcctgctcagtcatccgagctctgagccgcagggtggctctcggtgccacccccgtcgcctgccctccctccctcaccctgccgctgacagcctctggccaaagccctcggctcccccagggcctggaccaccgtctccctttgcctgggcctggctggccctctctgtgagtgagtgggtccagggaggggggtgggcagccgagagtggagaggaacggggagagagagagagagmgcgcagggatgagaggtgggggatctgatgactttccttgtttgttgagccggctgctggcctgggccttcaccccccacggccccctccccccactccaggctcagttgattattacccagccaagagctaagagcatagcactcattcctggggcccgtttctcgaagcgcagctgcacaggcttagggtagggtggggctgagggtctctgctttttcggtgcagctgcaaatgaccctgctctagggtcaggggcattggaaatggcttgggactgcggtcctgtggcctgcccgc

SEQ ID NO: 22260 - DNA, 601 bp, Human
tgcagctctgggacaccagccacagggcactgggagcccggagtgctgtcggaggcttttgttccctgttgccgggatatctgcctgctcagtcatccgagctctgagccgcagggtggctctcggtgccacccccgtcgcctgccctccctccctcaccctgccgctgacagcctctggccaaagccctcggctcccccagggcctggaccaccgtctccctttgcctgggcctggctggccctctctgtgagtgagtgggtccagggaggggggtgggcagccgagagtggagaggaasggggagagagagagagagagcgcagggatgagaggtgggggatctgatgactttccttgtttgttgagccggctgctggcctgggccttcaccccccacggccccctccccccactccaggctcagttgattattacccagccaagagctaagagcatagcactcattcctggggcccgtttctcgaagcgcagctgcacaggcttagggtagggtggggctgagggtctctgctttttcggtgcagctgcaaatgaccctgctctagggtcaggggcattggaaatggcttgggactgc

SEQ ID NO: 22261 - DNA, 601 bp, Human
agacacactggtctgcccaggcggctgcagctctgggacaccagccacagggcactgggagcccggagtgctgtcggaggcttttgttccctgttgccgggatatctgcctgctcagtcatccgagctctgagccgcagggtggctctcggtgccacccccgtcgcctgccctccctccctcaccctgccgctgacagcctctggccaaagccctcggctcccccagggcctggaccaccgtctccctttgcctgggcctggctggccctctctgtgagtgagtgggtccagggagggggstgggcagccgagagtggagaggaacggggagagagagagagagagcgcagggatgagaggtgggggatctgatgactttccttgtttgttgagccggctgctggcctgggccttcaccccccacggccccctccccccactccaggctcagttgattattacccagccaagagctaagagcatagcactcattcctggggcccgtttctcgaagcgcagctgcacaggcttagggtagggtggggctgagggtctctgctttttcggtgcagctgcaaatgaccctgctctagggtcagg

SEQ ID NO: 22262 - DNA, 601 bp, Human
gcaaaggctgggtggatgtggacagggggcagtcgccgcttcttgaaagcgccgctcagtagccgctccgcgtactgggggtcaatgcgccagaagccccccttgcctggttcgtccttctcccgaggcactttgatgaagcacttgttcagagacaggttgtggcggattgaattctgggtgcagggagagagcaagagagagaggaaccgctaggtcagtggggacggggagatgaaatggcacctggcgctgctgcgcaccccccatcttttctctggcaggggagaggaggggggggacagacacactggtctgcccaggcggctgcagctctgggacaccagccacagggcactgggagcccggagtgctgtcggaggcttttgttccctgttgccgggatatctgcctgctcagtcatccgagctctgagccgcagggtggctctcggtgccacccccgtcgcctgccctccctccctcaccctgccgctgacagcctctggccaaagccctcggctcccccagggcctggaccaccgtctccctttgcctgggcctggctggccctctctgtgagtgagtgggtccagggaggg

SEQ ID NO: 22263 - DNA, 601 bp, Human
cacgtgtgaggcggggctcagaggcgggctcagctccagggcctccagtgcacccagctccccgcccagagtgccggcgtcgaagatggcctcccagtcaaagttgcctttgaggggttccagctcaccctgctcctccggggtgggcagcagggtgctggggggccgcgggaccttggccacccgcttgggcagcggctgtttgcgcttatgccccagcctgccctcgcctgcaccccagcccgcctccccggtggcctcctcgaactcccgcagcagctgctgggcctcggtattcacygtcagcggcccggcccgggggacagcgctgggctcctgcgcggcctggcgggcaaaggctgggtggatgtggacagggggcagtcgccgcttcttgaaagcgccgctcagtagccgctccgcgtactgggggtcaatgcgccagaagccccccttgcctggttcgtccttctcccgaggcactttgatgaagcacttgttcagagacaggttgtggcggattgaattctgggtgcagggagagagcaagagagagaggaaccgctaggtcagtggggacggggagatgaaatggcacctg

SEQ ID NO: 22264 - DNA, 601 bp, Human
caccaaacccaaacttccagctgctctcagcctcaagtcgggcttaaagattagggatttacgtcccctccccgccccctagggatggggccaggcaaagaccccagaggccttagagaggatctccttgccccaccctgtgccaccacctcattttggtctcctctctctgccccctcccccagtccatcttctgccctgctccgccccatccacagcctgccccggccccagggaggctctgccaggagaagcctccagggggttaatttgctgtcatctaattagcatttgttgtacmtggggactctctctggatagagacctggggaagcaggggggaagcggaggtgctctgggagggcccagttctgttcctccccagcctgacccgggctcctccaggcctcggctctcatggtgcagggtcctttagccggtttctggggctgggaagacgcggagcaatgaaacactgtgtgtacaaggtggggctggggagaggaggcagcgattctggtcctgggccctcgttttcagcctcctgggcttgaatctgatggcagctggggctggtggccatgtggcctctggggcaagc

SEQ ID NO: 22265 - DNA, 601 bp, Human
aactgtggcctgggccaggacatggcaggcctcctcccacctgctccacaccagcccagagccccccaccctcccccttccaagaagaagacagatccaagtaccgttgaccctgtgggcagagcagagagcagcaggtttctagacagctggagcgagctcttccgaaggtgaaagcgtgaggagagagatggagaggggcgaggagaggagaggaggaagggccccagcaggggaggaaaaacagcatgtgcccagacagtagaagctcaaagagtaggggccccggggcgggctgcarcgggactggcccagggggtccccctcctgtgggaggcccagactgcagtgccacagcagagggcagtcagggccgggcctaccttggccaacagtgacagtgtaggggctgcgagggatgggcacgccggcaaacgtgacgtgcacggtgtggacgccctccatggtgggctggtagctgcagcggtatgtgctgtcgccccgggcctccagctgaggctctaccgtgcccttctgtcccatggggtcctggatcacaacctcgacctcgcccgtgccagctcctgccacgaggcacctg

SEQ ID NO: 22266 - DNA, 601 bp, Human
acatggagaaaccccgtctctactaaaaatacaaaattagctgggaatggtggcgtatgcctgcaatcccagctactcaggaggctgaggcaggagagaattgcttgaatctggcaggcagaggttgcagtgagctgagatcacgtcattgcactccagcctggcaataagagcaaaactccggctcaaaaaaaaaaaaccaggatgggcgcggtggctcatgcctgtcatcccagcactttgggaggccgaggtgggcagatcacaaggtcaggagatcgacaccatcctggctaacacrgtgaaaccttgtctctactaaaaatacaaaaaattagccgggggggtggcgggcgcctgtagtcccagctacccgggaggctgaggcaagacaatggtgtgaacctgggagaaagagcctgcagtgagccgagatcgcgccattgcactccagcctgggcgacagtgtgagactccatctcaaataaataaataaataaacaaaataattataaaggaacaaagtgccaagacatgccaaacatgaacgaaaacacggaaaacttcgtggtgagcgaaagaagccagacacaaaaggcca

SEQ ID NO: 22267 - DNA, 601 bp, Human
ggaggagactcagaagctccctcagctacactggcaggcacacaaaatggtccagctgccttgggaagagtctggcagttcctcagttgaccacagagggactgtgtgatgctccggttcactccgaggcaactacccaagagaaatgaaagcaaatgtccacgcaaacacctggactcactgttaacagcactgttcatgatcaccaaaggcaagctcatcctcaatatctgttagcaagtgaacggaaaaatggaatgtggtctggccacacaatggagtattatgcggccataaaaakaaatgaagcggccggacgtggtggctcatgcctgtaatcccagcactttggaaggccaaggtgggcggaccacctggggtcaggcggttgagaccagtctgaccaacatggagaaaccccgtctctactaaaaatacaaaattagctgggaatggtggcgtatgcctgcaatcccagctactcaggaggctgaggcaggagagaattgcttgaatctggcaggcagaggttgcagtgagctgagatcacgtcattgcactccagcctggcaataagagcaaaactccggctcaaaaaaaa

SEQ ID NO: 22268 - DNA, 601 bp, Human
tccaccttgactcggatggggctggtgggcgtggcctgcaggcagtgggaggagaaggccttagaggagggcagacgtcatccgcaatgacatcttagcggccaggagcgcagcacccacctggtcagcaaagaggaccataatggtgtagctgccagccccccggggcgtgtacttgaccgtgaaggtgtcattgtcattgcggatgatgtcgaagtcgatgtcagcttcggcggggcctaccactccaggggcacacttgatgccgatgctgacgtcccctgcggcggggagaggagctgaggctgagacctcgcagggacaccccagccacctgccctcccacccacagccaggccttaccctggccagcctcggcgcagtccacagtgaagtaggtgggctcgtgggccttgagccctgtcttggctactccggggccgtatactttgaccttgttggggtggctgccagctcccacattcacctgcagggcacaggggcaagggcaagggcatgagcagcctggaggagactcagaagctccctcagctacactggcaggcacacaaaatggtccagctgccttgggaagagtctg

SEQ ID NO: 22269 - DNA, 601 bp, Human
cctcaaagtatgcctcctaatttggctctcactgaagccccgtggccgtcaagcttgccagagagcaacttcagcgcccccttccccaccccgggctccctgtctccattctgcaaacagtagccagggaaactgaggttactgagtcttgctcccaccctcaaagcccccaaggccctgcaatcagtactccccagcctcccccgccctgcgcacacacgcctgtcacacacacatcggatcctacggcctgctctataaagccatctcgctcctgccgcaaaactctagccaccctctmaccctttccttagccacctcgcccaagtgccaggcctgtagcctctcatcagcatccctgggtgtccctggctggggcaggtgaccctccatgcctgttggggaatgtctgaataacgtcactgctgggggataggggaagggggaaggagggagacgggccacagaatgcactttggggctctgaggctgggccgggccccgccatgctggccgcccaagcagtcgacactggcgctactgcactaccagccagccccacccgctcatgcacctcccccggcccgggacgcagaggccc

SEQ ID NO: 22270 - DNA, 601 bp, Human
ttctgaaccccctggacccttcagccgcttacccacgtggccattacgcagccgcttcagcaaacagggctcctcccggcccgagggcgggaccacagtggccgtcagcaggctgagatccgtctctgagatgttgatggggatgtcggcagcagagccgacctttaggtgggacatacgcatggagtcgtcacctggtggggacaggccagccatcagtgtgcgtccagccatgggagaccatgcccaccctgccacccgtttctgtcactgctcccagtgccacccacctgtgacccgrgcagtgaaggggctgcctgggacgtgctgttcattgtacttgactagaatgctgtagtcccccggcagcacaggcaggtaggacacgctgcatgtcccatcctggttgtcagtgcagctgatttctgctttggacgggccctcaatggccagagacaggccccctggagagagccgtgggtgagcatgggaactatgctggggacactccagttggcctgcactgaggagctccgatggccagggcagcagggcagggagccccattcaggagtatctcctgagtccagcccttaccccg

SEQ ID NO: 22271 - DNA, 601 bp, Human
gatactgaattcggctgtgggagaacagtttgtcctcactgaaggctgcttcaccagcctcggccccctccaggcatagccaaggtagacatgcctgccggctctttcctccacccccaaccccaccctggccaacgcaggagagcgagcactcggggtgtgagcaggcctacctggcactccagcttcagctctctccaggccagggcccccagctcggaccttgtgggctcccccttcccctaggggccccacggtgaactggaaggggctcccaggcacgtgctggcccttgtacttsacgctgactgtgtgtgtgcccatctcagcgggaacaaagcggatgcagtaggtgtggttctccccttccacgatctcggcctcatgggtcttgcccgatgggctggtcacctgggctgtcatatcctggatgctaatttctgcagggtggggatgggctagtgagcagcagccctgggctccacccctcctcttggggctgcttgagccccaggacccctccccaggcttcccacagcccctaccagggattttcaggctgaggtcacaatgactaccaacgttggccactgaaggagcc

SEQ ID NO: 22272 - DNA, 601 bp, Human
gcttggccccaggctcacctgtgactttggccttgaaggggctgcccccaatgtggtaggggccgccgtacttgatggagatgaggtagctgccaggtgccatgggggtataggtgacgcggtagccctcagggcactcctggcaatccatcttcaccttggaggggccgtcaatggtcaccgacagggcaccagctcccgcattgctcgtgttcacgacgaactcagctgggttccctgggagcacaggaggtcaggcagagccagactggcctgcctccctgtcctcggccacccagcrcaggcttgtcacctccaggtgcctcctgttgtcaccaagagcttggaggcaagggcctagcagctgtgtgcacacgtgcagccgcaccgacagacttacctgtgacaccgccttccagacctgctccgtaagcagacaccaagcctgggtcccctccatgcccaggctccccaactcggatcttgaaggggcttccagggatgtgggtgccgttgaacttgacgtcaatcaggtaaacgccattctcccgagggatgaagcgcacagcatacttatctgaggagcagggagtcatgctgt

SEQ ID NO: 22273 - DNA, 601 bp, Human
gcacccctgtcaggttggccttgactggtcccccaaccccaacaaagctacagccacgcaaaggagaatggaagcaaaactttattcctcttggctggagaagagaactagtgggtggttgtgtacaggacccccatccctcacccctcccagaaccaaagaagacaagcagcgccaccaaatggctccctctgcccaagtgaaagccgagaggtcagcggctggctggggaggcaggtgagcgcagcacggcacagggcaggggcggctgcagtgacaggcgggcggccagggcggcctgggccggggttgaggggaagagggcggggctgcttgggtagcggggcaggcttgggggctgccggctggcacgggccccagactcagggcaccacaacgcggtaggggctgcctgggatgtgctcgtccccccatttgaccaccagtgtgtactcccccttgtccttgagcaggtaggacacgctgtagagccggctgcccacgtgcttcaccaggatctcctcgcagggggtccttgggccatgaacccccaccagcagcatgttgttgcctgaggcaagaggggtcctcagtcccaggt

SEQ ID NO: 22274 - DNA, 601 bp, Human
ggcacccctgtcaggttggccttgactggtcccccaaccccaacaaagctacagccacgcaaaggagaatggaagcaaaactttattcctcttggctggagaagagaactagtgggtggttgtgtacaggacccccatccctcacccctcccagaaccaaagaagacaagcagcgccaccaaatggctccctctgcccaagtgaaagccgagaggtcagcggctggctggggaggcaggtgagcgcagcacggcacagggcaggggcggctgcagtgacaggcgggcggccagggcggccwgggccggggttgaggggaagagggcggggctgcttgggtagcggggcaggcttgggggctgccggctggcacgggccccagactcagggcaccacaacgcggtaggggctgcctgggatgtgctcgtccccccatttgaccaccagtgtgtactcccccttgtccttgagcaggtaggacacgctgtagagccggctgcccacgtgcttcaccaggatctcctcgcagggggtccttgggccatgaacccccaccagcagcatgttgttgcctgaggcaagaggggtcctcagtcccagg

SEQ ID NO: 22275 - DNA, 601 bp, Human
ttggcacccctgtcaggttggccttgactggtcccccaaccccaacaaagctacagccacgcaaaggagaatggaagcaaaactttattcctcttggctggagaagagaactagtgggtggttgtgtacaggacccccatccctcacccctcccagaaccaaagaagacaagcagcgccaccaaatggctccctctgcccaagtgaaagccgagaggtcagcggctggctggggaggcaggtgagcgcagcacggcacagggcaggggcggctgcagtgacaggcgggcggccagggcggcctgggccggggttgaggggaagagggcggggctgcttgggtagcggggcaggcttgggggctgccggctggcacgggccccagactcagggcaccacaacgcggtaggggctgcctgggatgtgctcgtccccccatttgaccaccagtgtgtactcccccttgtccttgagcaggtaggacacgctgtagagccggctgcccacgtgcttcaccaggatctcctcgcagggggtccttgggccatgaacccccaccagcagcatgttgttgcctgaggcaagaggggtcctcagtccca

SEQ ID NO: 22276 - DNA, 601 bp, Human
aaatcatttggagccattttgagacagaagtagaggctctgtcaagtcaatactgcattgcagcttggtccactgaagaagccacgcctgagatacaaaagatgcactacacttgacccgctttatgttcgcttcctctccccttctctctcatcaactttattaggttaaaacaccacatacaggctttctccaaatgactccctatgtctggggtttggttagaattttatgcccacataaaccaaacttgtggctatgctatttgggccctgccataacatttgacataatacaaaayataaagtcatagggaaaacttccggatgctgtcccaaaccgtggaatattcaatttagaatctcctgaacctcaagaggacagatgacacacaacctgtatggatccagctcttgagcagcagcagcacatagctacactgattaaaagattaaaaaaactgtctcaagttgtctgtgtcggtatcccaatgtttgtttaacttcactagaaaaaaaaaaaagccagtttggttaaattgaacagaatgtggtaactgccaatgctgaatagccactccatgaaaacaagttaataatta

SEQ ID NO: 22277 - DNA, 601 bp, Human
ctgagatacaaaagatgcactacacttgacccgctttatgttcgcttcctctccccttctctctcatcaactttattaggttaaaacaccacatacaggctttctccaaatgactccctatgtctggggtttggttagaattttatgcccacataaaccaaacttgtggctatgctatttgggccctgccataacatttgacataatacaaaatataaagtcatagggaaaacttccggatgctgtcccaaaccgtggaatattcaatttagaatctcctgaacctcaagaggacagatgrcacacaacctgtatggatccagctcttgagcagcagcagcacatagctacactgattaaaagattaaaaaaactgtctcaagttgtctgtgtcggtatcccaatgtttgtttaacttcactagaaaaaaaaaaaagccagtttggttaaattgaacagaatgtggtaactgccaatgctgaatagccactccatgaaaacaagttaataattagaaaggtgaaggggagtatttactggcacagcgctcttcattctctccattttcattacaaaagcaggccttacaatattgatttca

SEQ ID NO: 22278 - DNA, 601 bp, Human
tatggaccaatgaaacgaggagagagccagaaataaaccctcgcatccacagtacagtgatttttgacaaagttgcaaagaccattcaatgaggggaaaaaaagtcatttcaacaaaccgtcctgggaaaactatccacatgcaaaagaatgaagttggaccctacctgacaccatccacaaaaactaaaaatggaacaaagacctaaatgtggtatctaaaactataaaactcttaggagaaaacagtgcaaaagcttcatgacattggagttggcagtaattccttgtatctaaaaccraagacacaggcaacaaaggaaagaattcatgaaaacaggatttcatgaaaattttaaaaatcttgtgcatagccaggcatggtggcatgtgcctgtaaccccagctacttgggaggctgaggcaggagaattgcttgagcccaagactttgagtccagcttgggcaacacacagcaagacactgtctcttttaaaaaaacaataaagaaatttttgcatcagaagacactaatcaagagttgaggcaactcacagaatgagagaaaatatctgcaaataagggattaatatccacaatac

SEQ ID NO: 22279 - DNA, 601 bp, Human
ggtccagccactatggaaaatggtatggcagtttctcaaacattaaaaacagaattaccatatgatctagcaattccacttctgggtacacacccaaaagaactaaacgcatggtcttgatgagacatttgtacacccattttcagagtagcattattcacaatacattcacaaaaacatggaagcaatccaggtattgatgaatggataagcaaactatggtctatctttccatacattggaatattattcagccttaaaaaggaaattctgacacatgctacaacacagatgaaccatrgacatcatgctaagtgaaataaactagtcacaagaaggcaaatactatattattccgtttatataaaatatagtagttaaaatcatagagaaagaaagtagaatggtgcttgccagtggctggaagcagagaacgaggagttattacttaattggtagtttcctttagaagaggaaaagtgagtgtgggcacagtggctcacacctataaaatcccagcactttgggaggccaaggtgggtggatcatttgaggttaggagttcaagaccagcctggccaacatggggaaaccctgtctc

SEQ ID NO: 22280 - DNA, 601 bp, Human
tataatcccagctacctggggaggctgaggcaggagaatcacttgaatacgggaggcagagattgcagtgagccaagatcatgccactgcactccagcttgggcgacagagtgagactccatctcaaaaaaaaagaagaggaaaagtgttatggagatgaatggtggttgtggtggttgtataatgatgtgaatatatttaataccactgaactgtacacttaacaatggttaagatggtaaattctggccgggcgcagtggctgacgcctgtaatcccagcactttgggaggccgaggcrggcagatcacctgaggtcaggagtttgagaccagcctggccaacctggtgaaaccccatctctactaaaaatacaaaaattagctgggtgtggtggtgggcacctgtaatcccagctactcaggaggttgaggcaggagaattgcttgaacctaggaggcagaggttgcagtgagccaagatcacgccactgcactccagcctgggcaacaaagtgagactgtctcaaaaaaaaaaaaaaaaaaaaaaaagatggtaaattttatgggtactttatcacaaaaaaaaaaaatggagggaa

SEQ ID NO: 22281 - DNA, 601 bp, Human
cctttcatatcaaagccctgaagtttcagaaacacaaagaatgaaacaaaagaaaaatacagaataaaagtaactttcagaagacagattaaaacatttatccctggccgagcgcggtggctcacacctgtaatcccagcactttgggaggccgaggcaggcagatcacgaggtcaagaaaccaagaccagcctggccaacatggtgaaaccccatctctactaaaaatacaaaaattagctgggcatggtggcacatgcctgtagtcccagctacttgggaggctgaggcaggagaatcrcttgaacccggaaggcagaagttgcagtaaccaagatcgtgccactgcactccagcctggtgactgagaagaaaaaaaaaaacacaccatttatctctatctcctaaacaactattatgctgaaagtacaagcagtgttactgtccctgatgaagatcttccagtggaacacgatgtggagatggaagacagtgatactgatgaccccaaccccacaaaggtggctgagtgaagtttgttggacctggatggtaaacagtgctatttgtgctgatatacctgagaattaagttagcatta

SEQ ID NO: 22282 - DNA, 601 bp, Human
tgtttcttcatttaagcctccaggtataacctggacataatacccgcctcttaggatccttgtaaggaataaatgagtttgaaaatgtgcttcacaaattattatcaggcgttttttgccccaagtcagtcctgtattttctctcccttactcattgtccccttacaccacctaccaaactctgatctcaaactttccagtgagacctaaataattgaagatgccccccaccccaccacccaggaggttgctacattcccacacagcttaatgttaaaaagataaagcttagatttttagwattccagtgagacagtaaagcagtgcactttgaagtgcatcctctactgcaagaactgttgcagatagtaacagtgtcaaatggcagaagaattaattcatatggtgataaagggaaacgatctttttttccttgtgattttttttttcagtagcatccacatcacctaagaggtttcaagaaaatgcagagccttctcagacctactgattagaacatgcactagaaccagattaatgatgctttatatataattcacatttgagaaatgctgctcaaaaccccacccgtgtaggtggc

SEQ ID NO: 22283 - DNA, 601 bp, Human
ttcataacacggttgatctaagtaactggaagaaaggaaatgagtattaggaaagggctttagttttcattcatggtgttcaatttataattttttttgaagcgatttcaatccgctatcttcttttttgtttttttgttttttgagacagggtctcactctgtcgcccagactggagtgcagtggtgcaatctcggctccccacaacttccacctcccaggctcaagtgattcttctgcctcagcctcccaagtggctggaattacagggacgcaccactaccgcccaactaatttttgyatttttagtagagagggggtttcaccatgttggccaggctggtcttgaactcctgacctcaaatgatccacccaacttggcctcccaaagtgctgggatcacaggcgtgagccaccacacctggcccactacctttatatttaaatcacttaaaaggtcccaacactaatttcaactagaacctcttcattcatagtgcaatatggctaagtatttgttttgttagaatttccacttggaagacttgggaaatttagtgagaatttcaagaaaaatacaaatctaaaaaccaaaatactt

SEQ ID NO: 22284 - DNA, 601 bp, Human
gatctaagtaactggaagaaaggaaatgagtattaggaaagggctttagttttcattcatggtgttcaatttataattttttttgaagcgatttcaatccgctatcttcttttttgtttttttgttttttgagacagggtctcactctgtcgcccagactggagtgcagtggtgcaatctcggctccccacaacttccacctcccaggctcaagtgattcttctgcctcagcctcccaagtggctggaattacagggacgcaccactaccgcccaactaatttttgcatttttagtagagrgggggtttcaccatgttggccaggctggtcttgaactcctgacctcaaatgatccacccaacttggcctcccaaagtgctgggatcacaggcgtgagccaccacacctggcccactacctttatatttaaatcacttaaaaggtcccaacactaatttcaactagaacctcttcattcatagtgcaatatggctaagtatttgttttgttagaatttccacttggaagacttgggaaatttagtgagaatttcaagaaaaatacaaatctaaaaaccaaaatacttactcatcagttctg

SEQ ID NO: 22285 - DNA, 601 bp, Human
tctaagtaactggaagaaaggaaatgagtattaggaaagggctttagttttcattcatggtgttcaatttataattttttttgaagcgatttcaatccgctatcttcttttttgtttttttgttttttgagacagggtctcactctgtcgcccagactggagtgcagtggtgcaatctcggctccccacaacttccacctcccaggctcaagtgattcttctgcctcagcctcccaagtggctggaattacagggacgcaccactaccgcccaactaatttttgcatttttagtagagagrgggtttcaccatgttggccaggctggtcttgaactcctgacctcaaatgatccacccaacttggcctcccaaagtgctgggatcacaggcgtgagccaccacacctggcccactacctttatatttaaatcacttaaaaggtcccaacactaatttcaactagaacctcttcattcatagtgcaatatggctaagtatttgttttgttagaatttccacttggaagacttgggaaatttagtgagaatttcaagaaaaatacaaatctaaaaaccaaaatacttactcatcagttctgta

SEQ ID NO: 22286 - DNA, 601 bp, Human
cattcaataaatatttgttgactgggtcctctctaagactcttttccagtataaaatctcattattctgagaaaataaaactagttactagagaaaataaaactacttactagatgccagggcttctgcttcagtggaaggaaccttgtagatttttccacccttatagacaaagctcccttcagtcactttaaaatccagatagcgagttacctctgtataaagcagcatcttaaccagctgacctagaaaagtcacataattcaaactataacttaagtctataaattataaagaacayttactaatactaacagcttctaaaattttttctaacgatgttcaataactccaacaaaataatttttttttgagacacagtctccctctgttgcccaggctacagtgcagtggcacaatcacgagctcactgcaacctcagcctcctgggctcatgcaagcttccagcctgacgctcctgagtacctggcactactatgcctggctaatttttttttgtattgttttgtagagacagggttttgccacgttgcccaggctggtctcaaactcctaagctcaaacaatccacccaccttgg

SEQ ID NO: 22287 - DNA, 601 bp, Human
gaaaagtcacataattcaaactataacttaagtctataaattataaagaacacttactaatactaacagcttctaaaattttttctaacgatgttcaataactccaacaaaataatttttttttgagacacagtctccctctgttgcccaggctacagtgcagtggcacaatcacgagctcactgcaacctcagcctcctgggctcatgcaagcttccagcctgacgctcctgagtacctggcactactatgcctggctaatttttttttgtattgttttgtagagacagggttttgccaygttgcccaggctggtctcaaactcctaagctcaaacaatccacccaccttggcctcccaagtgctgggattataggcacgaggcaccgcgcctggcccaaaataacctccaaagctgtattttaaataggacaaccagaatgcaaacttattgcactgcatattacacgtttttgttattttttatctttttttcctattcaaggttgaatacataggtttttttaatgttacaacttaaaggttaataattctatcaacttgcttttgcaaaagcaatgaaaaatttattagagatatg

SEQ ID NO: 22288 - DNA, 601 bp, Human
gcaagactgtctcaaaaaaataaaaataaaaataaaataaaacaaaattaagaaaagaaaaaaattgtgaggagatttgtagattaagaaaataaagaggtgcccaggcatggtggctctcacctataatcccaacactttgggaaaccaaggtaggaggatcacttgaggccaggagtttgagaccagcctgggcaacacagagagaccccatctctacaaaaaataaaataagccaggcaggtggtatgcatctttagccccgctacttaggaggctgatacaggaggatcgtttgagyccaggagttcaaggctacagcaagctacgatcgcactgctgcacttcagcctgggcaacagggcaaggccctgtctcttaaaaacaaacaacaacaacaaagaataaagcgctcgggcgtggtggctcatgcctgtaatcccagcagtttgggaggccaaggcagacagatcacatgaggtcaggggttccagaccagcctggccatcatggtggaaccccgtctctactaaaaatacaaaaattagccaggcatggtggtgcacgcctttaatcccagctacttgggaggctgaggcag

SEQ ID NO: 22289 - DNA, 601 bp, Human
aaccccacagagactatgttaaatggagattaaaaaaaaaatctttgagggactgagaaaataaataaagccatgaggaaagcactggacttgcgctggcacatcagacgatcctctaccctcccttcctagactattctctgttaacgctaagagataactgctccacatagcaacaaaagtcaaaatgtaaatttctatgagcttcaaaccagaagctcctgaaaaacagtgctccagatattccatttaacaaaacaaaattaagaccatctctaaggaataaggtagagattcacargtgaaatactcacaaagtgtgagaggcgtatgaaatttgactaacacttacatcttccaatggtgttatagatgcactctctcctccgtagtaagggtttcgatccatatgaagaactttcttgccattcactgacattatacctgacaggatacattcctatagaaaaagcatagtaccttgaaaagaaagttctacagcatatttaaaacagatcatttttttcaagcctgccattacacattctcttagtaattacacttatattcatgcaacatgacataatttatgaagaaagcc

SEQ ID NO: 22290 - DNA, 601 bp, Human
attaatgtatttaattccaacaccttaggtaggtattgctatgatctttactttacagatgagagaactgaggcacagaaaagttaagtaacttgcccaaggttattcagctattgagtaaaggaaccatgatttgaaactatggcaacctgaaaccagagcctgtactcttaactgttaggctatcctgcctccaataattgagaaaaaactctatattctagaagttttagcagtttcagaaacactaaatcagcacatgagagcttactttgggtttgtcctttcccccttctcttgmagagtttcaagaactttctccccagacaggaccaaccggacttttttattttcatgatcaaaagataccaacatgtattccacctattgaaaataaaggtgagaaaaattaacattcttccagacttgttttcagtgtggcctccagaagaaaaaggcagggaaacgtgaagtctgtaaaggatccacagtaactccagacagtcacatttgtttacagtacagcacataagtgttcatatgcataatatggaaacctgtagaaaggatcagtcagtagtgccacttccatcccttcttt

SEQ ID NO: 22291 - DNA, 601 bp, Human
aatatgcaaggacctaatgactcacgttgttcatagagcatcggtatcgatagtgctttgggagcactgcagatcctctgatctgccactgatgccaccatatgctagcaggtaaatgctgctttttgaaagtgcatgagggcgcaactgtcacagtcaccaggggacagcattccagaagctttggctactgcttacagggtcagaactgtgtggcaggcgtgctgctccctccaccctcgcctgcggcagacacggccacactgctggtctgtcatcacagtatcctggtctttcccaytgagcccccactgagtgcactcaccacggtgcagccaccacagctgacagaagctggcatgcaactgtgtctgcagctctactgttacagagtctatcaagtgcagtctataaaagataaaccatctgtaacgtatgaggattgtaaggtggaatgcccgggtcgtgacttgctcttttcattacctgtatctctgagagatctgctggggcatgttaatataggaactaacctgggaaatgaagttattgtgcaaagagcctgattttcttctaatatagaagtagcctccttccggcg

SEQ ID NO: 22292 - DNA, 601 bp, Human
ctctcacactacagcccaagtgagggctgcaaagcaaaaaggggatgccatctgcccaacccaacctttccaaggccttcaactgcttttaggagaacaactaaaatttatggttaacctgacctggcctgccaattacctgccagcttccctttaccccatacctgcacttcctcctcagcctcctagtcacactggccagcttgctttcttctagttcccaggaagtccccgcttgtttggttcatcctaggacttctacacacactgctccccctccctaagactgtcctccgctccycattcctatttcactcctcctggaaccttggacatcccaccccctccccctccacccaccagagtccactggatacctaggttgtactctttgctccccatctcctcctgctagcacagccccactttgacgcttatgaatctatgggtatttgattgttcttcaaccccccagctccacagagacagagctgtccgtcttcactcatgagagcatgcccattctgcctgcagcaggcactcaagtgtctgagtgaatggcagggccaatgatttttcacctcctctttcaaacattagg

SEQ ID NO: 22293 - DNA, 601 bp, Human
cccagcagttcactgactctgtcatcttttaaaccacccacttttcctatcaccagcacccacgggcatccaggcagcccttgtctcccctcagggagctccctcactcacctcctagtaagccctggcaccagctccacagctactctcacactacagcccaagtgagggctgcaaagcaaaaaggggatgccatctgcccaacccaacctttccaaggccttcaactgcttttaggagaacaactaaaatttatggttaacctgacctggcctgccaattacctgccagcttccctttmccccatacctgcacttcctcctcagcctcctagtcacactggccagcttgctttcttctagttcccaggaagtccccgcttgtttggttcatcctaggacttctacacacactgctccccctccctaagactgtcctccgctcctcattcctatttcactcctcctggaaccttggacatcccaccccctccccctccacccaccagagtccactggatacctaggttgtactctttgctccccatctcctcctgctagcacagccccactttgacgcttatgaatctatgggtatttga

SEQ ID NO: 22294 - DNA, 601 bp, Human
tcactagaagttgtcatttaacatctgtaacctactccttggcctctactctagtactcttaaggttttcaggacaatgacctatagcaaaagccttgatgtgtcttctctccccagcagttcactgactctgtcatcttttaaaccacccacttttcctatcaccagcacccacgggcatccaggcagcccttgtctcccctcagggagctccctcactcacctcctagtaagccctggcaccagctccacagctactctcacactacagcccaagtgagggctgcaaagcaaaaagggratgccatctgcccaacccaacctttccaaggccttcaactgcttttaggagaacaactaaaatttatggttaacctgacctggcctgccaattacctgccagcttccctttaccccatacctgcacttcctcctcagcctcctagtcacactggccagcttgctttcttctagttcccaggaagtccccgcttgtttggttcatcctaggacttctacacacactgctccccctccctaagactgtcctccgctcctcattcctatttcactcctcctggaaccttggacatcccacccc

SEQ ID NO: 22295 - DNA, 601 bp, Human
atataaaacagttctggtttgtgttacaaatcccctcccactttcttaatttgctaagtgaaatgtacaaccctcttaatgttaaggggaaaaaaatgaacatataaggtattaaattttccagttcactagaagttgtcatttaacatctgtaacctactccttggcctctactctagtactcttaaggttttcaggacaatgacctatagcaaaagccttgatgtgtcttctctccccagcagttcactgactctgtcatcttttaaaccacccacttttcctatcaccagcacccackggcatccaggcagcccttgtctcccctcagggagctccctcactcacctcctagtaagccctggcaccagctccacagctactctcacactacagcccaagtgagggctgcaaagcaaaaaggggatgccatctgcccaacccaacctttccaaggccttcaactgcttttaggagaacaactaaaatttatggttaacctgacctggcctgccaattacctgccagcttccctttaccccatacctgcacttcctcctcagcctcctagtcacactggccagcttgctttcttctagtt

SEQ ID NO: 22296 - DNA, 601 bp, Human
tttttttttttttttttttttttttccagggacgaggtctcactatgctacccagaatggtctttaactcctaggctccagtaatccttctgcctcagcctcctaaagtactgggattacaagcacgtgccacctcacctggccatcaatgccttatttttaacccctaccttttcttaatataaaataaagtatctgttgcctgcccaaatccaccttgtaaacaattgaaggtagtgatcttatctagaaaacagttcccagctacaagggttcttgagaattcttgaagctatgtgcrttatttactatgagcctagaaccttaggaatagtcctttgggagagtaataaacttaaatctgaggggattccttgctcaccagaatcagattggatgaagagagaatgagaatgtgtttgtgtggaagggagaaggtagaatcagaacttgcatcttcggacacctacggcactgcttcattctagagcagtgctgtcccacagaactttctggagtgatggaaatgtttaatatctccactatccaaaccgatgtggtagtcactaaccacgtggctactgagcccttgaaatgaggc

SEQ ID NO: 22297 - DNA, 601 bp, Human
aggctcctgagtagctgggattacaggcatgagtcactgtaccaagttttttttttttttttttttttttttttttccagggacgaggtctcactatgctacccagaatggtctttaactcctaggctccagtaatccttctgcctcagcctcctaaagtactgggattacaagcacgtgccacctcacctggccatcaatgccttatttttaacccctaccttttcttaatataaaataaagtatctgttgcctgcccaaatccaccttgtaaacaattgaaggtagtgatcttatctaraaaacagttcccagctacaagggttcttgagaattcttgaagctatgtgcattatttactatgagcctagaaccttaggaatagtcctttgggagagtaataaacttaaatctgaggggattccttgctcaccagaatcagattggatgaagagagaatgagaatgtgtttgtgtggaagggagaaggtagaatcagaacttgcatcttcggacacctacggcactgcttcattctagagcagtgctgtcccacagaactttctggagtgatggaaatgtttaatatctccactatccaa

SEQ ID NO: 22298 - DNA, 601 bp, Human
ccctgagatcaccctctgaagtctgaaacccaatcctattctcttacttgacttaaggagctctaatttcaacacagaaaaatgaagctccatatttattcctaagtgtaaagctcaaattctacatcacttttagtgatggccccagtttttccaagttaggaatttgaggtcaatattacatgtgctgtgagggaggacaaagactaagcgaaagccaaacaagggaggagttttaaattagtgggaagaaacttttggcttgaggatcaagactagctcatatcttttaaaaaaaaawttttttttttttttttttttttctgagaaagggtcttgctctgtctcccaggctggagtgcagtggtgcaatcatagctcagtgcagccttgaactcctgggctcaagtcatcctcctgcctcaggctcctgagtagctgggattacaggcatgagtcactgtaccaagttttttttttttttttttttttttttttttccagggacgaggtctcactatgctacccagaatggtctttaactcctaggctccagtaatccttctgcctcagcctcctaaagtactgggattacaagcac

SEQ ID NO: 22299 - DNA, 601 bp, Human
ttaaaacctcagaattgaacaacaaaccaacagaacttgaagttaatggaagagagtgcctattatatatatcaggtactgcacctattttataagttatatagagtaagatgggcaaatcacagatactgatggttagagaggacaaaaaaggagaaataactaagagaaaaaaaaaatcccagtaggcatttacagacctaggactgaaaataatctccctattaaaagagttattcgcagtggctcagcgaataactttgtgacgacttggagaattgacaaatcaagcctggtgcaygcatcaacaaccaagaagcctgggggtactgaagatgtgaacaggtgcacatctgctatcttctctggttacttaggaagagagccaaaactcagttaatgctcaaaaaggatttctagacagaaatactatactctcagaagtcaggggtctagtgaagggcatctgcatttcaacacaaagccatactcacctgaagcgagggtgcttgtttattgcttcatctggaaagaagagggacttggaagctcctccttccactgggttgggtttgacctcgggcagtgtgaacccaggaca

SEQ ID NO: 22300 - DNA, 601 bp, Human
gggcctgttaaaggaatgaacgctgagaagtctccatgttcccactctggatcaggagcctaggctcaggatgacagatgagcatgcattgtacaaagctaagatcaggctagtgagagccttaaagcaacttaaaacctcagaattgaacaacaaaccaacagaacttgaagttaatggaagagagtgcctattatatatatcaggtactgcacctattttataagttatatagagtaagatgggcaaatcacagatactgatggttagagaggacaaaaaaggagaaataactaagagaaaaaaaaaatcccagtaggcatttacagacctaggactgaaaataatctccctattaaaagagttattcgcagtggctcagcgaataactttgtgacgacttggagaattgacaaatcaagcctggtgcacgcatcaacaaccaagaagcctgggggtactgaagatgtgaacaggtgcacatctgctatcttctctggttacttaggaagagagccaaaactcagttaatgctcaaaaaggatttctagacagaaatactatactctcagaagtcaggggtctagtgaagggcatctgc

SEQ ID NO: 22301 - DNA, 601 bp, Human
cctcagtcagaagcaccttactttctccaagaaggatttctggtgcatcttttgacatctgtcataatctatctcttcttgagcagctgaattatttttattttcctttaaacacatgacaacatatgaagttagaaactacgtctacaaatatctgtcttccccaaaaggctctgcacatagcaaacgtgagggcctgttaaaggaatgaacgctgagaagtctccatgttcccactctggatcaggagcctaggctcaggatgacagatgagcatgcattgtacaaagctaagatcagrctagtgagagccttaaagcaacttaaaacctcagaattgaacaacaaaccaacagaacttgaagttaatggaagagagtgcctattatatatatcaggtactgcacctattttataagttatatagagtaagatgggcaaatcacagatactgatggttagagaggacaaaaaaggagaaataactaagagaaaaaaaaaatcccagtaggcatttacagacctaggactgaaaataatctccctattaaaagagttattcgcagtggctcagcgaataactttgtgacgacttggagaa

SEQ ID NO: 22302 - DNA, 601 bp, Human
aatggagatggtgtattcttgtccttaaatactgtattataaaaatacaaaaataaaaatggtttagaatccaggattaaacaacaatacaacatgtctctctcccaccccaccacctctcagtagacttacttggtacattgatgacaaccttttctcctctcctatgtcggatatttcttgttaaggtactaaaacagacaaccaaacgtcataaattggtcacctaagagtcatcgtgtaaaagaagaatttgattacatacaagtaagtggaatgaaatcatacctcaaattagttmtctaagacaactcaacagaaaatgtatctgtggtgtcaagacactacaagggaactttgtgattaaagattttgcattagtatcaattctttggctcctgctcgagaatgccgttctgtctcctgctcaacccctgctcccaaggctccctgtaacttaccaaatcaattcaggtgttcaaagtctgccatggtctgctttcactgtttgcaacatgtcccaaattaactccaaagactttggtcaaactttagtacccactttgcccaggcatctctggagccccaataccttgctcct

SEQ ID NO: 22303 - DNA, 601 bp, Human
ccgctagacagctttgcacaaatcccttggatcacaaaatcattggaatacttccatcagagctcattttcagagttttgaacaatatttaaaccacctcactagcctgtcacgagatggcagtaaaaactaggcatataaaaagagaagggaaacaatgacagaatatattgcattttaagttaactgaaattacagttataaaggtatatataccgtatatacctttgtggtgaacaacagagtctgtagaactattagtcatagacagcttccaatgaatttactaatataacttcatgtttttcagaaaggcataccagctaccatttcaacctcattaaaatgtgatttttggaacaggaaacatgcatatataaagaagttaaaaaacagaaatggatggaacactttgcctctctgtatatttgaaactatacctggagacagcaattgcccattccaaatcccatggcatccatgtaaatatgatccggcttagaagcccttgaagcttcatcatcctcagtaaatgtttctataaatggagatggtgtattcttgtccttaaatactgtattataaaaatacaaaaataaaa

SEQ ID NO: 22304 - DNA, 601 bp, Human
tcagagggatcttacatgggtccaggctctgcacggccctgtgcctctaaggacgctgttttgaatcagctgaagtaatcacaactggataaaatttccttggacattaaataacaagcagcctctctcttttacttctgttagttaaggcaataaaataaatattagcttagagtcagacctagaaggggacttaatatcagcccttctttcaactgatgaaaaatctgagccaaaagaagtaaagggagttgcccaaaaacctgagtagtgacagagccaaaagccaactgcaggcttktgtgtggccacctgatgggttccatgctcttccactctggtcctaagtgagcttggacacactcactgccaggggcaccatcatttaaacagatccaggaaaatttttaaatgggtaaacagagacaggctcctgtatactttactcaggggcaagacaaacacaagctgctaaatatttattctttttgtaccgctagacagctttgcacaaatcccttggatcacaaaatcattggaatacttccatcagagctcattttcagagttttgaacaatatttaaaccacctcactagcct

SEQ ID NO: 22305 - DNA, 601 bp, Human
tggtttagtgttccactgaagagatataaagcagggatttcggtggtgaattggcaaaattcatttcatgtgccacacactttatctgagctaacgattttttttaagtggagtagtgaaactgtacatgtcactgggaaaaagaaaacaatcctaagcttacactagatggaaaaattctatctacaagcaacaaaaatatttatcatctaccattaggaagcatttactagtatacatacagtgtttcagtggaaagaatatccctttggaaccatatcagagaaactatgcggtcttyggcagaacaccctggtttaatattaaaccaagaaaaggcaatcaatactcttaacagcacttatacaattttaaaaccatgtactgtaagctctagaacttaatggttttctttagaaatacttgtaattaagataggaaacaggcagttaaaagtcgaaagatctcttttttcgtgaagtgtgatggtttatgtttatttggaagtcacatattttatactacctataaatgtcaagaaaacagaaagaaattatccttggccatgttatttaaacacattcagaatggaaaaatctga

SEQ ID NO: 22306 - DNA, 601 bp, Human
ggcacatgtgataatttaatacattcatataatttgtaaagatcaaatcagtgtacttgggaaagaagttggtttagtgttccactgaagagatataaagcagggatttcggtggtgaattggcaaaattcatttcatgtgccacacactttatctgagctaacgattttttttaagtggagtagtgaaactgtacatgtcactgggaaaaagaaaacaatcctaagcttacactagatggaaaaattctatctacaagcaacaaaaatatttatcatctaccattaggaagcatttactrgtatacatacagtgtttcagtggaaagaatatccctttggaaccatatcagagaaactatgcggtcttcggcagaacaccctggtttaatattaaaccaagaaaaggcaatcaatactcttaacagcacttatacaattttaaaaccatgtactgtaagctctagaacttaatggttttctttagaaatacttgtaattaagataggaaacaggcagttaaaagtcgaaagatctcttttttcgtgaagtgtgatggtttatgtttatttggaagtcacatattttatactacctataaa

SEQ ID NO: 22307 - DNA, 601 bp, Human
ctgcaacctccgcctcccaggttcaagcgtttctcatgcctcagactcctcagtagctgggattacaggcacatgccaccaggtctaatttttgtatttttagtagagatgagattttgccatgatgaccaggcttgtctcaaactcctgacctcaagtgatctgcccatctcagcctcccaaagtgctgggattacaggcatgagccaccgtgcctggctgtgaacttggtgctttttaagtgattcctgaaaagccccaaaacagtcaataatttgaatgtggttaaaatcctttttgytttatacagtaagtcttccattagccttacaaaattactttaaaactattttttctactttactaagcagtttcttttttttttttccatctctctaatgatacataatagatgtacacagtttcagggcacatgtgataatttaatacattcatataatttgtaaagatcaaatcagtgtacttgggaaagaagttggtttagtgttccactgaagagatataaagcagggatttcggtggtgaattggcaaaattcatttcatgtgccacacactttatctgagctaacgattttttt

SEQ ID NO: 22308 - DNA, 601 bp, Human
gctggaatgcagtggcacgatcttggctcactgcaacctccgcctcccaggttcaagcgtttctcatgcctcagactcctcagtagctgggattacaggcacatgccaccaggtctaatttttgtatttttagtagagatgagattttgccatgatgaccaggcttgtctcaaactcctgacctcaagtgatctgcccatctcagcctcccaaagtgctgggattacaggcatgagccaccgtgcctggctgtgaacttggtgctttttaagtgattcctgaaaagccccaaaacagtcamtaatttgaatgtggttaaaatcctttttgctttatacagtaagtcttccattagccttacaaaattactttaaaactattttttctactttactaagcagtttcttttttttttttccatctctctaatgatacataatagatgtacacagtttcagggcacatgtgataatttaatacattcatataatttgtaaagatcaaatcagtgtacttgggaaagaagttggtttagtgttccactgaagagatataaagcagggatttcggtggtgaattggcaaaattcatttcatgtgcc

SEQ ID NO: 22309 - DNA, 601 bp, Human
aacttggaaatcgctttgcatatggcatgaaattacatgagcagtgaggaaatgggagctggtacccaaagtctttatgcacttatttgctgaagtagaagctccagaagggcggggatctttcttcccattctctatcccaagtgcgcaggacagcatctgatacctggttagtgcttaacaaatgagaatcttggaaaaaaaaaagtggggggggggtgctaaagaggatgacatgcggtcaaaggtatagtgagaaacctgaaagaccgggaccccaaaagccaaactgacaaggcaytgagattttaaaaaaaccaaaaaacaaaaaactacatgtttcccaagtattttgactaaagaattattttgaacatgcatctcttagattttttaggtcttttttgtgttgctcttaggtatttgagtatgtgtcatttttgtttttaaaaagatactatgagaagcaggttttctttccagtttttcaactggcttctcttagatggcctagtatacaatacataattcgtaggtgaatcctgggaaattcaaccccagagaagtatacaacagtgaagtgacttagttattttaaatg

SEQ ID NO: 22310 - DNA, 601 bp, Human
gtttcaaaggttaaagtagacacaaattgataagggttggcaattaagtcactgataaccaaaccaagggcagtttctgcaaagaggtgggaacttggaaatcgctttgcatatggcatgaaattacatgagcagtgaggaaatgggagctggtacccaaagtctttatgcacttatttgctgaagtagaagctccagaagggcggggatctttcttcccattctctatcccaagtgcgcaggacagcatctgatacctggttagtgcttaacaaatgagaatcttggaaaaaaaaaagtggggggggggtgctaaagaggatgacatgcggtcaaaggtatagtgagaaacctgaaagaccgggaccccaaaagccaaactgacaaggcattgagattttaaaaaaaccaaaaaacaaaaaactacatgtttcccaagtattttgactaaagaattattttgaacatgcatctcttagattttttaggtcttttttgtgttgctcttaggtatttgagtatgtgtcatttttgtttttaaaaagatactatgagaagcaggttttctttccagtttttcaactggcttctcttagatggc

SEQ ID NO: 22311 - DNA, 601 bp, Human
agtgagggatgcaaaagggatttggacatgttaactattgttttctttctttcttccttttatttttttgagatggagtctcactctgtcgcccaggctggggtgcagtggcgcgctctcggctcactgaaagctccacctcctgggttcacgccattcttccgcctcagcctcccgagtagctgggactacaggtgcccaccaccacgactggctaattttgtttttgtatttttagtagagatggggtttcaccgtgttagccaggatggtctcgatctcctgacctcatgatctgctygcctcggcctcccaaaatgctgggattacaggcgtgagccaccgcgtccggccaactattgttttcaaacttcactggtggcagtatggtgaagagcttggaagggggaaagactagaaagacagggaagcagttaaaatactgcacctgtcaaggaaaaggctgaggaaagatgtggggagagtgatactaaagtcaaagtagcaggcactggtgaccaaggggagactgagagtaggggatggcttaggttttggcttgggtgttcagaggttagagataaagaggtgtcatgacatg

SEQ ID NO: 22312 - DNA, 601 bp, Human
tgcaacagctgttcgtagatctctttatctatcgtcaagtcgatgtcattatatttctcaccacacttagataaatagctgtctattgagtcatatcgggatttactgatcctatagttattgttcttcaatggctaaagattaaaaatatatataaatgaatatgctatataaaatgagtggaatatatttttatatatgataattatataaaaacctcaacataagatacagaaaaaaagttagtgagccctaaaaagtattattaaggaaaattatgttttttaaaatctgaaggcartttaaataccctttttttctggtatgatttaaatatacttttatcttttaaaagcagatcactttcattcttattaagctagggaaaataaatactaaggttaaaagcaaataaataaataaatctataacgtaagataaacctatcaaaataattatcctttaaagtttatttctacttagaaagcatgttcaacaatttatgaacaattacatgaagaccagagcagtagtagtatagccctggttgagaatatcaaaaccacttatgagggctcctttaaaaacacccttgttcggg

SEQ ID NO: 22313 - DNA, 601 bp, Human
gaactcactgcaaagcgagagataccacttcctcttagtccagaaagacgacaggatagctcaggaagtttgaagaaagggtgtctagaagcttgaaatagctggtttgattagtatcctcacctcacccagtattttatcctgcggacactgcgggagtgtcagcgttttattcactacttacacaatgcctgctggggcactggtgtggacctagacacagacctccaaagtaagctccttttgctaaaaatcaagaaaatctcacaagtatttggaacctgaaactttaggaacaagyagcctcatgagagaagttaaagactttgcactaaaaatagaaaccagaccaggagtcagcaaaaaagtgtaaaagagctttgaagaactaaaggcgtacattcaaacccagaaagatggagtagaaacccaccttcctgcaacagctgttcgtagatctctttatctatcgtcaagtcgatgtcattatatttctcaccacacttagataaatagctgtctattgagtcatatcgggatttactgatcctatagttattgttcttcaatggctaaagattaaaaatatatataaatgaat

SEQ ID NO: 22314 - DNA, 601 bp, Human
agagagagttctttctccgtcctgaccatcttgggacccgatggcaagactggaaggatttatatctccttttgtgagtttggtgggggaaagaaaggggatatagatggtatttcaaaaggtatatatgtcaatgtctacatataacatgacacagaaataaatctatgagaagtctatctacaaaaaaaaaaggtgatatgtctgaagcactgaaataactgatcaggttattttttgtgcagtgtatgtttgaatttttcaccactaggcaaataagaaaatactgaacaataaaaaraaaaattagaatcagtgagataaacagtaagaatcgtaaaataagagtacttgaaaccgattttttatttgtccaagttctttactgcactgggtaaatgaaagtcttatgaaatttcttttgtgttctccacaggtacagaaaactgcctccccatgttggtttgtgaagtgaaatgcatataaaacagaggattccagactctcagaagtcaatacataaataaataaaaataaaactgagaagatacctcaaaatggtcagactcattagcatcatccaggtgtattttctcttcaa

SEQ ID NO: 22315 - DNA, 601 bp, Human
ccctccttaacttggactgacttgctaccatgcacatacttaatttttattttatatataagagccttctcatagcagcatcagaagggtgatgaacagctggcgaaagagtacttttgagtcagttcttgctgatgcatgtgtcttacctccatgggtcgaaattctactctccatccaatgtctgagtttggaggagggggcttaaatctcattgtctgccaatttgtggactgaatattctgtgatacaaaagcagagaagaaaaccaacttttcacacatccaggaaaatattaagwtgatctggtatttaattaaggaagaagactgctcactgtccataccaaatttcaattgacaaagacaaaaaggtacaattgaagattttcttcgagtgtgctcttttaggaaaacaaaacagccaagtgtttaacaaaagctatgaggccctatcactgcaagcttaatctcacccagctcctactccctatctcccagctacagagcagcatctgaagagccacggggcccccaccttcatccctgagaattttaggagccagcctgcctttccaggtgacactggacactttcatctg

SEQ ID NO: 22316 - DNA, 601 bp, Human
cctgacccaggcccttcctcagatcatgtcattcccaagccatctcctaattccccatctgggtctggaagccctttgcccacatctattctcagaaatcaaccctccttaacttggactgacttgctaccatgcacatacttaatttttattttatatataagagccttctcatagcagcatcagaagggtgatgaacagctggcgaaagagtacttttgagtcagttcttgctgatgcatgtgtcttacctccatgggtcgaaattctactctccatccaatgtctgagtttggaggarggggcttaaatctcattgtctgccaatttgtggactgaatattctgtgatacaaaagcagagaagaaaaccaacttttcacacatccaggaaaatattaagatgatctggtatttaattaaggaagaagactgctcactgtccataccaaatttcaattgacaaagacaaaaaggtacaattgaagattttcttcgagtgtgctcttttaggaaaacaaaacagccaagtgtttaacaaaagctatgaggccctatcactgcaagcttaatctcacccagctcctactccctatctccca

SEQ ID NO: 22317 - DNA, 601 bp, Human
ttcaaatgaaatcaggtgggaaataaatagcatatataaataaatatatctacagatagatctatacccatcaccataaagaaacatatccttacctttgacagtggaatgagaaaatccaatttgtaggaaaggatcactctggtgagcagtaccacaaacaccacataggcagagttctcaaagtctgttaattgcacctagacaagcagaagcccagagaagttatgaaccaactacacaaacatgctcttccctgacccaggcccttcctcagatcatgtcattcccaagccatctyctaattccccatctgggtctggaagccctttgcccacatctattctcagaaatcaaccctccttaacttggactgacttgctaccatgcacatacttaatttttattttatatataagagccttctcatagcagcatcagaagggtgatgaacagctggcgaaagagtacttttgagtcagttcttgctgatgcatgtgtcttacctccatgggtcgaaattctactctccatccaatgtctgagtttggaggagggggcttaaatctcattgtctgccaatttgtggactgaatattct

SEQ ID NO: 22318 - DNA, 601 bp, Human
aatttgtttttctgagagttcaatcccatccgaattcttcagaaatatctcaagttcagttctactgaggagacttttaccggcattccagcagttacactttccctccccatcctaatttaacattgtaatcaacctgggattttgtggtggatgaaatcaatgtgtaggactacttctagccatcaatcatcttgaatggaaagcgtctagaaattaagcttaggtttaaaagaaaataaagaatagggctgatggagaaacattttattgcaaagggtaaacaatttcaaatgaaatyaggtgggaaataaatagcatatataaataaatatatctacagatagatctatacccatcaccataaagaaacatatccttacctttgacagtggaatgagaaaatccaatttgtaggaaaggatcactctggtgagcagtaccacaaacaccacataggcagagttctcaaagtctgttaattgcacctagacaagcagaagcccagagaagttatgaaccaactacacaaacatgctcttccctgacccaggcccttcctcagatcatgtcattcccaagccatctcctaattccccat

SEQ ID NO: 22319 - DNA, 601 bp, Human
atgacttagatttaaaatctttttgttaagacatttaaagctataatttttccttagacatcagctctgccagcatgtctttcactttcctacacaatctgtaattctagttttggttaatctaaaatctacttggaaagacatttttaatttccaatgttaaatttctccagagtatctctttcgttgaattttagcgggaacgcatgctgtattatgtctacttttgagaagtgaagattttctttaatttttgtaaatcttactcatggcatttgaaaaaagatgtggtatgagataygtaatatacgcatacaaccaagcttattaaccatgcctttaattcccccatggcctttcccatcctttgattatatggcctgtcagttactgagtaacatgcaaggtactctgttaagtggtttacctccattaatccccacacgggcttacaacagcctacttattcccctctgggatacatgtgggaaactgaggcactgagaataagtcacttgtccaggttaaaagcctagtaaatagtaccagggatttatgcatttagttctcacatcaaagccatgtattacccatcacacta

SEQ ID NO: 22320 - DNA, 601 bp, Human
tggagtgcagtggtgcaatctcatctcaccccaacctctgtctcctgggttcaagcaattctttgtgcctcagcctcccaagcagctgggattacaggcctgcaccaccacactcggctaatttttttgtatttttagtagagacggggtttcaccatgttggccaggctggtttcgaactcctgacctcaagtgatctgcccgcttcagactcccaaagtgctgggattacaggcgtgagccaccgcgcccggcctataacccggttcttctaagttgagtgctcttcccctgctgcctygccattggggttttgcctccccactttagtgaggaaaggcaaagacagttcataggttgtcatatctggaataaggttacagccctcccaagggcagaagatcactgctgttttacccatctggtgcctccggacatgtagactcactcatgaaaccgaaaactgttttatttgtgaattctctgtatctccaatgactttttaagactctcaaagcagaatttaaaaaacgttttagtagtaatcccttattttctataatgaaatcttatgtgggacctcaatatatacaacagtgac

SEQ ID NO: 22321 - DNA, 601 bp, Human
acccagttcttcttctgtttttttgagatggagtctcgctctgttgcccaggttggagtgcagtggtgcaatctcatctcaccccaacctctgtctcctgggttcaagcaattctttgtgcctcagcctcccaagcagctgggattacaggcctgcaccaccacactcggctaatttttttgtatttttagtagagacggggtttcaccatgttggccaggctggtttcgaactcctgacctcaagtgatctgcccgcttcagactcccaaagtgctgggattacaggcgtgagccaccgygcccggcctataacccggttcttctaagttgagtgctcttcccctgctgcctcgccattggggttttgcctccccactttagtgaggaaaggcaaagacagttcataggttgtcatatctggaataaggttacagccctcccaagggcagaagatcactgctgttttacccatctggtgcctccggacatgtagactcactcatgaaaccgaaaactgttttatttgtgaattctctgtatctccaatgactttttaagactctcaaagcagaatttaaaaaacgttttagtagtaatcc

SEQ ID NO: 22322 - DNA, 601 bp, Human
tgcaattaggactcattcccttagggattctactttctgctcaaatgcttcccagtgggaggaacaggctttttatttatgtgaggactgtatcactcaatcatggattggtatgtgatttttcaaccaatcagggaattttaagagaaacttaaaacccaaaacttatattcatgtggaacgtctgcatttcaaagcacctctgtgactgagccttgcaacagatatacagtgttgggagggcaggtggctggttccctttatatagcagtgtctcaccaggagtcccagggtaacgaaggcagaaggcaggactagaacccagttcttcttctgtttttttgagatggagtctcgctctgttgcccaggttggagtgcagtggtgcaatctcatctcaccccaacctctgtctcctgggttcaagcaattctttgtgcctcagcctcccaagcagctgggattacaggcctgcaccaccacactcggctaatttttttgtatttttagtagagacggggtttcaccatgttggccaggctggtttcgaactcctgacctcaagtgatctgcccgcttcagactcccaaagtgctgggat

SEQ ID NO: 22323 - DNA, 601 bp, Human
tgagggtgtactcctctgcagcgagctccgtgctgttctgggccttgccacaaccatccaccactgcattgccacctgccggagaagagggtcaggggagctttagcagcttgttgcagcataagctgacattagaaatctaagataatgtaatacctttgcaaatatctttcctgaaataaaacattccctgcaagacagcatctcttttctgtgctaccttcatgttctcatcaacctaagggaaaaaaagaatcacgactaagtcaaaatattcttgatcagacatacaagttgcagyaccttcctcacctttgcaattaggactcattcccttagggattctactttctgctcaaatgcttcccagtgggaggaacaggctttttatttatgtgaggactgtatcactcaatcatggattggtatgtgatttttcaaccaatcagggaattttaagagaaacttaaaacccaaaacttatattcatgtggaacgtctgcatttcaaagcacctctgtgactgagccttgcaacagatatacagtgttgggagggcaggtggctggttccctttatatagcagtgtctcaccaggagt

SEQ ID NO: 22324 - DNA, 601 bp, Human
atcctttgtgactccagaaagtttacagaagccttgagttaaatacagatgccattaccattattgctgtcactttattaacagctgacagctcccttgtgccaagtactgtgttagcagtacttggttactgtactgtattgtaaatgtaacctcctcaaaactaacaaagaaaggggattctcaggagcctcactgtatgtacaaaggcaggctaaagaactgttcagcttatttaacttacagagttccttagccctataaaagggcccatgatgatgtaagatcaacacagttggaygtaaatgataagtaagcaatccagatgccatttcatcatctaagatgccagtgattttcagatgcacccctattttatgaactgataagaaaaaaagcactactaatctaaattatgagtgtcaaagattataaggtgaatacaattgcagaaatataaaaatgtgaaactgtgcatgaatacagcattattttaaaagactactttaagaaattgaacattctaagattataccatgctgtctatattatgagattaagaaaaatagatatcataccagatgctctcttcttaattagc

SEQ ID NO: 22325 - DNA, 601 bp, Human
ggtgggaacatctttcatagcgtttgaagaactcctcctgggcaggaattctaggttgcaggcaggcaatgagaacacatacatccagtttctatggtacctgttagatgccacccatatgctgacactgccagctcttaaggaacaggagccagcacatgtgtacaagaacatgtgccctcccatttggccagagggctaggactacaaatgccagtgtcatgagactgcctcagaggactgtagggtccttgagcgatctttgatcaaagaggtggagagaataaagaacagtaagtaragtgaatgaagtgggaaattggcagtataccatttgaggggtgaggtagggttctacggctatcctttgtgactccagaaagtttacagaagccttgagttaaatacagatgccattaccattattgctgtcactttattaacagctgacagctcccttgtgccaagtactgtgttagcagtacttggttactgtactgtattgtaaatgtaacctcctcaaaactaacaaagaaaggggattctcaggagcctcactgtatgtacaaaggcaggctaaagaactgttcagcttatttaa

SEQ ID NO: 22326 - DNA, 601 bp, Human
gtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactcygtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaaagaaaagcaacatagtggggtttctgtcaatctgtcctcggctgcccttctcatttgttgatgggaccttgaaagcaagcttgctaggtgccctctgtggctccagcc

SEQ ID NO: 22327 - DNA, 601 bp, Human
cctagacctggccatcgcaaccaccagcaagtttgtggccacattgtgggggcatctagaatctggcacaggcacctttctagacactttgcgtgcatcttagacttaatcctcctaacagatttgtgaggaaagtattctcatccccatttgacagatgagaagactggagctcagtgatgttaagggacttgccaagttgaccttgccagtcagtagcagagctgggattcaaaccccagtatgtctgattcaaaagtggaagttcctaacctccaccaagttaccctgtgatgccacytgaggcttcaagttgagagctcagtgaaatggtaggaaaactcagggcagagcctacttcatgagacagcctccatttgctctggagaatggaaatggtgataatgcttacctccctcacctgctgtgagccttcaaagtgatcatgcatataaaggcatttgacaaagtgccaggcacaaagaaagtattattattaccaacattactgcatcttaattcctttaggggaaaaaaaaggctttcattctttcacttctccatcctggtggaaataaaaacactaactaaacactactgt

SEQ ID NO: 22328 - DNA, 601 bp, Human
cttcccctttacccttctcttcctgtccctccctttcccctccctcccaccctccctgcgtttataattccaataaatatatatggaaagcctatcaggtaccaggctccatgccaggctctgaagagttcagttcaaagagacactcacaggctggcactgttcattaagagaatcacagagatgaatctcacaatgcaggaaaactaggtcataatgtccagcaaacatgaacatctgaactgagaaccggctttccgaggactgcccattctcctccacgtggatggtggaatcacgytgatttgagcagctgggagggtgacaggggcaaaggtgtaacttctaaaaacagcagtggagaaaattaaagagtccctcgggttccctccatcatgataacgtggactttttctgttcctctgtttcctccaagatgttatccataagcgcacatggcttaaattatttgagggcacagtctctggagtgaaacagactggttttatactgtagcctgacccacgttctagctaagtgattatgggcaggttactcatccttactgaaccttacttttcttatctgtaaagtggagaca

SEQ ID NO: 22329 - DNA, 601 bp, Human
actgcccattctcctccacgtggatggtggaatcacgttgatttgagcagctgggagggtgacaggggcaaaggtgtaacttctaaaaacagcagtggagaaaattaaagagtccctcgggttccctccatcatgataacgtggactttttctgttcctctgtttcctccaagatgttatccataagcgcacatggcttaaattatttgagggcacagtctctggagtgaaacagactggttttatactgtagcctgacccacgttctagctaagtgattatgggcaggttactcatcctyactgaaccttacttttcttatctgtaaagtggagacagtaatatacactttatgagactgatgtgagcatttaatcagataatccacatattgcttggcacatagctaatgtgccatagctcaatgacaaatattagctaggattattactataatttaaatcatgatctatagaaatgcatttttcccttgtttttgtcagccgggcatgtttaatgatatttcaccccacaacatttatcatattgttttcatattgaccagtgttcacttctgtgtaataatccatcactaccaaat

SEQ ID NO: 22330 - DNA, 601 bp, Human
caccaaaccatctggaaaccactgaattagaaaatgtctaatccttctgatcctgttgctttgtgatcccagggagcaatagggaatgagacgggcactctggatttttgacatctcagaaagtcccctagcaagtctagggatgctaaggaactgattcaacagggccccatttcagcacagaaacacaacaaaacagagaaaagcccctgcccaaattgctatctgatgctatttctgctggggacgggggtgcctgtttatccgataaaagctggtctctgcttaaatctcacgtctkcagggaagctgttctgtccccatcaaacccaccaccaacaggggtctggaacccctgttccctgctcccaaagcaccccacatttcttttacattgtactcatcttgcttataagtaattattggtttaattagttgtttaatacctttgttcctcaaggtgaatgaactttgaacttgtcctgtgtttttgttttctagcacatttagtaagcactgtttcatgttgctgcattgcctagttataacaatctttaatagccacggaatagtctatgtctgccttgttcatgctgaacat

SEQ ID NO: 22331 - DNA, 601 bp, Human
atcccagggagcaatagggaatgagacgggcactctggatttttgacatctcagaaagtcccctagcaagtctagggatgctaaggaactgattcaacagggccccatttcagcacagaaacacaacaaaacagagaaaagcccctgcccaaattgctatctgatgctatttctgctggggacgggggtgcctgtttatccgataaaagctggtctctgcttaaatctcacgtctgcagggaagctgttctgtccccatcaaacccaccaccaacaggggtctggaacccctgttccctgytcccaaagcaccccacatttcttttacattgtactcatcttgcttataagtaattattggtttaattagttgtttaatacctttgttcctcaaggtgaatgaactttgaacttgtcctgtgtttttgttttctagcacatttagtaagcactgtttcatgttgctgcattgcctagttataacaatctttaatagccacggaatagtctatgtctgccttgttcatgctgaacatctttaatatacaatcaatgaatacttgtggaatgaatgactgaatgactggaggctcctggagga

SEQ ID NO: 22332 - DNA, 601 bp, Human
ttctctttggcaaaaaaacaaaaccatacagatgtttatgtgtatgtgtatgtaggtgtatctcaaatccagatctgatttccagagtcaatttgcttaaccatgcagccaccctaccttctgagctcatggaggtcaagggacctcttccttcagtgttactgacactttatgggaaggcgaatgaggaaaccaggcaaaaaactagaacgataaattattgacccttgggaagagtcaggaaccaacaagcttgcttctctgtgcatccctcccccaccatccctaattgaaattatcrtaattgtagcttacgtttatgaaactcacatgtcagacttatactaagctctttatgtaaaccaacttgtgcactctcacacaaccctgggggctcagggaagctaagtggcttgtccaagatctcagagctactatgataggtcccatcagcccaacacataccttctggcagcagtggtgtgaaagccacttacctccagaatgttcctgcaggcactagcctggacggggctggtcacagatacccagttcctctcctctgtctgcaagatgctgctgcagtttgggtctcgcaggt

SEQ ID NO: 22333 - DNA, 601 bp, Human
ccctaccttctgagctcatggaggtcaagggacctcttccttcagtgttactgacactttatgggaaggcgaatgaggaaaccaggcaaaaaactagaacgataaattattgacccttgggaagagtcaggaaccaacaagcttgcttctctgtgcatccctcccccaccatccctaattgaaattatcataattgtagcttacgtttatgaaactcacatgtcagacttatactaagctctttatgtaaaccaacttgtgcactctcacacaaccctgggggctcagggaagctaagtgscttgtccaagatctcagagctactatgataggtcccatcagcccaacacataccttctggcagcagtggtgtgaaagccacttacctccagaatgttcctgcaggcactagcctggacggggctggtcacagatacccagttcctctcctctgtctgcaagatgctgctgcagtttgggtctcgcaggtaggcaatgacctcctcccccaaacccaggcctcccagcaaacatttgtccaccttcaccttgatctccctgggcccacagtctagctgaggctgcaaactgtggacatctg

SEQ ID NO: 22334 - DNA, 601 bp, Human
aaggtccctgggatccagatggaattcatgcctaggctggcagtaggtgggactggcaaagggggcccctcattcaagatttccaagtgtcctatgtgcaggcttgctaaggttttttagtctagttcctcttggggattgtgttatttggggaggcaggatggacttgcattccatactagaatcaaagttagatatatgctaccttgttgagtcagcacatctgaccaagttcagagctatcatattttaactcaacatttattcaacacacaacttcttgagaatctactatctgccrggcactggggctacaacacttatcaaaactgaaaaaattcccactcttatagagctaacagttgaataggggagacaaatagtaaactaataggaagacagtttctattgcattcattaatgcattgattcaatatatatttaccaaccacattatctctctctctgtctctcttttttttttttttttttagacagagttttgctgtgttgcccaggctggagtgcagtggtccaatctcagttcactgcaacctctgcctcctggattcaagtgattctcctgcctcagcctcccaag

SEQ ID NO: 22335 - DNA, 601 bp, Human
cacttatcaaaactgaaaaaattcccactcttatagagctaacagttgaataggggagacaaatagtaaactaataggaagacagtttctattgcattcattaatgcattgattcaatatatatttaccaaccacattatctctctctctgtctctcttttttttttttttttttagacagagttttgctgtgttgcccaggctggagtgcagtggtccaatctcagttcactgcaacctctgcctcctggattcaagtgattctcctgcctcagcctcccaaggctgggattacaggcaygggattacaggcatgagccaccacacctggctaatttctgtatttttataaagatggggttttgccatattggccaggctggtttcaaactcctgacctcaagcgatctgccggcctcagcctcccaaactgttgggattacaggcatgagccactttaccaaccaccttctcaaatgctaggtgcattcaacatgaagtaaataaggcatggacttggcccatgaggatttcttggtcttgtgtaaacaccaacatatcaacagtttattatacttcaatatgataaagatacagacag

SEQ ID NO: 22336 - DNA, 601 bp, Human
agccaccacacctggctaatttctgtatttttataaagatggggttttgccatattggccaggctggtttcaaactcctgacctcaagcgatctgccggcctcagcctcccaaactgttgggattacaggcatgagccactttaccaaccaccttctcaaatgctaggtgcattcaacatgaagtaaataaggcatggacttggcccatgaggatttcttggtcttgtgtaaacaccaacatatcaacagtttattatacttcaatatgataaagatacagacagaagtatgtacagatgsagggggagcagagaagaaggtctatctgagtctcttggtgaagtcagggaaggattcacagtggtatgaaatttgaaacgtgggtaggagttttgcaagtcagtaaagcaagtgaacgcatcccaggctaagggaacaggagaggcaaaagcatggagatgggatagagggaatggtgcatttgtggaatttcagagttcagaggcgcaggaacctaaaatgagagcagggtgtgggagaaggagatggaagtgaaagtcagagcacagagggatgtgtctgcaagcaatggggcccact

SEQ ID NO: 22337 - DNA, 601 bp, Human
gtagtgtgctcagaggaaggcatgcttgtgccaaaggcaagatcaaaggcccttgttagagttcagtgatggagggaaataatctcagtgggaggctcatccatcccctgtccagggcttagtgcttgtttgtctatgacatccctacccatgggacatctcactctgcttgcttacctcctgggacgagaaattcatcacctcctgagcctgcccaattggactgctctgatttagttctcacaatagccctgtatggtgggtattattattaccttatcctcattttacagatgaggayattcaggctcagagacagtagtgacttgtccccagaagtctgcccatgtccctgacatgaagaccctgtggctatgaaaacatagctcctacattagcagaattatcatcttcagtgtcttcatccctcaggggtcaagcctgcccatgtcagaaccatttcctgaggccacggcccagcagctgacctggaaatttgctccaaccctgccctcctatccttgcaaacccactggctttacagcaaatggattggagagcccacattcccttgacctcaggtccatgcccctgactctgc

SEQ ID NO: 22338 - DNA, 601 bp, Human
taaggacaaggaatgtattagcctattcaatcaaaatgagaaaggacagcatggtggttaaggccatggatgctggagctagaatgccaagttcaaatcccagctgtaccatgctccagctctgtgatactaggagagccccttaatctctctgtgcccctaattggggtaattaggtagcacttacctcgtggaactggggagaggatcaaatgagttaatacatttgaagtacttaggatagcaacaaggacattgtgagcattatgtattagctgttatttttgctgttacccccccscctttttttcagatcagaacactgaggctcagggaggcaaattaaacttctcaaatggagccaaaatcggaacgagcatgagttctggattttatgctacacacatttataaactaggaaatttcacccttgaatgggaatttctggcttgaaatgttggaaggtctcaacccctgtgttgagttctcactgggcaggagctgagtcgaggctgctctgcatcctctcctgtctcctcttgacttgctccactcactctactgagcctgggaggcatctcattggctgtgtagctgcctc

SEQ ID NO: 22339 - DNA, 601 bp, Human
aggctgctctgcatcctctcctgtctcctcttgacttgctccactcactctactgagcctgggaggcatctcattggctgtgtagctgcctcctccagggctctgctgctcacctgtgcagtatctcagattacaccagggagtgccttccaaccggtacacatggtacccgcctgggcaggccttcaccagcacctctgttttccagaaacagcagttgccactccaatgggcacaggcagtgtggttggtgatgccatccccaagggcagggtgggtcccattcagccacatgggagcrtctgtctggcatcggtgcacctggacacaggtctccgacatccttactcctccttcccctacaaagcggtaccagccgctcatgtttttatcgcacccctgggaccctgctgagttctctgtgcttcggaagggttcatccaggagggtgtaattctgacaggggtcaaaacagacatgagcctctggggtgccaggagctccgcagtccaggtccagcccatacgaactggcttcaatggggtttccataacctgggaaagtgacagagtgcagttgggtttactgagcaatgccagaa

SEQ ID NO: 22340 - DNA, 601 bp, Human
aaatgaaagttgtcataagcccatctcatccccagaagtaacaataaatttgtaatatagccttcttcttaggcaagtttaaaatatattgctttcttaaaaataaaaataagtttaattctgtgcaacatctttttttccacttgcattttttacttaatataacatagacatttttccataccagtagcacagtctattgcaagaactcccaaccttggcactattgacattttggctaggtcattcttcactggaggagccatcctgtgcattatagaatgtttaggagtatccttgrcctctacctaccagatcccaccagcatgccccaaagtggtctccaggcattgccaaatgtcttcttggggggcatcgcccccagttgagaaccactgatctaacaagaccatttctgattgttgatctaccatttttaaaaacagttttagaaactgtgatgtatgaagaggcagagaagtgaaggaggaagaccacaggctggtcaggctgagtttaaatccaattctacacctgctggctgggtgaccttggcaggtgacttaagtcccctgagactcattggcaaaaccacacctgt

SEQ ID NO: 22341 - DNA, 601 bp, Human
ttgccccttaactgaagtcatgctgccaatccctatccctggatgactgcaatcaccggcttctcctccctgctgtcaggccactcagctcagtgcccaggggaaactgtatcaatccacgagcgggattttcagtctcttccttaatgtctttgacagatgtattgtcctctcaacaacataacaagacaccagtacttacctatttctatgtgtgttgaaaggccacacggtgaacctctatggcagagagaacccaacatgatcagcaggccaggccacaacctgaaagcagacatgmtctcattgcccaccggcttctctggtgacgtgggaatgctcagagctgcagcagcactgggactccaaaatccaggtgcagacccaccgcttctctctaagcaggtcactgaccgaggaaaccaagcctcatttcaaaataatatcgttttccaatgaagtcaactgtccaactactgtttagcttcaccagaacagcaaacaaactctgtgctcctggggggtggggttgggaggataaactgaaatctgaaaagccttaggccagaagcactgcatcttctgaccgaggttttttctg

SEQ ID NO: 22342 - DNA, 601 bp, Human
gaaacacacaggggtcccatgaccaatggggcatcagctctctttcttatttgccccttaactgaagtcatgctgccaatccctatccctggatgactgcaatcaccggcttctcctccctgctgtcaggccactcagctcagtgcccaggggaaactgtatcaatccacgagcgggattttcagtctcttccttaatgtctttgacagatgtattgtcctctcaacaacataacaagacaccagtacttacctatttctatgtgtgttgaaaggccacacggtgaacctctatggcagasagaacccaacatgatcagcaggccaggccacaacctgaaagcagacatgctctcattgcccaccggcttctctggtgacgtgggaatgctcagagctgcagcagcactgggactccaaaatccaggtgcagacccaccgcttctctctaagcaggtcactgaccgaggaaaccaagcctcatttcaaaataatatcgttttccaatgaagtcaactgtccaactactgtttagcttcaccagaacagcaaacaaactctgtgctcctggggggtggggttgggaggataaactgaaatct

SEQ ID NO: 22343 - DNA, 601 bp, Human
ctctcgttcactgagcctctcactatttccccacccagagaaacacacaggggtcccatgaccaatggggcatcagctctctttcttatttgccccttaactgaagtcatgctgccaatccctatccctggatgactgcaatcaccggcttctcctccctgctgtcaggccactcagctcagtgcccaggggaaactgtatcaatccacgagcgggattttcagtctcttccttaatgtctttgacagatgtattgtcctctcaacaacataacaagacaccagtacttacctatttctaygtgtgttgaaaggccacacggtgaacctctatggcagagagaacccaacatgatcagcaggccaggccacaacctgaaagcagacatgctctcattgcccaccggcttctctggtgacgtgggaatgctcagagctgcagcagcactgggactccaaaatccaggtgcagacccaccgcttctctctaagcaggtcactgaccgaggaaaccaagcctcatttcaaaataatatcgttttccaatgaagtcaactgtccaactactgtttagcttcaccagaacagcaaacaaactctgt

SEQ ID NO: 22344 - DNA, 601 bp, Human
ctgtctagtatcagtttcttcatctgtaaaagaagagaactggactcggtgacttctagtgtcctttcagatagtcaaattctgtgataacaggttcttgcccatcgtagctcagtatatatgtctattttgcactgataaattttcattttttgcctataatcttattattctttgaaacttctggaggtggtacaactataaaattctgttataatttttatctaaattaaagaaaactcaggccaggcgcgatggctcacgcctgtaatcccagcactttgggaggccgaggcaggcrgatcgcaaggtcaggagatcgagatcatcctggctaacatggtgaaaccccatctctactaaaaaaaaatacaaaaaaattagccaggcgtggtggcgggcacctgtagtcccagctactcgggaggttgaggcaggagaatggtgtgaacccaggaggcggagcttgcagtgagccgagattgcgccactgcactccagcatggcggacagagcgagactccgtctcaaaaaaaaaaaaaagaaaactcagaacatcaggtatatctgaaattaatctgaaaattgctgtagaatgtta

SEQ ID NO: 22345 - DNA, 601 bp, Human
ttctcagaatccgtgcagattctatttcaggagatgccttcaattatgttcacataaatattattctttaaatgtccattaggacctttgtttggtacttaatgaagaagggcaagcaattatctggttttattaaaatttcagatgcaatctgtcttgtaaatttttaaacactaaggattaaaaatggagtatttccatttatatttgttcctcatcagcttactctgtagttttggcaatttcaacttcacagaacatagaactgcaagacactttagaattctttaagaagttcaaycccctcattttatagaattgagaggtaggtaaaaagtgaattgctcagaatcacacatctactttactggatggctggaactagaacctaagtctgatcctcttttccattgtttcctgactcccttctagcagtacatttttaatggaaagaacgccggaccagctgtcaggacatgtaattctaggccaggccactgaaaacttagctgtaaaactgtctagtatcagtttcttcatctgtaaaagaagagaactggactcggtgacttctagtgtcctttcagatagtcaaattctg

SEQ ID NO: 22346 - DNA, 601 bp, Human
ctacaataaaaacaaaaagatgtgttcttctcagcagcacatatactaatattggaatgatacagagaagattagcacatttttaaaaatgtactgtttaaaaaatttctcaagtattttttcaaattatgagtcatatcattaaaatctttaaattttaagtgtgatatatataagatacctataaaatgttcaagtagcacttggaagagacatataccttttaaccataatattaatgtcttataacattaataacataatatacaacattataacataaagaaataaataatgagtmttttttttttttttgagacggagtttcactcttgttgcccaggctgaagtgcagtggtgcaatctcagctcaccacaacctccacctcctgggttcaagccattctcctgcctcagcctcccgaataactgggattacgggcatgcaccaccacacccggctaattttggatttttagtggagatggggtttctccatattagtcaggctggtctcgaactcctgacctcaagtgatccacctgcctcagcctcccaaagtgctgggattacaggcatgagccaccacgcccagccaaaa

SEQ ID NO: 22347 - DNA, 601 bp, Human
gtaacaagaagtggaaaataaatgatctctctcaagtatgactttttaaaataaaaacaaaaaagatgggccaggcatagtggctcatgcctataatcccagtgctttgggaggccaaggtggaaggattgcttgagcccaggagttcaagaccagcttgggcaacatagcgagacccccatctctacaataaaaacaaaaagatgtgttcttctcagcagcacatatactaatattggaatgatacagagaagattagcacatttttaaaaatgtactgtttaaaaaatttctcaagtattttttcaaattatgagtcatatcattaaaatctttaaattttaagtgtgatatatataagatacctataaaatgttcaagtagcacttggaagagacatataccttttaaccataatattaatgtcttataacattaataacataatatacaacattataacataaagaaataaataatgagtcttttttttttttttgagacggagtttcactcttgttgcccaggctgaagtgcagtggtgcaatctcagctcaccacaacctccacctcctgggttcaagccattctcctgcctcag

SEQ ID NO: 22348 - DNA, 601 bp, Human
ttacttaaccagtcactgttctaagctccttatatgtattaagacttgttgaatctgcatctcccagtgaggtaggcatgttatttaatgtgataaaataatctgaagtaaattttaaaaattatgccaaagagcaaactgttgaggaaaaaagaagagtactaacgaaggatgtatccttcagatattaaaatgtatttttggatttttttttttttttttttttgagatggagtctcacactgtcaccgggctggagtgcagtggcgtgatctcagctcactgtaacctctgccttccrggttcaagcaattcttcctgcctcggccttctgagtagctgggattacaggcactggcctccacacctggctaatttttgtattttttttctttttttcttttttgagacagaatctcgctctgtcacccaggctagagtgcaatggcatgatctcggctcactgcaacctctacctcccaggttcaagtgattctcctgcctcagcctcctgagtagctgggattacaggcaccggtcaccacgcccagctaatttttgtatttttagtagagacagggtttcaccaggttggccaggc

SEQ ID NO: 22349 - DNA, 601 bp, Human
tgagttggacttttttcacttaaaaatagtaattaactttactggctatttacttaaccagtcactgttctaagctccttatatgtattaagacttgttgaatctgcatctcccagtgaggtaggcatgttatttaatgtgataaaataatctgaagtaaattttaaaaattatgccaaagagcaaactgttgaggaaaaaagaagagtactaacgaaggatgtatccttcagatattaaaatgtatttttggatttttttttttttttttttttgagatggagtctcacactgtcaccgrgctggagtgcagtggcgtgatctcagctcactgtaacctctgccttccgggttcaagcaattcttcctgcctcggccttctgagtagctgggattacaggcactggcctccacacctggctaatttttgtattttttttctttttttcttttttgagacagaatctcgctctgtcacccaggctagagtgcaatggcatgatctcggctcactgcaacctctacctcccaggttcaagtgattctcctgcctcagcctcctgagtagctgggattacaggcaccggtcaccacgcccagc

SEQ ID NO: 22350 - DNA, 601 bp, Human
tcagttacatgaaccaataaagtccacttttttccaaaagatagcttgagttggacttttttcacttaaaaatagtaattaactttactggctatttacttaaccagtcactgttctaagctccttatatgtattaagacttgttgaatctgcatctcccagtgaggtaggcatgttatttaatgtgataaaataatctgaagtaaattttaaaaattatgccaaagagcaaactgttgaggaaaaaagaagagtactaacgaaggatgtatccttcagatattaaaatgtatttttggatttttttttttttttttttttgagatggagtctcacactgtcaccgggctggagtgcagtggcgtgatctcagctcactgtaacctctgccttccgggttcaagcaattcttcctgcctcggccttctgagtagctgggattacaggcactggcctccacacctggctaatttttgtattttttttctttttttcttttttgagacagaatctcgctctgtcacccaggctagagtgcaatggcatgatctcggctcactgcaacctctacctcccaggttcaagtgattctcctgcctca

SEQ ID NO: 22351 - DNA, 601 bp, Human
ttttttttttaaataagaacttactaataatgtggaccatatataggtgcaacaaagaagtacttcaagaaattaaaacacaaagaaagatagtatcatctggtttttggttttgtttttctaaccagtatcccattctcctccttctagaggcagaatcaccctctcccgaggagagcccattccacaccgctcaggtggggctgaccagaatgctgtggccagcatgcccaccctcaccacagagtttggctcagaaatggacctttgagcaaagctagttccgttcacaccttccccragacttctccactagagctctgggaagatgccctcttccccttgtggctgctgagctctgacgctgagtgctaggctgtcagcattccccacgtggagagatatagaaaccatctagagctctgggcccagttccacactgcagatatcagttacatgaaccaataaagtccacttttttccaaaagatagcttgagttggacttttttcacttaaaaatagtaattaactttactggctatttacttaaccagtcactgttctaagctccttatatgtattaagacttgttgaatctgc

SEQ ID NO: 22352 - DNA, 601 bp, Human
gtcccagaaccaataggtgaggtggtggcttcttattttacaaaccgtgtatgagaccgttgaatttgtagcaaatggggcagtgaatgcctgtcaatggcaggagtagcagctccttgacaggccagttctgtgcattattttgggagtcctttctggacacctggcctagagcctgctcctgcagttcccacagtttgtaagcagtgaattctctaattcctggtattaatcctttccttgcctaaactagcagaggggtttccattatctgcaaatgaactctgatggacacactggrcaaagtaaaagtttggcaatatcccgcccttttttttttttttttaaataagaacttactaataatgtggaccatatataggtgcaacaaagaagtacttcaagaaattaaaacacaaagaaagatagtatcatctggtttttggttttgtttttctaaccagtatcccattctcctccttctagaggcagaatcaccctctcccgaggagagcccattccacaccgctcaggtggggctgaccagaatgctgtggccagcatgcccaccctcaccacagagtttggctcagaaatggac

SEQ ID NO: 22353 - DNA, 601 bp, Human
ttcaatgattcacagtgaaaagagaaaaacggacacacaaacgcacgtacgcacgcacacaaacaagcacgcacatatgtgcatatcagtttatagttgctacctgtgttttagtgtaagatgacgtcctttgtgttttgggagggctaaaaaaagtgctttccctttttaaatgatgtgaaagtagatggtagcggttttcttctaaatgttcttccttggtcaactggctcacttccttccattccgagtcccttatgggatgtctagctgcatgctataggctagaaaacacagactrcatttcccaggctgtctcagctcacagtctgatatggcccagcctccaccacggagccctcggctaacatggaagcatttggtttttccacagcagaggtagcacagcccctcgtgttgcagctctggcttcccacgtgtttatgggcagagtacaggacaaccatattgttagtaaggcaggtgcccgaggtggtgatgaggtcccagaaccaataggtgaggtggtggcttcttattttacaaaccgtgtatgagaccgttgaatttgtagcaaatggggcagtgaatgcctgtcaat

SEQ ID NO: 22354 - DNA, 601 bp, Human
cccaggctggagtgcagtggcgcaatctcagctcactgcaacctcccaggttcaagcgattctcctgcctcagcctcccaatgtgctgggattacaggcatgagccaccatacctggcccacagctggttttttataaaattttcaatgattcacagtgaaaagagaaaaacggacacacaaacgcacgtacgcacgcacacaaacaagcacgcacatatgtgcatatcagtttatagttgctacctgtgttttagtgtaagatgacgtcctttgtgttttgggagggctaaaaaaagtgytttccctttttaaatgatgtgaaagtagatggtagcggttttcttctaaatgttcttccttggtcaactggctcacttccttccattccgagtcccttatgggatgtctagctgcatgctataggctagaaaacacagactacatttcccaggctgtctcagctcacagtctgatatggcccagcctccaccacggagccctcggctaacatggaagcatttggtttttccacagcagaggtagcacagcccctcgtgttgcagctctggcttcccacgtgtttatgggcagagtacagg

SEQ ID NO: 22355 - DNA, 601 bp, Human
gctcttgtcacccaggctggagtgcagtggcgcaatctcagctcactgcaacctcccaggttcaagcgattctcctgcctcagcctcccaatgtgctgggattacaggcatgagccaccatacctggcccacagctggttttttataaaattttcaatgattcacagtgaaaagagaaaaacggacacacaaacgcacgtacgcacgcacacaaacaagcacgcacatatgtgcatatcagtttatagttgctacctgtgttttagtgtaagatgacgtcctttgtgttttgggagggctaaaaaaagtgctttccctttttaaatgatgtgaaagtagatggtagcggttttcttctaaatgttcttccttggtcaactggctcacttccttccattccgagtcccttatgggatgtctagctgcatgctataggctagaaaacacagactacatttcccaggctgtctcagctcacagtctgatatggcccagcctccaccacggagccctcggctaacatggaagcatttggtttttccacagcagaggtagcacagcccctcgtgttgcagctctggcttcccacgtgtttatgggc

SEQ ID NO: 22356 - DNA, 601 bp, Human
attttctctgtcaatccagtaaagcaggatttccctgaggccttaaggttgttttactgacccagagctgttgtttttgttgctgttgttgtttgtttgtgttttgagatggagttttgctcttgtcacccaggctggagtgcagtggcgcaatctcagctcactgcaacctcccaggttcaagcgattctcctgcctcagcctcccaatgtgctgggattacaggcatgagccaccatacctggcccacagctggttttttataaaattttcaatgattcacagtgaaaagagaaaaacrgacacacaaacgcacgtacgcacgcacacaaacaagcacgcacatatgtgcatatcagtttatagttgctacctgtgttttagtgtaagatgacgtcctttgtgttttgggagggctaaaaaaagtgctttccctttttaaatgatgtgaaagtagatggtagcggttttcttctaaatgttcttccttggtcaactggctcacttccttccattccgagtcccttatgggatgtctagctgcatgctataggctagaaaacacagactacatttcccaggctgtctcagctcacagtct

SEQ ID NO: 22357 - DNA, 601 bp, Human
tttagaaacagcagaaaacacttgtttaaatttcatcttctttcattttctctgtcaatccagtaaagcaggatttccctgaggccttaaggttgttttactgacccagagctgttgtttttgttgctgttgttgtttgtttgtgttttgagatggagttttgctcttgtcacccaggctggagtgcagtggcgcaatctcagctcactgcaacctcccaggttcaagcgattctcctgcctcagcctcccaatgtgctgggattacaggcatgagccaccatacctggcccacagctggttttttataaaattttcaatgattcacagtgaaaagagaaaaacggacacacaaacgcacgtacgcacgcacacaaacaagcacgcacatatgtgcatatcagtttatagttgctacctgtgttttagtgtaagatgacgtcctttgtgttttgggagggctaaaaaaagtgctttccctttttaaatgatgtgaaagtagatggtagcggttttcttctaaatgttcttccttggtcaactggctcacttccttccattccgagtcccttatgggatgtctagctgcatgctataggcta

SEQ ID NO: 22358 - DNA, 601 bp, Human
tatactgtgcaattaaaaatatattgtacacacatatatatatttttaaagtcatagctattcctattaaccaagtaaaagtgacttcattcagtctgcaaactttcatcttacctcctttgcagatgctagggtaaaaacaatcaggaaacacgattccagcctgatacgcatcctggtgttctagtaacagctgcagagcaagaaaatacagagattaaggggcaggagtcaacagcctggggagtataggccccaccaattttctgtgatgagatgctagaaatatgggggtatagayggaatgaaagggaaaaaggaaggaaagcaggcataaagtaaataaatgattaaaattcacacataatccaagacaaaacacaacaatatataacttcagattcttccctaccaaacacagagaggctaatttagaaacagcagaaaacacttgtttaaatttcatcttctttcattttctctgtcaatccagtaaagcaggatttccctgaggccttaaggttgttttactgacccagagctgttgtttttgttgctgttgttgtttgtttgtgttttgagatggagttttgctcttgtc

SEQ ID NO: 22359 - DNA, 601 bp, Human
tttgccaagacatgaaaattgagattctgtggataagtgacttttttaagatcacatgctaatatagaaggaacacaaactcagaccttttgatctcttgcaaaatgtcttctatcatgccacttaggttttcaccaaaaaatagttctcagaatttctatgcttaactaggtcagttatagctaaatggaaaatgcaactatgtaaactaagtcattaaccaacaatattgttgggaaacaaattgttctcaacaataatggaaaatatactgtgcaattaaaaatatattgtacacacttatatatatttttaaagtcatagctattcctattaaccaagtaaaagtgacttcattcagtctgcaaactttcatcttacctcctttgcagatgctagggtaaaaacaatcaggaaacacgattccagcctgatacgcatcctggtgttctagtaacagctgcagagcaagaaaatacagagattaaggggcaggagtcaacagcctggggagtataggccccaccaattttctgtgatgagatgctagaaatatgggggtatagatggaatgaaagggaaaaaggaaggaaagcaggca

SEQ ID NO: 22360 - DNA, 601 bp, Human
tctttgactgttaagctgcttttcatgtttctttcctctttctttaactcttacaaataatagtatctgcgatttgcataacacttgacaaaatactgtgcattaatgccaaggacaatccagtctaggcagggcaggcaggacaatccagtctttgccaagacatgaaaattgagattctgtggataagtgacttttttaagatcacatgctaatatagaaggaacacaaactcagaccttttgatctcttgcaaaatgtcttctatcatgccacttaggttttcaccaaaaaatagttytcagaatttctatgcttaactaggtcagttatagctaaatggaaaatgcaactatgtaaactaagtcattaaccaacaatattgttgggaaacaaattgttctcaacaataatggaaaatatactgtgcaattaaaaatatattgtacacacatatatatatttttaaagtcatagctattcctattaaccaagtaaaagtgacttcattcagtctgcaaactttcatcttacctcctttgcagatgctagggtaaaaacaatcaggaaacacgattccagcctgatacgcatcctggtg

SEQ ID NO: 22361 - DNA, 601 bp, Human
tcaggtttacttctccaaaataaatctgtctttgactgttaagctgcttttcatgtttctttcctctttctttaactcttacaaataatagtatctgcgatttgcataacacttgacaaaatactgtgcattaatgccaaggacaatccagtctaggcagggcaggcaggacaatccagtctttgccaagacatgaaaattgagattctgtggataagtgacttttttaagatcacatgctaatatagaaggaacacaaactcagaccttttgatctcttgcaaaatgtcttctatcatgycacttaggttttcaccaaaaaatagttctcagaatttctatgcttaactaggtcagttatagctaaatggaaaatgcaactatgtaaactaagtcattaaccaacaatattgttgggaaacaaattgttctcaacaataatggaaaatatactgtgcaattaaaaatatattgtacacacatatatatatttttaaagtcatagctattcctattaaccaagtaaaagtgacttcattcagtctgcaaactttcatcttacctcctttgcagatgctagggtaaaaacaatcaggaaaca

SEQ ID NO: 22362 - DNA, 601 bp, Human
aataaatactctcagtctgtaagagagagagtgttcctgaccgaaatcggccagaagcccctctcaggtttacttctccaaaataaatctgtctttgactgttaagctgcttttcatgtttctttcctctttctttaactcttacaaataatagtatctgcgatttgcataacacttgacaaaatactgtgcattaatgccaaggacaatccagtctaggcagggcaggcaggacaatccagtctttgccaagacatgaaaattgagattctgtggataagtgacttttttaagatcacaygctaatatagaaggaacacaaactcagaccttttgatctcttgcaaaatgtcttctatcatgccacttaggttttcaccaaaaaatagttctcagaatttctatgcttaactaggtcagttatagctaaatggaaaatgcaactatgtaaactaagtcattaaccaacaatattgttgggaaacaaattgttctcaacaataatggaaaatatactgtgcaattaaaaatatattgtacacacatatatatatttttaaagtcatagctattcctattaaccaagtaaaagtgacttcat

SEQ ID NO: 22363 - DNA, 601 bp, Human
cagagacgtgcaagccccaagataacctcccctccagccagagagatgtcaaccccaagataacctcccctccaactagagacattccaatcccaccataaacttctcccccacacagaaacattccaaactctctcaccaataaatactctcagtctgtaagagagagagtgttcctgaccgaaatcggccagaagcccctctcaggtttacttctccaaaataaatctgtctttgactgttaagctgcttttcatgtttctttcctctttctttaactcttacaaataatagtatctgmgatttgcataacacttgacaaaatactgtgcattaatgccaaggacaatccagtctaggcagggcaggcaggacaatccagtctttgccaagacatgaaaattgagattctgtggataagtgacttttttaagatcacatgctaatatagaaggaacacaaactcagaccttttgatctcttgcaaaatgtcttctatcatgccacttaggttttcaccaaaaaatagttctcagaatttctatgcttaactaggtcagttatagctaaatggaaaatgcaactatgtaaactaagtcat

SEQ ID NO: 22364 - DNA, 601 bp, Human
ttcaccttgaccaaaaattgcctaaatccaaagggcatcagcctaatgggtacagtcagcataaccataaatcacagataacatctccaatcagaaacattccaaacccctccccaaccagagacgtgcaagccccaagataacctcccctccagccagagagatgtcaaccccaagataacctcccctccaactagagacattccaatcccaccataaacttctcccccacacagaaacattccaaactctctcaccaataaatactctcagtctgtaagagagagagtgttcctgaccraaatcggccagaagcccctctcaggtttacttctccaaaataaatctgtctttgactgttaagctgcttttcatgtttctttcctctttctttaactcttacaaataatagtatctgcgatttgcataacacttgacaaaatactgtgcattaatgccaaggacaatccagtctaggcagggcaggcaggacaatccagtctttgccaagacatgaaaattgagattctgtggataagtgacttttttaagatcacatgctaatatagaaggaacacaaactcagaccttttgatctctt

SEQ ID NO: 22365 - DNA, 601 bp, Human
ataatgacagagcagaagcattgccatcttggacaagaactgccattttaagttcaccttgaccaaaaattgcctaaatccaaagggcatcagcctaatgggtacagtcagcataaccataaatcacagataacatctccaatcagaaacattccaaacccctccccaaccagagacgtgcaagccccaagataacctcccctccagccagagagatgtcaaccccaagataacctcccctccaactagagacattccaatcccaccataaacttctcccccacacagaaacattccaaaytctctcaccaataaatactctcagtctgtaagagagagagtgttcctgaccgaaatcggccagaagcccctctcaggtttacttctccaaaataaatctgtctttgactgttaagctgcttttcatgtttctttcctctttctttaactcttacaaataatagtatctgcgatttgcataacacttgacaaaatactgtgcattaatgccaaggacaatccagtctaggcagggcaggcaggacaatccagtctttgccaagacatgaaaattgagattctgtggataagtgactttttt

SEQ ID NO: 22366 - DNA, 601 bp, Human
atcttttgcaattcctcgcctcctgtccatatctttgaaaatggtgcccttactaagctcctctccaattactcagtttgagtgtgacttctgggtcctgctggggctctgactgatacgactcatgagacaagtttactgataatgacagagcagaagcattgccatcttggacaagaactgccattttaagttcaccttgaccaaaaattgcctaaatccaaagggcatcagcctaatgggtacagtcagcataaccataaatcacagataacatctccaatcagaaacattccaaacycctccccaaccagagacgtgcaagccccaagataacctcccctccagccagagagatgtcaaccccaagataacctcccctccaactagagacattccaatcccaccataaacttctcccccacacagaaacattccaaactctctcaccaataaatactctcagtctgtaagagagagagtgttcctgaccgaaatcggccagaagcccctctcaggtttacttctccaaaataaatctgtctttgactgttaagctgcttttcatgtttctttcctctttctttaactcttacaaata

SEQ ID NO: 22367 - DNA, 601 bp, Human
aaaaaacctaagtggaataagtggaatttgtatgcaaattccctgtaactagtcatataccagtcccaatcttttcatcacacaagactatttattgctgcagaaaaaactggaaaatgctaggtaaatactttacattccttttccactctcctcagaaccttgattagtgtgggttttgtctgtctctaaaaatggcgtacattaagcaatgttgctcaaattgaatggacaaaaatatcctttcttctttcttttttgtagaagctatcaagggacagtagagctcccatgaatacastttgggaagtgctaaattagaaataataggttagaaaggagaactataacatgcaggcaaaataataggattgagaaatgatagttaacagactaagagggaaacagaacaaaactccttataaatatgagaaatacaaaagctagctgcctgggattctaactgcaggagtgattagccccagatagttcatttcagtcccaaagacatcactgaattaaaggaatgggataatagcagatgacccaaaaccccagaagcagtttatacaagtacccagcgtgctgggggcctccattt

SEQ ID NO: 22368 - DNA, 601 bp, Human
tgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaaggaaaactacagttgaattaggtatgtatgagacaaggtaaaatgtggaaaaatgcaaaaaaacctaagtggaataagtggaatttgtatgcaaattccctgtaactagtcatataccagtcccaatcttttcatcacacaagastatttattgctgcagaaaaaactggaaaatgctaggtaaatactttacattccttttccactctcctcagaaccttgattagtgtgggttttgtctgtctctaaaaatggcgtacattaagcaatgttgctcaaattgaatggacaaaaatatcctttcttctttcttttttgtagaagctatcaagggacagtagagctcccatgaatacagtttgggaagtgctaaattagaaataataggttagaaaggagaactataacatgcaggcaaaataataggattgagaaatgatagtta

SEQ ID NO: 22369 - DNA, 601 bp, Human
ctatagtctcagctactcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaaggaaaactacagttgaattaggtatgtatgagacaaggtaaaatgtggaaaaatgcawaaaaacctaagtggaataagtggaatttgtatgcaaattccctgtaactagtcatataccagtcccaatcttttcatcacacaagactatttattgctgcagaaaaaactggaaaatgctaggtaaatactttacattccttttccactctcctcagaaccttgattagtgtgggttttgtctgtctctaaaaatggcgtacattaagcaatgttgctcaaattgaatggacaaaaatatcctttcttctttcttttttgtagaagctatcaagggacagtagagctcccatgaatacag

SEQ ID NO: 22370 - DNA, 601 bp, Human
gcctataatcccagcactttgggaggctgaagtgggaggaccccctgaggccaggaggttgagactagcctgggcaacatagcaagaccacatctctacaaaaatttaaaaataaaataaaaaagtagccaggtatggtggtacacacctatagtctcagctactcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaaggaaaactacagttgaattaggtatgtatgagacaaggtaaaatgtggaaaaatgcaaaaaaacctaagtggaataagtggaatttgtatgcaaattccctgtaactagtcatataccagtcccaatcttttcatcacacaagactatttattgctgcagaaaaaactggaaaatgctaggtaaatactttacattccttttccactctc

SEQ ID NO: 22371 - DNA, 601 bp, Human
atagctcacaaagggtcaatcagacccacttctaatcctgtttaaaccagatgtccttgttactgtaattataaaggctaattcagtattaggtaaactaatacaaatgaagagttttgctgggtgcagtagtgcacgcctataatcccagcactttgggaggctgaagtgggaggaccccctgaggccaggaggttgagactagcctgggcaacatagcaagaccacatctctacaaaaatttaaaaataaaataaaaaagtagccaggtatggtggtacacacctatagtctcagctaytcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaaggaaaactacagttgaattaggtatgtatgagacaaggtaaaatgtggaaaaatgcaaaaaaacctaagtgga

SEQ ID NO: 22372 - DNA, 601 bp, Human
agacttgaacttacctgtctataccatagctcacaaagggtcaatcagacccacttctaatcctgtttaaaccagatgtccttgttactgtaattataaaggctaattcagtattaggtaaactaatacaaatgaagagttttgctgggtgcagtagtgcacgcctataatcccagcactttgggaggctgaagtgggaggaccccctgaggccaggaggttgagactagcctgggcaacatagcaagaccacatctctacaaaaatttaaaaataaaataaaaaagtagccaggtatggkggtacacacctatagtctcagctactcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaaggaaaactacagttgaattaggtatgtatgagacaaggtaaaatgtgg

SEQ ID NO: 22373 - DNA, 601 bp, Human
tcccccaggacatactagatgctgacagctggcaagccactgcccagagacttgaacttacctgtctataccatagctcacaaagggtcaatcagacccacttctaatcctgtttaaaccagatgtccttgttactgtaattataaaggctaattcagtattaggtaaactaatacaaatgaagagttttgctgggtgcagtagtgcacgcctataatcccagcactttgggaggctgaagtgggaggaccccctgaggccaggaggttgagactagcctgggcaacatagcaagaccacrtctctacaaaaatttaaaaataaaataaaaaagtagccaggtatggtggtacacacctatagtctcagctactcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagatgcaatgaaagtgaatcatcaccaaataagaaaag

SEQ ID NO: 22374 - DNA, 601 bp, Human
ccctctgtaaatccaacagactggaagcagaaagtcccccaggacatactagatgctgacagctggcaagccactgcccagagacttgaacttacctgtctataccatagctcacaaagggtcaatcagacccacttctaatcctgtttaaaccagatgtccttgttactgtaattataaaggctaattcagtattaggtaaactaatacaaatgaagagttttgctgggtgcagtagtgcacgcctataatcccagcactttgggaggctgaagtgggaggaccccctgaggccaggagkttgagactagcctgggcaacatagcaagaccacatctctacaaaaatttaaaaataaaataaaaaagtagccaggtatggtggtacacacctatagtctcagctactcagaaggctgaggcaggagggttgcttgaggccaggagtttgaggctgtaatgagctgtgattgcaccactgcaccccagcctgggcaacagagcaagaccctgtctctaaaaaatgtaaaaataactttaaaaaaaaggtgttttttctttggcaattaagtatctaagaaagctaagtgctttggaaagat

SEQ ID NO: 22375 - DNA, 601 bp, Human
gaaacaagttgtactttggttttgtttatttgttgggattttaaaaagtatcttccttgtccctcacagtcagcctccttaagagtacaagaaataaaagcagatatttcatatgctttcaagcatttgattttataataattattgcaaaatggcacaggccccagtgagcattttatgcaagtgtcgtttgagtgggccagtgcgtgtcccatgtagctctttattcccacaagaggggtaggaaagacagaactggcctctgtgctaaacctccaagagccacaaatgcctcatggartgccaaatgttacgagggtaactaaaagcaaaactgccgagttcagatccctcagttcaatttttctatgccgttcctaaagtaaaaattgccgaaccagttttaaatcattggttttttttcaaaatgattttcaaaggagttagaatcaagacatttgatttgctcccacagttttcctagagataaagctttaaacaattcttgttctccagaatacagtaaaactccagaattaaatatggcagtagctcttttgaacaacttcaacttaaacaaattggcagattaactgaagct

SEQ ID NO: 22376 - DNA, 601 bp, Human
gaggaccacgcctaccttctcccagggaaggggatagttctctcggatataatgaacgcttgcattaagaaacggagtccagtgagtgctctcagacacatcatggaattttcctgacaaaacaaaagcagggctctagattctctcttaaaagttggaaagtctcaatcaaatcttccacaccacccgctgcgctgctgtgtcccttctcctccttccctccatgcccctcagtttcttctgtcgactttcaaaagaagcctctaaaacggaagagccagctgagattttggaatacgcrtggtactgtctgcctgatgactaaaaagagccctacagtaagagggacggagcctaaactggctcacggaatcgcaagcccggctacctggttagaatagaggctagaattgtttccatttctgtgccctaaaactaaggaaacaagttgtactttggttttgtttatttgttgggattttaaaaagtatcttccttgtccctcacagtcagcctccttaagagtacaagaaataaaagcagatatttcatatgctttcaagcatttgattttataataattattgcaaaatggcacagg

SEQ ID NO: 22377 - DNA, 601 bp, Human
ctagccatctactatgtccaagcaatgtgcatgacactgaaggtggaatggtgggcagcccttacagagcggtacaaatggggtcaatgcgggtgcaaacacagtgcatggcaggtttggtgctaaatattttaaggattggaggaccacgcctaccttctcccagggaaggggatagttctctcggatataatgaacgcttgcattaagaaacggagtccagtgagtgctctcagacacatcatggaattttcctgacaaaacaaaagcagggctctagattctctcttaaaagttggaragtctcaatcaaatcttccacaccacccgctgcgctgctgtgtcccttctcctccttccctccatgcccctcagtttcttctgtcgactttcaaaagaagcctctaaaacggaagagccagctgagattttggaatacgcatggtactgtctgcctgatgactaaaaagagccctacagtaagagggacggagcctaaactggctcacggaatcgcaagcccggctacctggttagaatagaggctagaattgtttccatttctgtgccctaaaactaaggaaacaagttgtactttggt

SEQ ID NO: 22378 - DNA, 601 bp, Human
tagttattaaaaaccacataagaggccaggtgcagtggctcttgcctgtaatcccagctactcaggaggctgagacacaagaattgcttgaacctgggaggcggaggttgcagtgagctgaaattgcaccactgcactccagcctgggcgacagagcaagactctgtctcaaaaaaaaaaaaaccacacacaggccgggcgcagtggctcacccctgtaatcccagcactttgggaggcctatgcaggtggatcacgaggtcaggaaatcgagaccatcctggctaacatggtgaaacccygtctctactaaaaatacaaaaaaaaaaaaaaaaaaattagccgggcgtggtggcgggcgcctgtagtcccagttacttgggaggctgaggcaggagaatggcatgaacccgggaggtggagcttgcagtgagctaagatcgcgccactgcactccagcctgggtgacagagcgacactctgtctgaaaaacacaaaaacagaaacaaaaccacacacacacacacaaaaccataaggacttttggaaacgttttacgatgtgttggaagtgctttcagattaattactattggagcaaaa

SEQ ID NO: 22379 - DNA, 601 bp, Human
tgattttataataacaatcctattaaaagttttaataaatataaattcatttatgttactgagacctaacaaaaaatttcaggcaagtaaattgcagtttctagttattaaaaaccacataagaggccaggtgcagtggctcttgcctgtaatcccagctactcaggaggctgagacacaagaattgcttgaacctgggaggcggaggttgcagtgagctgaaattgcaccactgcactccagcctgggcgacagagcaagactctgtctcaaaaaaaaaaaaaccacacacaggccgggygcagtggctcacccctgtaatcccagcactttgggaggcctatgcaggtggatcacgaggtcaggaaatcgagaccatcctggctaacatggtgaaaccctgtctctactaaaaatacaaaaaaaaaaaaaaaaaaattagccgggcgtggtggcgggcgcctgtagtcccagttacttgggaggctgaggcaggagaatggcatgaacccgggaggtggagcttgcagtgagctaagatcgcgccactgcactccagcctgggtgacagagcgacactctgtctgaaaaacacaaaaac

SEQ ID NO: 22380 - DNA, 601 bp, Human
gtcatgtgtgtttgggtgattttataataacaatcctattaaaagttttaataaatataaattcatttatgttactgagacctaacaaaaaatttcaggcaagtaaattgcagtttctagttattaaaaaccacataagaggccaggtgcagtggctcttgcctgtaatcccagctactcaggaggctgagacacaagaattgcttgaacctgggaggcggaggttgcagtgagctgaaattgcaccactgcactccagcctgggcgacagagcaagactctgtctcaaaaaaaaaaaaamcacacacaggccgggcgcagtggctcacccctgtaatcccagcactttgggaggcctatgcaggtggatcacgaggtcaggaaatcgagaccatcctggctaacatggtgaaaccctgtctctactaaaaatacaaaaaaaaaaaaaaaaaaattagccgggcgtggtggcgggcgcctgtagtcccagttacttgggaggctgaggcaggagaatggcatgaacccgggaggtggagcttgcagtgagctaagatcgcgccactgcactccagcctgggtgacagagcgacactctgtc

SEQ ID NO: 22381 - DNA, 601 bp, Human
caagcaaattagagtcatgtgtgtttgggtgattttataataacaatcctattaaaagttttaataaatataaattcatttatgttactgagacctaacaaaaaatttcaggcaagtaaattgcagtttctagttattaaaaaccacataagaggccaggtgcagtggctcttgcctgtaatcccagctactcaggaggctgagacacaagaattgcttgaacctgggaggcggaggttgcagtgagctgaaattgcaccactgcactccagcctgggcgacagagcaagactctgtctcaaaaaaaaaaaaaccacacacaggccgggcgcagtggctcacccctgtaatcccagcactttgggaggcctatgcaggtggatcacgaggtcaggaaatcgagaccatcctggctaacatggtgaaaccctgtctctactaaaaatacaaaaaaaaaaaaaaaaaaattagccgggcgtggtggcgggcgcctgtagtcccagttacttgggaggctgaggcaggagaatggcatgaacccgggaggtggagcttgcagtgagctaagatcgcgccactgcactccagcctgggtgacaga

SEQ ID NO: 22382 - DNA, 601 bp, Human
ccaaacaagcaaattagagtcatgtgtgtttgggtgattttataataacaatcctattaaaagttttaataaatataaattcatttatgttactgagacctaacaaaaaatttcaggcaagtaaattgcagtttctagttattaaaaaccacataagaggccaggtgcagtggctcttgcctgtaatcccagctactcaggaggctgagacacaagaattgcttgaacctgggaggcggaggttgcagtgagctgaaattgcaccactgcactccagcctgggcgacagagcaagactctrtctcaaaaaaaaaaaaaccacacacaggccgggcgcagtggctcacccctgtaatcccagcactttgggaggcctatgcaggtggatcacgaggtcaggaaatcgagaccatcctggctaacatggtgaaaccctgtctctactaaaaatacaaaaaaaaaaaaaaaaaaattagccgggcgtggtggcgggcgcctgtagtcccagttacttgggaggctgaggcaggagaatggcatgaacccgggaggtggagcttgcagtgagctaagatcgcgccactgcactccagcctgggtg

SEQ ID NO: 22383 - DNA, 601 bp, Human
tctactaaaaatataaaaattagctaagcatggtggcacgtgcctgtaatcccagctactcaggaggctgaggcaggagaatcacttgaaccagggagttggaggttgcagtgagccaagatcgcgccttcgcaccactgcattccagcctggcaacagagtgagactccatctcaaaaaaaaaaaaaaaaggaacaaattggaaaagatgggactctaaccaaacactgctttgggcagaagtctgaataacctaacattttcctttcttttaaaacggtcaggttttgatcttaggtgwgacagtatcactcccataaagtcattccccataaagggatgtactcacagctcccatggtcctaaggaatccttgttcaaggcccagactatgccagctgacatctgccgccatgtgagaagtaattccaaacaagaaagctaccagtttctctgtgtcctgccaaacaagcaaattagagtcatgtgtgtttgggtgattttataataacaatcctattaaaagttttaataaatataaattcatttatgttactgagacctaacaaaaaatttcaggcaagtaaattgcagtttctag

SEQ ID NO: 22384 - DNA, 601 bp, Human
ctcaaaaacaaacaaacaaaaaaacaacaacaaaaaaaaccacacccacatacacacacacacacacacacacacacatatatatgcagctgagttggatacatatgtctggcaataaagctactacagacaactctgccttataggatatatataaaaatctctgagttgaagttgaaacttctaacagaatgtaattaacataaattaaggaccagggggccttccagaggctaagtcatcaggtaagatcacaattttcagtttgaggacatggcattttcatatagaaagttaaaargagagagaaaaagtccaataaagtagaagtattacttttaaatagaaccaagtggcaggtattcatatccttcttaagatatacagcttgaataaagcataagatttatcaattatttttgtgactaaaacaaaacatcacatctatgactgttttcagtacacattagccactctgctcttgtggatgaatctacccagttggcaagaagaataaaaggaatgaattggaccgggcgcggtggcttatgcctgttatcccagcactttgggagaccaaggcaggcagatcatgaggtca

SEQ ID NO: 22385 - DNA, 601 bp, Human
tgcaacattaaatagaaaatacatgcaaccagcaaaatattaaagacacacatatttaaagcacagtagtgatgtcattataagtgaactataccacgagaaaatttagcaaatgtaaataaacagtaccaaaatcaccagccgaatgagcctctgaataggagccgtgaaaatcaatctaagaaagaaagagaaccatctggtgtgtattacaaattgtagccccaactcttacttccacagtcaagcaagtggtgggagatgacagctaactcaatgaactgctgaggacgcataatasactcaattttcacactaacattttattagtaaaaaaataataataataaaaaggcagggcgcggtagctcacgcctgtaatcccagcactttgggaggttgaggcgggtggatcacctgaggtcaggagttcaagaccagcctggccaacatagtgaaaccccatctctactaaaaatacaaaaaattggccgggcatggtggcgggttctggtaatcccagctacttgggaggctgaggcaggagaatcacttgcacctgggaggcagaggttgcagtgagccgagattgcaccactga

SEQ ID NO: 22386 - DNA, 601 bp, Human
ctcctagggtatgagaaaaatattgacatttggtggattagtgacaaacatagcatgcatctattcaacatgaggtctgacaagttggattattagtttttcacattattacatgtttttgttcattgttttaggtaaaggcatgcctttttttttttttagacggagttttgctcttattgcccaggctggagtgcaatggcgtgatctcggctcactgaaacctccgcctcctgggttcaagcaattctcctgcctcagcctccctcgtagctgggattacaggcatgcgccaccacgsccagctaatttttgtatttttagtagaggtggggtttcaccatgttggccaggctggtcttgaactcctgacctcaggtgatccacctgccttggcctcccaaagtgctgggattacaggtgtgagccaccacgccaggccgccttttttttttttttttttttaagaaaaaattatcttttaaaaatcttagttagtgaaacatataaattaagaaagaactggccatataaccaaaggtgttttttgttttactttaaggaaatatcgaccataagggtttaataaacaccattcacc

SEQ ID NO: 22387 - DNA, 601 bp, Human
tttcttaaataagacatcagaagtacacattacaaaggaaaaactgatctattcaactacatgaatattaacaaatcctgtttgtcaagatacacaataagtgaaaggacataccacaaactgtgaaagacatttgtaataactaagtgacaaactgacaagagagtagaagccagaatatataaatactcacaaataaataaaaaggataaacaacccaacagaaaaatagactgaaaactggaaaaagttttcacttaaaatcaaacacaaatgatccataaaatagaagaaaagtgtracctcattagcaatctgggaaattcaaactgcaacctcaatgagataccattacacacaaacaggctggaaattttaacagttggacaataccaagtattggagaatgcagaagaaccagaatgattatacaaagctaatgggagcataagttaagatgatcattttgaaaaagtaaactatgactcagcaactccactccattcaaaattgagtggaattcaatttctcaaagaatctaaactatgctaatatgcaattttacttttcaaaatttaccagtgcagaagacttctaatta

SEQ ID NO: 22388 - DNA, 601 bp, Human
ctcctgtgctcaagtgatcctcccacctcagcctcctgagtagctgggactacagatgctgtgccaccacacctagctaagaacggatttcttaaataagacatcagaagtacacattacaaaggaaaaactgatctattcaactacatgaatattaacaaatcctgtttgtcaagatacacaataagtgaaaggacataccacaaactgtgaaagacatttgtaataactaagtgacaaactgacaagagagtagaagccagaatatataaatactcacaaataaataaaaaggataaayaacccaacagaaaaatagactgaaaactggaaaaagttttcacttaaaatcaaacacaaatgatccataaaatagaagaaaagtgtaacctcattagcaatctgggaaattcaaactgcaacctcaatgagataccattacacacaaacaggctggaaattttaacagttggacaataccaagtattggagaatgcagaagaaccagaatgattatacaaagctaatgggagcataagttaagatgatcattttgaaaaagtaaactatgactcagcaactccactccattcaaaattga

SEQ ID NO: 22389 - DNA, 601 bp, Human
ctgggattacaggcatgagccaccgtgcctggcctcaatatttcaaaattgttaattttccaattcatctctagattcaataaacacttaatcaaaattccagcaaagtttttcttggaacatgacaacttgagcctaaatcttatttgaaagaacaaaggcaaagaataggcaaggtacttttgaagaaaaagaaggactagttataagatctgccctaacagagcccaagacttattataaagctacagcaattaaaataatcaatattgttcagggaccaaaaggacatatcagaaarcccagaaactgacccatacatatacataacattttaatttataacccaaagggggtgcagtggctcacacctataatcccaacacttgggaggccaaggtgggcggatcacttgagcccaggagttcgagaccagcctgggcaacatggcaagacctcatctcttacaaaacattaaaaaattagccaggtggaggctgaggtgggaggatcatttgggcctggaagttggagtttgcagtgacccaagatcacacaccactgcactccagcccgagccacagagttagactggctcaaa

SEQ ID NO: 22390 - DNA, 601 bp, Human
ggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaaaatcctcagaataaacaagataaaaaatcgcaaccaataaaatctaactttagtaggtttcttttagtaggtaaaagaaagaaacaattgagagactcattttttattttataagagcactggaatggcattcccaataaaaatagcttaaaaagtcagacaaaataacaaaaaatatttttttaaatgaatcaccaagctagcaggacagcagaaatttttcaaaggccaaaaacaactagaaacaaaaaaaccctgggaggtaagcaaatgggacaaccagcttttgccc

SEQ ID NO: 22391 - DNA, 601 bp, Human
tccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgaygagttagtgggtgcagcgcaccagcatggcacatgtatacatatgtaactaacctgcacaatgtgcacatgtaccctaaaacttaaagtataataaaaaaaaaaatcctcagaataaacaagataaaaaatcgcaaccaataaaatctaactttagtaggtttcttttagtaggtaaaagaaagaaacaattgagagactcattttttattttataagagcactggaatggcattcccaataaaaatagcttaaaaagtcagacaaaataacaaaaaatatttttttaaatgaatcacca

SEQ ID NO: 22392 - DNA, 601 bp, Human
atcatccctctgctcacctgagacaaatgtatatctgattgcttcctttgcctaattgtttcactaaaccagactacagcataagtgacactattactgtaaactgcattttcagtgaaaggctaattggaaattcggaaggatgtctcatagctacctatgacctggaagcctcctcctcgcttcgagttgtcccatctttctggactgaaccaatggacattttacttatttttttatttttattttttttttgagatggagtctcactctgtcacccaggctggagtgcagtggtgcratatcggttcaccgcaacctccgccttccaagttcaagcaattctcctgcctcagcctcccaagcagctgagactacaggcgtgcgccaccatgcctggccaaaacaactgacctgtaaggggactgaacctgcgaccctggtgtcattagcaccacaactgagctaactggccaatagccatttcgcatttattgattgatgtcccaagtctccctaaaatgtacagataaccaagatgtgctccaacagccttgggcacatgttgtcatccggacctcctgaggctgtatcatgggtg

SEQ ID NO: 22393 - DNA, 601 bp, Human
ctagttatttaatcctagcaatgacctcaggtggttagtactatcatattcccgttttacataagaagaaatgattaaggcacagaaaagttaaataattggcccaatgatgcagagcaaacaactggtaacttaaatcaaatatttatgtaggtatactcagattggaaactaactataacgtacaaaaagagtggttaattttgtgaattcagagttcaagaagtaatttaaagtattttcattgtttcaagttgaattgaaaagaattattttaaaaacactattataaaaatgtctyctcaccctgacatcttaatttcagagtatataaagtatacaaaaaagtataccaaagtataaaagtattgtaaaggaaaataaatctcagaaccccaaaatcactaaactaaagggaaaagtcaagctgggaaccgtgtagggcaaacctgcctcccaatctatttctgtgtggtttctgtgtggttgtttttgttttctgttttttgttttttttttggagacggagcttcgctcttgttgcccaggctggagtgcaatggtgcaatctccgttcaccgcaacctccgcctcccgggtt

SEQ ID NO: 22394 - DNA, 601 bp, Human
aaaactgtgcaaaggaagtcacaacaaaatcagctgcaaattgtcctctgagttacgcttacatttctaagaactggatatgtgaacaatcaacgattacattttcggtgatgacttttcgaccatacagtttctcataaattcccagtagatctttgactggcacatacctgaaaaatgcagaataaagtaagagttgttttgattctgaagctgaaaatagtaacaacagcagcagcagctaccagttattccgtgattattttgtgccaggcaccatgtaaaagtctttacatgcacyagttatttaatcctagcaatgacctcaggtggttagtactatcatattcccgttttacataagaagaaatgattaaggcacagaaaagttaaataattggcccaatgatgcagagcaaacaactggtaacttaaatcaaatatttatgtaggtatactcagattggaaactaactataacgtacaaaaagagtggttaattttgtgaattcagagttcaagaagtaatttaaagtattttcattgtttcaagttgaattgaaaagaattattttaaaaacactattataaaaatgtctcc

SEQ ID NO: 22395 - DNA, 601 bp, Human
aaaaataaaatgaatatggtactattcctggtatctttataatcctttaagatttggaagaatgacgcctttaccttggaaacagctagcatctcaccatacctgcaaaataaacaataattttggctgtgagttgcagtttgtaacagagaaatgaagcaaataatgaagaaaaagttccatccacccttttccaccgtcatgcaactgcctttgaataagcagaatccataaatccaaaatccagtctcaggaaacaaaaacataaaaactgtgcaaaggaagtcacaacaaaatcagytgcaaattgtcctctgagttacgcttacatttctaagaactggatatgtgaacaatcaacgattacattttcggtgatgacttttcgaccatacagtttctcataaattcccagtagatctttgactggcacatacctgaaaaatgcagaataaagtaagagttgttttgattctgaagctgaaaatagtaacaacagcagcagcagctaccagttattccgtgattattttgtgccaggcaccatgtaaaagtctttacatgcactagttatttaatcctagcaatgacctcaggtggt

SEQ ID NO: 22396 - DNA, 601 bp, Human
aaaaattagccagggatggtggtgcacacctgtagtcccagctgattgggaggctgaggcacgagactcccttgaacccaggaggcagaggttgcagtgaagccgagatcgtgccactgtactccagcctgagcaacagagcaagactctgtctcaaaataaaaagaaagaaacaaatggagcaccacctgtggaggctgattcctgcctggctgagccatttctcacagaccccaaatattgcaataactgtctctctatttctaaaacacgagcagcatcaaccaagccaactggatgrgaaccagtcaagtttataagatcactgagtttccattctttccctctttgaataggttagaaaagcacttcatgagattgttttgttttgtttttatgtgatcagttgaaaaacctgagagttatgttgggggatggggtaaaaaggcagagagtgattggtaatagaaatgcaatatgaattcacctggtcccattctccaacatgaagcttgttagatggtaaatattagtggaccaaaatgccatatcatccagtcctccaagaaaatactcttggaattgttccaccaaaaacggg

SEQ ID NO: 22397 - DNA, 601 bp, Human
ccaaaaaatgttttccagtttggattatataaaacaagtaagtgcaggtcaatcactcaaacatgcccttatgttatgagtccttccaatacaaactttgcttccttctaataataatagtaaccaatacttagtaagtgcttactctattctaaaccctttacatgactgatctaatttactcctcacaaaaatcctatggtaaaaatagtattgctgtcccaattttataggtgaggaaataagattttggaaggtttagcaacttgttccagataactcagtagtgagtggcagatcycttaaattctgtacaaccacggcagtatgcacctaaaaacccaggtccacgggagagcttggggattttagttgaggtttatttcactattaaaagtggcattcatatgagattgctatccctgccaaattgttactcaccgattgttaaaaacaagtttattatgtaccaagctaaggtcgaatttgtcatcaaagggaattttgtttcaaatcaacacaatatataattatggttaacactgtttgggtactagcaaatgtttataagggtaaaggaatatcacccagtataatattc

SEQ ID NO: 22398 - DNA, 601 bp, Human
cgaaagaataaggtccagctatctttccttagctatttggagaaccaaaccaaaattgaacaccaaaaaatgttttccagtttggattatataaaacaagtaagtgcaggtcaatcactcaaacatgcccttatgttatgagtccttccaatacaaactttgcttccttctaataataatagtaaccaatacttagtaagtgcttactctattctaaaccctttacatgactgatctaatttactcctcacaaaaatcctatggtaaaaatagtattgctgtcccaattttataggtgagkaaataagattttggaaggtttagcaacttgttccagataactcagtagtgagtggcagatcccttaaattctgtacaaccacggcagtatgcacctaaaaacccaggtccacgggagagcttggggattttagttgaggtttatttcactattaaaagtggcattcatatgagattgctatccctgccaaattgttactcaccgattgttaaaaacaagtttattatgtaccaagctaaggtcgaatttgtcatcaaagggaattttgtttcaaatcaacacaatatataattatggtta

SEQ ID NO: 22399 - DNA, 601 bp, Human
ctatactttcaaatagagtttgaggtgagtagagttcttggcaatgtaactaccactacttcattgcttttttaaggaaaatataccaaataacataagtgagctttggaagataacctgtgttagtaagctgggaaatgcctgttactatgaacatatttatgttttcctttctgttatgaatttttttgtgttgtctctttttggagacttctctgaatttcccatacattttcataaattctgatgaatctttctttgtatatgtatgcaaacaagcaatcaactcatggaattttayaccttggtaaattgggacagggatcaagagacaagaaatatgttctttctcaattatcttttcctaacgaaagaataaggtccagctatctttccttagctatttggagaaccaaaccaaaattgaacaccaaaaaatgttttccagtttggattatataaaacaagtaagtgcaggtcaatcactcaaacatgcccttatgttatgagtccttccaatacaaactttgcttccttctaataataatagtaaccaatacttagtaagtgcttactctattctaaaccctttacatgactg

SEQ ID NO: 22400 - DNA, 601 bp, Human
tgtgctttttccattttgcaaaaggaggaagctatagctccaaaaatcaagcagcttgtttaaaaatcacacagctgcaagtgacaaatctggaatttgaacctacagctgtctctcaacagatcccgtgttctcaacctctatagggcatctcctccaggtgagatgtactttttctatgaacaattttggaatccacttacccctgggtgtggttttgctggccgccacatgcaatgaacagagggttctcaggcaggttgcagtcactgaggaaacagtcaaatgagttagccatttrtctacttcttcacaagcatgaattttaccgagaatcggtagtgcgcttcaatcatctcccaaaggcttaaagtgtttattacctagccatacaggactaattaagagcccatgttctcccagagagggtgggtaggctgacggttgtcactatcatggtaatccaggaaggctcatgctgccagtcaccccagactcagccttcctcttccctccccgctccacctgctgagctgttccacgctaacacgaaacgtctcagaatttgagagtgttatcaacactggttaccaattatgtc

SEQ ID NO: 22401 - DNA, 601 bp, Human
tttttttgagacaggatctcactctgttgcctagactggagtgtactggcctgatctcagctcactgcagcctcgaactcctaggctcaagcaatcctcccgcctcagcctcccaagtagctgggactacaggcacacaccaccatacctggctaattttgttcattttttgtagatataggggtctcactatgttgctgaggctggtcctgaactcctggacttaagggatcctcctgcctcagcctcccagagtgctaggattacacgtatgagccactgtgcccagccactaactacygtttaatgagcaactcaacatgtgctaattgctttacatccaccactgcatgtcatccacaccataattctgggagtgttgatgtgctttttccattttgcaaaaggaggaagctatagctccaaaaatcaagcagcttgtttaaaaatcacacagctgcaagtgacaaatctggaatttgaacctacagctgtctctcaacagatcccgtgttctcaacctctatagggcatctcctccaggtgagatgtactttttctatgaacaattttggaatccacttacccctgggtgtggttt

SEQ ID NO: 22402 - DNA, 601 bp, Human
atgtgattaaacaacaacaaagtatgttgaaggaatggtttgctaggaaaaaaagaaaaagaaaaaaaaaagttacccaattcaaatacaacaatgacgacttcactgaacactttctgtgtaattttcattcttccaaagtgctaagatcattcctctcagtacctttatcattgcaatactctacttttgagtatatctcactcttgatcatccttaaatatcccggttaagccatcacttcttcaaggagagctcttttgtgcccagggccaggacgctctgttgcaaatccccagarcaccctgcatttttaattcctgacacttaaatatctgttaagccatcacttcttcaaggagaaccctcctgtgcccaggccaggacgcttgcaaatccccagagcaccttgcattttttcttcctaacacttaacaatgtccacaattacttgtttagtgcccagctacctgccaggccatatacctgagagcaggaactgtttctgtcttgttcacaatgatatctctagtgcctgaaccagttcctggcacgtactgattaataaatgatattttattatttgtgttattttgttcta

SEQ ID NO: 22403 - DNA, 601 bp, Human
agaaaacaaccccccgtaaaactgagttgaagaatatagtcatgttaatcacaggttaaaagaccacaaaattttaacgtcagaaggctgaaggagcaacacagaaagttttagaaaaccttcatttcacaaaatcttttagtaaacacatttctaaggcttaaaagcctatccttataaaacatatttcctataatatcagagctctatggtaggagtaaaaggcttcaattctttccagattatgaaaaaatttagcaacaggtatcagctggtggggaaactgctttgcaagcatacygattttttttttttttttgagacggagtcttgctctgtcacctaggctgcagtgcagtggcacgatctcggctcattgcaaccttcgcctcctgggttcaagcaattctcctgtctcagcctcctgagtagcctggaactacaggcatgcaccaccacacccagctgatttttttgtatttttagtagagatggagtttcactatgttggccaggctgggctcgaactcctgagctcaggtgatccacctgcctcggtctcccaaagtgctggaattacaggtgtgagccatcacgccca

SEQ ID NO: 22404 - DNA, 601 bp, Human
aattctcagagaccccattcacaaagttgtctaaacccttctgacattaagagcccactacaatccaatgcctacttagcttcctaagcctctcacagtaactcatattccttgtcctgtgctccaggcaaatacgactactcagatttcccaacacctgaaactttcccaacccactaacagaaatgtactctcactgatgaaatactatctactgtccaagacctaacttgaatgtcccctcctccaggaagccttctctgtctgatagcctccaaggtgaagcttttctccctgctaytttttttttgttttgttttttgagacagggtgtcactctagcacccaggctggagtgcagtggtgcaacctcagctcactgcaacctctgccttccaggaacaagtagtcctcccacctcagcctcccgaatagctgggactacaagtgcacactaccatgcccagctgattttttgttacttttttgtagagacagggtctcattatgttacccaggctagtctcaaactcctgagctcaagcaatccacctgcctcagccacttaaagtgctgggattacaggcgtgagccaccacgc

SEQ ID NO: 22405 - DNA, 601 bp, Human
gcctataatcctagcactttgggaggtcaaggtgggaggatcacaaggtcaggagttcgagaccagcctggccaatatagtgaaaccccgtctctactaaaaattagctgggagtggtggcgggcacctgtagtcccagctacttgggaggctgaggcaggaaaatcgcttgaacctgggagatggaggttgcagtgagctgagatcgtgccgctgcacgctagcctgggtgacagagcaagactccatctcaaaaaaaaaaaacgatatcctccaaaccacacccaagctgagatgtggytgtatttgctgccaggcaggcacgagaggtcacatgcagaatgctaggagccgtacaccacagaatttgggggacaacaagcccctcagcttgggatgctgaatcgttcttaatgtggttactgcagagacaaaaaacacaaacgagagtggccctgaacaagctggccagatactagatccatccaagttaaggggacacaactctaaatctgcccaagggtgacatgagaccaaacaagatttcctaggtctgctccaaagcagagcacagttggctcagagcatgaaggcagcccag

SEQ ID NO: 22406 - DNA, 601 bp, Human
tctcaacaaaaaatacaaaaaattagccgagtgtggtggagcgtgcctgtaatccctgctacttgggaggctgaaatgggaggatcacctgcatccaagaggttgaggctgcaatgagctgagatctcaccattgcactccagcctgagcaacagaatgagactctgtctcaacaacaagaaaaagaacaagtcctttcaatgcagaactttaattgtatttgtatatgtgtatatatattaacaaacaaataaactggaacaacaggatgccaaagatatcctccagaccggccaggcgyggtggctcacgcctataatcctagcactttgggaggtcaaggtgggaggatcacaaggtcaggagttcgagaccagcctggccaatatagtgaaaccccgtctctactaaaaattagctgggagtggtggcgggcacctgtagtcccagctacttgggaggctgaggcaggaaaatcgcttgaacctgggagatggaggttgcagtgagctgagatcgtgccgctgcacgctagcctgggtgacagagcaagactccatctcaaaaaaaaaaaacgatatcctccaaaccacacccaagc

SEQ ID NO: 22407 - DNA, 601 bp, Human
aggcaggtggatcgcttgagcccaggagtttgagaccagcctgggcaacatagcaagaccccatctctagtacagaaaaaaaaatttttttaatcaaataaattaatgcttttgttgatgatgaattcattgacaagcaaggtgctaacaagcaccatttaaaacagttgcagagggctgggcacagtggctcacacctgcaatcccaggactttgggaggccaaggcgggaagatcacttgagcccagaagttcgagatcagcctggtcaacatggtgaaaccttgtctctactaaaaayataaaaattagccaggcatggtggcgcgcacctgtaaccccagctactgggaagctgaggcagagaatcacttgaacctgggaggcagaggttgcagtgagccaagatcaagccactgtactccagcctgggtgacaagtgagactctgtctcaaaaataaaataaaataaaatgaaataaaaaacagttgcagaatgattgaataaaattaatactgaagaaaacattcacaagttagataaacttatacgtaccagccaagcctcgcataaggaaatgacaagaagtaagatgctaag

SEQ ID NO: 22408 - DNA, 601 bp, Human
tttattgttgtgattatttagtaaaccgaaagttccttgtatttaaacatatttgaccaagtgtaaggagatcatttcattgttacaataacttaaccattaaattaatgcttttggccaggtgcagtggctcatgcttgtaatcccagcactttggggggctgaggcaggtggatcgcttgagcccaggagtttgagaccagcctgggcaacatagcaagaccccatctctagtacagaaaaaaaaatttttttaatcaaataaattaatgcttttgttgatgatgaattcattgacaarcaaggtgctaacaagcaccatttaaaacagttgcagagggctgggcacagtggctcacacctgcaatcccaggactttgggaggccaaggcgggaagatcacttgagcccagaagttcgagatcagcctggtcaacatggtgaaaccttgtctctactaaaaatataaaaattagccaggcatggtggcgcgcacctgtaaccccagctactgggaagctgaggcagagaatcacttgaacctgggaggcagaggttgcagtgagccaagatcaagccactgtactccagcctgggtgac

SEQ ID NO: 22409 - DNA, 601 bp, Human
gctactttggaggctgaggcaggagaatcacttgaacccgggaggcagagaacccagtgagccgaaatcagaacaaacggcagaacaaaggaaaaagtcaagagcagttgtttaaggctgtgatacctggtgggagggacagacactccagtggacccgttgctgttctctgcactttggaggctcaatgctggccagtaatggccctagggatgcccctgtggctggctgtgcttatgtagctgccagcccagcaggaggcctttcggatctttcagggaggtagccatacacacaagtsaacgaccagtaaagacagcattcacctccccatctcctgcactagagctgaatgcacagaagccctgaaaggaaggactgtcaggaaattgtgccaaggaaatgcaatgccctttggaattaaggagtatgatttttttaaaaagccttcatccaaacttccagaaaatagtcacttttatatacttggggttagttttgtatgttgttgttgttttgttttatttttttatttattttgggggcttagttttggttgaattttaaaatcagaggaattcctaacattctctttataaaa

SEQ ID NO: 22410 - DNA, 601 bp, Human
acagccacaaaggcacctggcagtgggccaaatcaagagtcccacatgtttagtagaggctcctagatgagattccaagagccaccagttacagagctggataaaccgagtcaaaggttcaagtgtcactacaggggctggaaagaccaaaagtcatttgtttattctagtgcttatcatcacataaagaacaaatggcaggccgagcatggtggctcacgcctgtaatcccagcactttgggaggccaaggcaggtggatcacctgagatcaggagttcgataccagcctggccaagacrgtgaaatgctgtctctactaaaaatacaaaaattagctgggtatggtggcaggcgcctgtaatcccagctactttggaggctgaggcaggagaatcacttgaacccgggaggcagagaacccagtgagccgaaatcagaacaaacggcagaacaaaggaaaaagtcaagagcagttgtttaaggctgtgatacctggtgggagggacagacactccagtggacccgttgctgttctctgcactttggaggctcaatgctggccagtaatggccctagggatgcccctgtggctggctgtg

SEQ ID NO: 22411 - DNA, 601 bp, Human
aaatagactatgtttttaccacagccacaaaggcacctggcagtgggccaaatcaagagtcccacatgtttagtagaggctcctagatgagattccaagagccaccagttacagagctggataaaccgagtcaaaggttcaagtgtcactacaggggctggaaagaccaaaagtcatttgtttattctagtgcttatcatcacataaagaacaaatggcaggccgagcatggtggctcacgcctgtaatcccagcactttgggaggccaaggcaggtggatcacctgagatcaggagttcrataccagcctggccaagacagtgaaatgctgtctctactaaaaatacaaaaattagctgggtatggtggcaggcgcctgtaatcccagctactttggaggctgaggcaggagaatcacttgaacccgggaggcagagaacccagtgagccgaaatcagaacaaacggcagaacaaaggaaaaagtcaagagcagttgtttaaggctgtgatacctggtgggagggacagacactccagtggacccgttgctgttctctgcactttggaggctcaatgctggccagtaatggccctaggga

SEQ ID NO: 22412 - DNA, 601 bp, Human
cttacaaagttttataaatacatacatttcgtgtgtgtgtgtgtgtgtgtgtgtgtataaagaggttttatattatcaattatattatcaagaaatcacatcccaactggccactcaaagcagttctcaatagcatgtgtgtttttggaaggtattagactaatgatagaataaaataaatgatgtaaacatgcttctaaaactaaaaagtgcttcacaaatgtacaccaccagctgtttgttactgtaattattcttgttattagttactcatcctggagaatctgccacaaaatgcaakagtagctactaaccactagaagagaaaggatgagatggtgtctcacctggaagccttcaaggatcctgtgggcctccttgtccaggtccaggtcaacaggtggcaggcccaggtcattgccgtagatgaggtacacgcgcccgatgtggatgtggccggggcggctgtagcctggtgcgcccaccacgaggtcaccgtgcccatcctggttgaggtcagctgaggtcattgcccttagggaagtgaagggacccaccatggtatgcactgagcactagggttaaagctgtcgcctgcttc

SEQ ID NO: 22413 - DNA, 601 bp, Human
ccaaggtgggtggatcacctaaggtcaggagtttgagaccagactggccaacatggcaaaactgcatctctactaaaaataaaaaaattagccgggcctggtggtgtgcacctgtagtaccagctactcaggaggctgaggcaggagaattgcttgaacccgggaggcagaggttgcagtgagcagagattgcaccactgcactccagcctgggtgacagagcaagagactccatctcaaataaataaataaattaattaaaataaaatacttacaaagttttataaatacatacatttcttgtgtgtgtgtgtgtgtgtgtgtgtataaagaggttttatattatcaattatattatcaagaaatcacatcccaactggccactcaaagcagttctcaatagcatgtgtgtttttggaaggtattagactaatgatagaataaaataaatgatgtaaacatgcttctaaaactaaaaagtgcttcacaaatgtacaccaccagctgtttgttactgtaattattcttgttattagttactcatcctggagaatctgccacaaaatgcaagagtagctactaaccactagaagagaaagga

SEQ ID NO: 22414 - DNA, 601 bp, Human
ttctggacggatgcagtggctcacgcctgtaatcccagcactttgggaggccaaggtgggtggatcacctaaggtcaggagtttgagaccagactggccaacatggcaaaactgcatctctactaaaaataaaaaaattagccgggcctggtggtgtgcacctgtagtaccagctactcaggaggctgaggcaggagaattgcttgaacccgggaggcagaggttgcagtgagcagagattgcaccactgcactccagcctgggtgacagagcaagagactccatctcaaataaataaatwaattaattaaaataaaatacttacaaagttttataaatacatacatttcgtgtgtgtgtgtgtgtgtgtgtgtgtataaagaggttttatattatcaattatattatcaagaaatcacatcccaactggccactcaaagcagttctcaatagcatgtgtgtttttggaaggtattagactaatgatagaataaaataaatgatgtaaacatgcttctaaaactaaaaagtgcttcacaaatgtacaccaccagctgtttgttactgtaattattcttgttattagttactcatcctggag

SEQ ID NO: 22415 - DNA, 601 bp, Human
ttgacactcagagaatgcagtgccaggccagtatcaccaaaagccccacactcattggtgactagtagcagagctctgtctaccccacccccccacgctcctccttattgctgttacaaaaactaaagcctctgatgttagaaaaactttccaggaccctagcgctctcgggaggaattaatgcttggactccacgaggaacgtttgtagtcactgcgggttttttcaggtgatgaataaccacttaggacaaaagaaggaaatctaaagaaagcctggcgtttagttaatagtgatgtasagtgttgtttttattcttaatttttgacaagtataccataattatgtaagatgttaacataggggaaaatgagtaaacagtacatgggaactctttgtactgtctttataccttttctgtgaatctaaaattctggacggatgcagtggctcacgcctgtaatcccagcactttgggaggccaaggtgggtggatcacctaaggtcaggagtttgagaccagactggccaacatggcaaaactgcatctctactaaaaataaaaaaattagccgggcctggtggtgtgcacctgtagtac

SEQ ID NO: 22416 - DNA, 601 bp, Human
gtgaccttgagatgggagaataacttaaacccagaaggcagaggttgcagtgagccaagatcatgccactgcactccagtctgggcaacagtgagagtttatctcaaaaaaaaaaaaaaagcaagcacgttcaggtgtgccatcttattttctcttcacaggattcacttcacagcgaaagggtaagtgccttgcctggaacaagaaccacgacgatctgactggaagtctagggttctccccctagcacttgacactcagagaatgcagtgccaggccagtatcaccaaaagccccacaytcattggtgactagtagcagagctctgtctaccccacccccccacgctcctccttattgctgttacaaaaactaaagcctctgatgttagaaaaactttccaggaccctagcgctctcgggaggaattaatgcttggactccacgaggaacgtttgtagtcactgcgggttttttcaggtgatgaataaccacttaggacaaaagaaggaaatctaaagaaagcctggcgtttagttaatagtgatgtagagtgttgtttttattcttaatttttgacaagtataccataattatgtaag

SEQ ID NO: 22417 - DNA, 601 bp, Human
ttgtgaccttgagatgggagaataacttaaacccagaaggcagaggttgcagtgagccaagatcatgccactgcactccagtctgggcaacagtgagagtttatctcaaaaaaaaaaaaaaagcaagcacgttcaggtgtgccatcttattttctcttcacaggattcacttcacagcgaaagggtaagtgccttgcctggaacaagaaccacgacgatctgactggaagtctagggttctccccctagcacttgacactcagagaatgcagtgccaggccagtatcaccaaaagccccasactcattggtgactagtagcagagctctgtctaccccacccccccacgctcctccttattgctgttacaaaaactaaagcctctgatgttagaaaaactttccaggaccctagcgctctcgggaggaattaatgcttggactccacgaggaacgtttgtagtcactgcgggttttttcaggtgatgaataaccacttaggacaaaagaaggaaatctaaagaaagcctggcgtttagttaatagtgatgtagagtgttgtttttattcttaatttttgacaagtataccataattatgta

SEQ ID NO: 22418 - DNA, 601 bp, Human
tttctcttttttttgtttttgttttttgtttttgagatggagtttcgctcttgttgcccaggctagagtgcaatagtgcttggctcaccgcaacctccgcctcctgggttcaagcgattctcctgcctcagcctcccgagtagctgggattacaggcatatgccaccacatctggctaattttgtatttttagtagagacggggtttcaccacgttgatcaggctggtcttgatctcttgacctcaggatctgcccgccttggcctcccaaagtgctgggattataggcatgagccaccgygcccggccaggttctccaattctttcacaacttacataacaacgaatggcctttcacacagtggtgcttgccacataacacacatgctgaaggacccacgtccattatttattaggtaatctctccacacccgtgtgcagtggcatctataagtgctgcccctttctgtaaggcagaaacttgataaacaagataaggttgcctggggacacaaaacacgctagggcagggtgggaaccaataactcagggctctgccagctgaggactggttcattttatcactatcagctgcaccatc

SEQ ID NO: 22419 - DNA, 601 bp, Human
ggccgagccaaaccgacctgagggctgaagaggcacaagtttacttcccctgggctgagccacggcctcggaaagagcactcctgacccccagggagtagagaggcctgggacaacccccgccccccgccacccaaaagccgaaggtgcagtaagctataacatatctgcaacacatcagttaggtagctctgccctaagtatattttcagcatgtctgtctgccttgaggggaagcagagatgccagaaagtagagggttggttcttatgagttctagatttgtagaaaatagcctcgtktatgttcagacccacattaagcacaaaacttatcttcgaaagtatctaaaataggccgggcacggtggctcacacctgtaatcccagcactttgggaggcctgaacctgaggtcaggagttcaaaaccagcctggccaacatagtgaaaccccatctgtactaaaactacaagaattagccgggtgtggtggcacatgcctgtaatcccagctactctggagactgaggcaggagaatcccttgaatctgggaggcggaggttgcagtaagccaagatcgtgccactgcactccagccta

SEQ ID NO: 22420 - DNA, 601 bp, Human
ggggagaaaaagcttttcaagcagaggaaactgtacgagcaaaggtcgcaaagtgagacagcctgatgagttcaggacgtgacagactgctggcatgtctagaaatggagtgtgaggaggaaggggcaagagttgagtctgcagagggcagctggcaagggagggccctcgacctccacagtcacacatggtgcccggatgcgtggtccctgctatggtaggaagcatctgtgggaagcaagcaagccctgtgggccagggtccaggatctctaactcagtaagaaaggaggcaacaggcrgggatccaccatttgaggagaggcccagggaagtcacctcgctgttgtgataaccagaaactacagatgagctgggatttctgtctcccttcactggcattcagcatggtgggggatgaaaaaaagggctaagtacctggtggaattgggaaaccatagggccaaaataaggccagggaggcagcagcaggtgctacaaggtaactcaaggtcacggcaagaaccccataggggcctgagattatctgctcacaaatgctctgtctcacacactggctgtctgctttgctccaggggctc

SEQ ID NO: 22421 - DNA, 601 bp, Human
tcttttccatcataagccaggtactaggtacacaatgacaaataagaccaatctctttcctcctgaaaggctggcacacaggtcattatgacacccagggaagaaggggatataacaggtacaagcacaggatgctaagtggggacaaggaagtatcagcctcgcccaggagttaggtaatagtttctgcaagaagtgacatgtcactcctaaagaaagacaggggagaaaaagcttttcaagcagaggaaactgtacgagcaaaggtcgcaaagtgagacagcctgatgagttcaggacrtgacagactgctggcatgtctagaaatggagtgtgaggaggaaggggcaagagttgagtctgcagagggcagctggcaagggagggccctcgacctccacagtcacacatggtgcccggatgcgtggtccctgctatggtaggaagcatctgtgggaagcaagcaagccctgtgggccagggtccaggatctctaactcagtaagaaaggaggcaacaggcggggatccaccatttgaggagaggcccagggaagtcacctcgctgttgtgataaccagaaactacagatgagctgggat

SEQ ID NO: 22422 - DNA, 601 bp, Human
ttaatgacagacagaaatccattctgtgcattgctgctgggctgaaaggaatttttttaaagtctgtcacttccatcagactatgagagtccacaatgcagaaatgatgtcatttatatctttgcctccctgatgtcttactcaagatcctccacacacaattgtgcagtgtgcttgcagaatgacttactcaactccttgcccacttcaaggaccagcacagtttcaggctcttccatgaagcccccgggccacagcctgttgtacccatggcacatctgaatgccaacataccacatckgtaccacttacctgcctgaggatacacactgtgctattttattctgtgttaccaatcagttcctcttataacttgcctgtctccatccccattcattctacaagcacttcttttccatcataagccaggtactaggtacacaatgacaaataagaccaatctctttcctcctgaaaggctggcacacaggtcattatgacacccagggaagaaggggatataacaggtacaagcacaggatgctaagtggggacaaggaagtatcagcctcgcccaggagttaggtaatagtttctgcaa

SEQ ID NO: 22423 - DNA, 601 bp, Human
gaagaagacattcctccttgtttggaaccaaagtagacatacacggcaccctagataaggacaaacagcagatagacatgaggctctggtggtgacccaagaaccttaaataacagaagataaaaaggactgactctgggtccaggtatggtggctgatgtctataatcccagtgctttgggaggcccaagtgggaacattgcttgaggccaggagttcaagagcagcctcgaaaacacagtgagatcctgtgtccacgaaaaaaacttttaattaaagcgagaccttgtcaaattatcaycacccccaatgattgggagcttaatgacagacagaaatccattctgtgcattgctgctgggctgaaaggaatttttttaaagtctgtcacttccatcagactatgagagtccacaatgcagaaatgatgtcatttatatctttgcctccctgatgtcttactcaagatcctccacacacaattgtgcagtgtgcttgcagaatgacttactcaactccttgcccacttcaaggaccagcacagtttcaggctcttccatgaagcccccgggccacagcctgttgtacccatggcacatct

SEQ ID NO: 22424 - DNA, 601 bp, Human
agtggtaaacatacctggcaagaaatggtgatgttaggggaagaagacattcctccttgtttggaaccaaagtagacatacacggcaccctagataaggacaaacagcagatagacatgaggctctggtggtgacccaagaaccttaaataacagaagataaaaaggactgactctgggtccaggtatggtggctgatgtctataatcccagtgctttgggaggcccaagtgggaacattgcttgaggccaggagttcaagagcagcctcgaaaacacagtgagatcctgtgtccacgaawaaaacttttaattaaagcgagaccttgtcaaattatcaccacccccaatgattgggagcttaatgacagacagaaatccattctgtgcattgctgctgggctgaaaggaatttttttaaagtctgtcacttccatcagactatgagagtccacaatgcagaaatgatgtcatttatatctttgcctccctgatgtcttactcaagatcctccacacacaattgtgcagtgtgcttgcagaatgacttactcaactccttgcccacttcaaggaccagcacagtttcaggctcttccatga

SEQ ID NO: 22425 - DNA, 601 bp, Human
tccctccacctggtgcaaaaggggagccgatgaccagatcgggttcactgtctccattcacatctgcagccaagagagtccagcccaagttacagtagatgtccttaagaagaaaccaggaaagcacattttacccagccctggtggcagttaggatacagcgagttctaggtttctgcacctggctaaagtggtaaacatacctggcaagaaatggtgatgttaggggaagaagacattcctccttgtttggaaccaaagtagacatacacggcaccctagataaggacaaacagcagayagacatgaggctctggtggtgacccaagaaccttaaataacagaagataaaaaggactgactctgggtccaggtatggtggctgatgtctataatcccagtgctttgggaggcccaagtgggaacattgcttgaggccaggagttcaagagcagcctcgaaaacacagtgagatcctgtgtccacgaaaaaaacttttaattaaagcgagaccttgtcaaattatcaccacccccaatgattgggagcttaatgacagacagaaatccattctgtgcattgctgctgggctgaaaggaat

SEQ ID NO: 22426 - DNA, 601 bp, Human
acaataacaacaacaacaacaacaacagctatggacagtcgagagcaccactgagatgcctccggtgcaaagcctcctcagtgtttctgttttacatggagacactatgggaatagtctatttgccctctttggctctctacctagaaactgtgggtcaccttttgtattttcagtgaatctatgcacatcacttgccaacacatctttaagagtaacagactgttagaaaatgttggtgaaatgatatggaataaggaaaaaggatataaacccctatgcaggataagttgtcgtagacmcacagagcagccatggtctcacccattccccctcaggcactacctttgtcgctcaggctggggccagaataaaacgcagccacaattcccttctgcttccctccacctggtgcaaaaggggagccgatgaccagatcgggttcactgtctccattcacatctgcagccaagagagtccagcccaagttacagtagatgtccttaagaagaaaccaggaaagcacattttacccagccctggtggcagttaggatacagcgagttctaggtttctgcacctggctaaagtggtaaacatac

SEQ ID NO: 22427 - DNA, 601 bp, Human
atgatgaaaccccgtctctactaaaaatacaaaaattagccgggcatggtggcatgcgcctgtagtccccacctgtagtcccagctactcaggaggctgagacagaattgcttaaacctgggaggtggaggttgtagtgagccaagattatgctactgcactccagcctgggtgacacagggagactctgtctcaaaaaaaaagaaaaaacaacaataacaacaacaacaacaacaacagctatggacagtcgagagcaccactgagatgcctccggtgcaaagcctcctcagtgtttctrttttacatggagacactatgggaatagtctatttgccctctttggctctctacctagaaactgtgggtcaccttttgtattttcagtgaatctatgcacatcacttgccaacacatctttaagagtaacagactgttagaaaatgttggtgaaatgatatggaataaggaaaaaggatataaacccctatgcaggataagttgtcgtagacccacagagcagccatggtctcacccattccccctcaggcactacctttgtcgctcaggctggggccagaataaaacgcagccacaattc

SEQ ID NO: 22428 - DNA, 601 bp, Human
ctaatagaagtgggttcattttgctgagtttttgccagaggtcttatatgtccccatgctgatcccaggaccccaatgtcattgaatctcactcttcatacaagaaatacatttctagagctcacttctgtggagcagaggatgctatttaaaaaggctctgggccaggtgcggtggctcacacctgtaatcccagcactttgggacgccgaggtgggtggatcaccagaggtcaggagttcaagaccagcctgaccaatatgatgaaaccccgtctctactaaaaatacaaaaattagcygggcatggtggcatgcgcctgtagtccccacctgtagtcccagctactcaggaggctgagacagaattgcttaaacctgggaggtggaggttgtagtgagccaagattatgctactgcactccagcctgggtgacacagggagactctgtctcaaaaaaaaagaaaaaacaacaataacaacaacaacaacaacaacagctatggacagtcgagagcaccactgagatgcctccggtgcaaagcctcctcagtgtttctgttttacatggagacactatgggaatagtctatttgccctc

SEQ ID NO: 22429 - DNA, 601 bp, Human
aaaaaaattagctaggcatgggcacacacgacttgtagtcccagctattcaggaggccgaggcaggaggacgagttcgagcctgcagtgagttaccactgccctctgccctttgcaacagagtgaaccctcaccccctcctcccaaaagaaaaaacagaagtgaggaatggggcacagacacacagagagggaagacagccatctgcaagccaaggagacaggcctcaggagaaaccaaccctctgacctcaaccttgatcttggacgtctagcttccagaactgtgagaaaataatacayttgtctattgtatttttaaatttctaaggaggagaatttgcaatcttgcccagagccttggcttttccttcaaaagtcaagcatttcctagcccttttccctcagcctcatgctcagtgcgctccatagcagcaggtacctgcccctgtgttcatggttcccagcccccagcatcagcctcacctgctggcattcttccaggtcgggctcccaaccaacagcaaggttctgttgtccacagtgacaccgtgaagggaatatccaaaccaggagaagtcttcctcgcctctcaccgtccag

SEQ ID NO: 22430 - DNA, 601 bp, Human
ggcctcccagcagactctctgggatagagatataggggtacctactgttatgggctcagtggtggtccccccgatccctacactgaagccctaacccccagtatctctgaatgtgactacttgaagacagagtctttaaagaggtgattaagttacgatgaggtcatttgggtggatcctgatccaataggactggtgtctttcaaagaagaggagaggcaggaggatcacttgaggccagtttgagacgagcctgggcaacactgcaaaaacccatccctataaaaatgtttttaaattaaaaaaaaaaaattagctaggcatgggcacacacgacttgtagtcccagctattcaggaggccgaggcaggaggacgagttcgagcctgcagtgagttaccactgccctctgccctttgcaacagagtgaaccctcaccccctcctcccaaaagaaaaaacagaagtgaggaatggggcacagacacacagagagggaagacagccatctgcaagccaaggagacaggcctcaggagaaaccaaccctctgacctcaaccttgatcttggacgtctagcttccagaactgtgagaaaataa

SEQ ID NO: 22431 - DNA, 601 bp, Human
tgtctcaaaaaagaaaaataaaagataggtcctcatagtggacctattcctagtgaactgacctatacaatttttctctggctccaagttccatgggataggggctttaaaaatacactaagttactttcatatgtcattttcaacaaagctttgaaacacaaattttattttatcttattttattttatttttattttatttttgagatgaagtcttgctctgttgcccaggctggagtgcagtggcatgatcttggcttactgcaacttctgcctcccagattcaagcgattctcctgyctcagcctcccgagtagctgggattacaggtatgcaccaccacacctggctaatttttgtatttttagtagaggcaaagtttcaccatgttgccaggctggtctccaactcctgacctcaagtgattctctcaccttggcctcccaaagtgctgggattacaggtgtgagccaccgcacccggcctgaaataggtatttacaatttcagttttgtagatggtgatacaaaagttctgagaggttaagtaacttccccaaagttacacagaatgttattaatgaaaaaaggaaatattgaa

SEQ ID NO: 22432 - DNA, 601 bp, Human
gttgtcctgtctctgacttgaaattgtcaacaatgttttaacaaggggccctgcatttttatttggaactgggccccgcaaactgtgtgggtgaaatacaagtaaaatacaagtaataatgggaaaatctgaacaatttgggtgaaatatatcaataacaataacctgatggtgacattaattcatatttatatataatatatagttatatatacattcatacattatatatagacacatacatgtatatataatatatacatattatatacatttatattatatattagtatacttatayacactttataaattagcatattatatacatacataaaagttataattaaacttattttctattattatttatcttttaaaaaatagggtctcactctgttgcccaggctggagtgcagtgggtgtgatcatagctcactgcagccttgaactcctgggctcaagtgatcttcccacctcagcctcctcagtaggtggaactacatgtgcccatcactatgcctacctttttttctttttctgtagagatggggtctccctatattgtccaggctggcctcaaattcttgggctcaagcaa

SEQ ID NO: 22433 - DNA, 601 bp, Human
gacttgaaaagctgtacagtgccgagagaagctaagtggttaggacataaatgcagggcatgtgcccctgtggtcacacaggcactgcatttcgaaaggacctatgcctgtcttcatgttgtcctgtctctgacttgaaattgtcaacaatgttttaacaaggggccctgcatttttatttggaactgggccccgcaaactgtgtgggtgaaatacaagtaaaatacaagtaataatgggaaaatctgaacaatttgggtgaaatatatcaataacaataacctgatggtgacattaattyatatttatatataatatatagttatatatacattcatacattatatatagacacatacatgtatatataatatatacatattatatacatttatattatatattagtatacttatatacactttataaattagcatattatatacatacataaaagttataattaaacttattttctattattatttatcttttaaaaaatagggtctcactctgttgcccaggctggagtgcagtgggtgtgatcatagctcactgcagccttgaactcctgggctcaagtgatcttcccacctcagcc

SEQ ID NO: 22434 - DNA, 601 bp, Human
aacctgattccaagacttgaaaagctgtacagtgccgagagaagctaagtggttaggacataaatgcagggcatgtgcccctgtggtcacacaggcactgcatttcgaaaggacctatgcctgtcttcatgttgtcctgtctctgacttgaaattgtcaacaatgttttaacaaggggccctgcatttttatttggaactgggccccgcaaactgtgtgggtgaaatacaagtaaaatacaagtaataatgggaaaatctgaacaatttgggtgaaatatatcaataacaataacctgatkgtgacattaattcatatttatatataatatatagttatatatacattcatacattatatatagacacatacatgtatatataatatatacatattatatacatttatattatatattagtatacttatatacactttataaattagcatattatatacatacataaaagttataattaaacttattttctattattatttatcttttaaaaaatagggtctcactctgttgcccaggctggagtgcagtgggtgtgatcatagctcactgcagccttgaactcctgggctcaagtgatct

SEQ ID NO: 22435 - DNA, 601 bp, Human
tttcagtgatgccacatctttgcaaagctgcatattcagggatggttgtgataaaaagcaggcactaatgaaaaaattgctgtggattaggaaatgaggaaagttgtgtctaacctgattccaagacttgaaaagctgtacagtgccgagagaagctaagtggttaggacataaatgcagggcatgtgcccctgtggtcacacaggcactgcatttcgaaaggacctatgcctgtcttcatgttgtcctgtctctgacttgaaattgtcaacaatgttttaacaaggggccctgcattttyatttggaactgggccccgcaaactgtgtgggtgaaatacaagtaaaatacaagtaataatgggaaaatctgaacaatttgggtgaaatatatcaataacaataacctgatggtgacattaattcatatttatatataatatatagttatatatacattcatacattatatatagacacatacatgtatatataatatatacatattatatacatttatattatatattagtatacttatatacactttataaattagcatattatatacatacataaaagttataattaaacttattttc

SEQ ID NO: 22436 - DNA, 601 bp, Human
ttcaaagataacagtgacatctgacaccacacgaactactgggtggaggccggtcacagttacgacacgagagtcctgcattcgtttcagtgatgccacatctttgcaaagctgcatattcagggatggttgtgataaaaagcaggcactaatgaaaaaattgctgtggattaggaaatgaggaaagttgtgtctaacctgattccaagacttgaaaagctgtacagtgccgagagaagctaagtggttaggacataaatgcagggcatgtgcccctgtggtcacacaggcactgcatttygaaaggacctatgcctgtcttcatgttgtcctgtctctgacttgaaattgtcaacaatgttttaacaaggggccctgcatttttatttggaactgggccccgcaaactgtgtgggtgaaatacaagtaaaatacaagtaataatgggaaaatctgaacaatttgggtgaaatatatcaataacaataacctgatggtgacattaattcatatttatatataatatatagttatatatacattcatacattatatatagacacatacatgtatatataatatatacatattatatacattt

SEQ ID NO: 22437 - DNA, 601 bp, Human
aaaaaaagtatatcaaaaatctcaaatttagattaatctgtgccttatagctgtgattcccaaactgcacactgaagcgcttcagtgaactggcaaagatgctgtagatattttgacatttcaaagataacagtgacatctgacaccacacgaactactgggtggaggccggtcacagttacgacacgagagtcctgcattcgtttcagtgatgccacatctttgcaaagctgcatattcagggatggttgtgataaaaagcaggcactaatgaaaaaattgctgtggattaggaaatgargaaagttgtgtctaacctgattccaagacttgaaaagctgtacagtgccgagagaagctaagtggttaggacataaatgcagggcatgtgcccctgtggtcacacaggcactgcatttcgaaaggacctatgcctgtcttcatgttgtcctgtctctgacttgaaattgtcaacaatgttttaacaaggggccctgcatttttatttggaactgggccccgcaaactgtgtgggtgaaatacaagtaaaatacaagtaataatgggaaaatctgaacaatttgggtgaaatatatcaata

SEQ ID NO: 22438 - DNA, 601 bp, Human
tgggaggcagaggctgcagtgagcttgagatcacaccactacattccagcctgggcaagagagcgagactctatctcaaaaaaaaaaaaaaaagtatatcaaaaatctcaaatttagattaatctgtgccttatagctgtgattcccaaactgcacactgaagcgcttcagtgaactggcaaagatgctgtagatattttgacatttcaaagataacagtgacatctgacaccacacgaactactgggtggaggccggtcacagttacgacacgagagtcctgcattcgtttcagtgatgmcacatctttgcaaagctgcatattcagggatggttgtgataaaaagcaggcactaatgaaaaaattgctgtggattaggaaatgaggaaagttgtgtctaacctgattccaagacttgaaaagctgtacagtgccgagagaagctaagtggttaggacataaatgcagggcatgtgcccctgtggtcacacaggcactgcatttcgaaaggacctatgcctgtcttcatgttgtcctgtctctgacttgaaattgtcaacaatgttttaacaaggggccctgcatttttatttggaactg

SEQ ID NO: 22439 - DNA, 601 bp, Human
actgcttgaacctgggaggcagaggctgcagtgagcttgagatcacaccactacattccagcctgggcaagagagcgagactctatctcaaaaaaaaaaaaaaaagtatatcaaaaatctcaaatttagattaatctgtgccttatagctgtgattcccaaactgcacactgaagcgcttcagtgaactggcaaagatgctgtagatattttgacatttcaaagataacagtgacatctgacaccacacgaactactgggtggaggccggtcacagttacgacacgagagtcctgcattcrtttcagtgatgccacatctttgcaaagctgcatattcagggatggttgtgataaaaagcaggcactaatgaaaaaattgctgtggattaggaaatgaggaaagttgtgtctaacctgattccaagacttgaaaagctgtacagtgccgagagaagctaagtggttaggacataaatgcagggcatgtgcccctgtggtcacacaggcactgcatttcgaaaggacctatgcctgtcttcatgttgtcctgtctctgacttgaaattgtcaacaatgttttaacaaggggccctgcatttt

SEQ ID NO: 22440 - DNA, 601 bp, Human
gcctggccaacatggtgaaactccatctctactaaaaataaaaaaaaaaaatagctgggcatggtggtgcgtgcctgtagttccagctactcaggagaatgaaacaggagaactgcttgaacctgggaggcagaggctgcagtgagcttgagatcacaccactacattccagcctgggcaagagagcgagactctatctcaaaaaaaaaaaaaaaagtatatcaaaaatctcaaatttagattaatctgtgccttatagctgtgattcccaaactgcacactgaagcgcttcagtgaactsgcaaagatgctgtagatattttgacatttcaaagataacagtgacatctgacaccacacgaactactgggtggaggccggtcacagttacgacacgagagtcctgcattcgtttcagtgatgccacatctttgcaaagctgcatattcagggatggttgtgataaaaagcaggcactaatgaaaaaattgctgtggattaggaaatgaggaaagttgtgtctaacctgattccaagacttgaaaagctgtacagtgccgagagaagctaagtggttaggacataaatgcagggcatgtgc

SEQ ID NO: 22441 - DNA, 601 bp, Human
ttttcacatttaggctatttctagctttttactactataaacaatacagccatccctcagtatccacgaaggattggttccagggcctctcacagataccaaaatccacggatgttcaagcccctgatataaaatggtatagtgactgggcgcagtggctcacgcctgtaatcccagcactgtgggaggccgaggcgggcggatcacctgacatcgggagtttgagaccagcctggccaacatggtgaaactccatctctactaaaaataaaaaaaaaaaatagctgggcatggtggtgcrtgcctgtagttccagctactcaggagaatgaaacaggagaactgcttgaacctgggaggcagaggctgcagtgagcttgagatcacaccactacattccagcctgggcaagagagcgagactctatctcaaaaaaaaaaaaaaaagtatatcaaaaatctcaaatttagattaatctgtgccttatagctgtgattcccaaactgcacactgaagcgcttcagtgaactggcaaagatgctgtagatattttgacatttcaaagataacagtgacatctgacaccacacgaactactggg

SEQ ID NO: 22442 - DNA, 601 bp, Human
taaaattttaaatctgattcttttcacatttaggctatttctagctttttactactataaacaatacagccatccctcagtatccacgaaggattggttccagggcctctcacagataccaaaatccacggatgttcaagcccctgatataaaatggtatagtgactgggcgcagtggctcacgcctgtaatcccagcactgtgggaggccgaggcgggcggatcacctgacatcgggagtttgagaccagcctggccaacatggtgaaactccatctctactaaaaataaaaaaaaaaartagctgggcatggtggtgcgtgcctgtagttccagctactcaggagaatgaaacaggagaactgcttgaacctgggaggcagaggctgcagtgagcttgagatcacaccactacattccagcctgggcaagagagcgagactctatctcaaaaaaaaaaaaaaaagtatatcaaaaatctcaaatttagattaatctgtgccttatagctgtgattcccaaactgcacactgaagcgcttcagtgaactggcaaagatgctgtagatattttgacatttcaaagataacagtgacatctg

SEQ ID NO: 22443 - DNA, 601 bp, Human
ttgtggattataaaattttaaatctgattcttttcacatttaggctatttctagctttttactactataaacaatacagccatccctcagtatccacgaaggattggttccagggcctctcacagataccaaaatccacggatgttcaagcccctgatataaaatggtatagtgactgggcgcagtggctcacgcctgtaatcccagcactgtgggaggccgaggcgggcggatcacctgacatcgggagtttgagaccagcctggccaacatggtgaaactccatctctactaaaaataaaaaaaaaaaatagctgggcatggtggtgcgtgcctgtagttccagctactcaggagaatgaaacaggagaactgcttgaacctgggaggcagaggctgcagtgagcttgagatcacaccactacattccagcctgggcaagagagcgagactctatctcaaaaaaaaaaaaaaaagtatatcaaaaatctcaaatttagattaatctgtgccttatagctgtgattcccaaactgcacactgaagcgcttcagtgaactggcaaagatgctgtagatattttgacatttcaaagataaca

SEQ ID NO: 22444 - DNA, 601 bp, Human
atggccagcctcggcaacatagcaagactccaactattaaaaaaaaaaaaaaagcataaagaagaaaatgtatatactatatatatttctttctggaaagtgagataggtaggtaggtaggcagatatctataaacacacattttaaacaaaatggagattttgtggattataaaattttaaatctgattcttttcacatttaggctatttctagctttttactactataaacaatacagccatccctcagtatccacgaaggattggttccagggcctctcacagataccaaaatccacrgatgttcaagcccctgatataaaatggtatagtgactgggcgcagtggctcacgcctgtaatcccagcactgtgggaggccgaggcgggcggatcacctgacatcgggagtttgagaccagcctggccaacatggtgaaactccatctctactaaaaataaaaaaaaaaaatagctgggcatggtggtgcgtgcctgtagttccagctactcaggagaatgaaacaggagaactgcttgaacctgggaggcagaggctgcagtgagcttgagatcacaccactacattccagcctgggca

SEQ ID NO: 22445 - DNA, 601 bp, Human
catggccagcctcggcaacatagcaagactccaactattaaaaaaaaaaaaaaagcataaagaagaaaatgtatatactatatatatttctttctggaaagtgagataggtaggtaggtaggcagatatctataaacacacattttaaacaaaatggagattttgtggattataaaattttaaatctgattcttttcacatttaggctatttctagctttttactactataaacaatacagccatccctcagtatccacgaaggattggttccagggcctctcacagataccaaaatccayggatgttcaagcccctgatataaaatggtatagtgactgggcgcagtggctcacgcctgtaatcccagcactgtgggaggccgaggcgggcggatcacctgacatcgggagtttgagaccagcctggccaacatggtgaaactccatctctactaaaaataaaaaaaaaaaatagctgggcatggtggtgcgtgcctgtagttccagctactcaggagaatgaaacaggagaactgcttgaacctgggaggcagaggctgcagtgagcttgagatcacaccactacattccagcctgggc

SEQ ID NO: 22446 - DNA, 601 bp, Human
aagaggatatcatcttgtaatgtggttcatatttgtgtctcagaaaaactataaacttgccaggcatggtggctcatgcctataatcccagcactttgggaggctgaggcaggaggatcacttcagctcatgagttcaagaccagcctgggaaatgcagtgagaccccatcactacaaaaagtagggtgtggtggcatgtgcctgtagtctgacctactcaagaggcttgaggcggcaggatcgcttgacctcaggtgttcaaggtaacagtgagctgtgatcacaccattgaactccagyctgggcaacagagcaagaccctatggcttaaaaagaaaaagaaaaattatcaactgtaagttacttaatgtcaccagctttcaggattactgcaaaagtcaaaactatgaagatgtcaagaagatcttttatatttgatcattatcaaaagtgtaaaaaatactcaaaaaaaaaaaaaaaaagaagcataatccaggtgttgtggcacatgcctgtggtcccggctacttgtgaacctgagatgggaggatcacttgagcccagaagttcatggccagcctcggcaacatagcaagactc

SEQ ID NO: 22447 - DNA, 601 bp, Human
cacaggtgcatctcaccaactctactctcttgaaaaccacaggaaagaggatatcatcttgtaatgtggttcatatttgtgtctcagaaaaactataaacttgccaggcatggtggctcatgcctataatcccagcactttgggaggctgaggcaggaggatcacttcagctcatgagttcaagaccagcctgggaaatgcagtgagaccccatcactacaaaaagtagggtgtggtggcatgtgcctgtagtctgacctactcaagaggcttgaggcggcaggatcgcttgacctcaggwgttcaaggtaacagtgagctgtgatcacaccattgaactccagcctgggcaacagagcaagaccctatggcttaaaaagaaaaagaaaaattatcaactgtaagttacttaatgtcaccagctttcaggattactgcaaaagtcaaaactatgaagatgtcaagaagatcttttatatttgatcattatcaaaagtgtaaaaaatactcaaaaaaaaaaaaaaaaagaagcataatccaggtgttgtggcacatgcctgtggtcccggctacttgtgaacctgagatgggaggatcactt

SEQ ID NO: 22448 - DNA, 601 bp, Human
ccttctgtaatgcttataccttctagttaacatagaattccttctgtaatgcttaaaccctctgattaaggaccattatcttttagacctccatattgccttaatttctgccacgagcactagtccctagggttgtgtttgggatgcaggggtggtgggtattttttaaatacacacacaagtgttttacttctcatgtggaacttttcttccagtggagggagcagaaaacaaaagagctattgtgaaacacaggtgcatctcaccaactctactctcttgaaaaccacaggaaagaggrtatcatcttgtaatgtggttcatatttgtgtctcagaaaaactataaacttgccaggcatggtggctcatgcctataatcccagcactttgggaggctgaggcaggaggatcacttcagctcatgagttcaagaccagcctgggaaatgcagtgagaccccatcactacaaaaagtagggtgtggtggcatgtgcctgtagtctgacctactcaagaggcttgaggcggcaggatcgcttgacctcaggtgttcaaggtaacagtgagctgtgatcacaccattgaactccagcctgggc

SEQ ID NO: 22449 - DNA, 601 bp, Human
agaaaaaactcaaggtaatgttgtaggcatttctatattatttcagtactgaaaataattctgaagaactttggcttttaaaagggctacatgcagaggcctttatgaattcccaaattctagaatgctactataacacagaattccttctgtaatgcttataccttctagttaacatagaattccttctgtaatgcttaaaccctctgattaaggaccattatcttttagacctccatattgccttaatttctgccacgagcactagtccctagggttgtgtttgggatgcaggggtggygggtattttttaaatacacacacaagtgttttacttctcatgtggaacttttcttccagtggagggagcagaaaacaaaagagctattgtgaaacacaggtgcatctcaccaactctactctcttgaaaaccacaggaaagaggatatcatcttgtaatgtggttcatatttgtgtctcagaaaaactataaacttgccaggcatggtggctcatgcctataatcccagcactttgggaggctgaggcaggaggatcacttcagctcatgagttcaagaccagcctgggaaatgcagtga

SEQ ID NO: 22450 - DNA, 601 bp, Human
ctcaccttctcaatcatgcaaattaaacaatggattatcatacacatttagacaaggagaaaaaactcaaggtaatgttgtaggcatttctatattatttcagtactgaaaataattctgaagaactttggcttttaaaagggctacatgcagaggcctttatgaattcccaaattctagaatgctactataacacagaattccttctgtaatgcttataccttctagttaacatagaattccttctgtaatgcttaaaccctctgattaaggaccattatcttttagacctccatattgscttaatttctgccacgagcactagtccctagggttgtgtttgggatgcaggggtggtgggtattttttaaatacacacacaagtgttttacttctcatgtggaacttttcttccagtggagggagcagaaaacaaaagagctattgtgaaacacaggtgcatctcaccaactctactctcttgaaaaccacaggaaagaggatatcatcttgtaatgtggttcatatttgtgtctcagaaaaactataaacttgccaggcatggtggctcatgcctataatcccagcactttgggaggct

SEQ ID NO: 22451 - DNA, 601 bp, Human
caagcccagccacattccctttcttttcgtgcctcctaaaggaaccatgagctccctggagcgcccaggaatccagtaacacttccagctctctgtctactccctgcttcagtccttccatggcaagaggatacctgaggcttctccctctggctctgccgcccacaggatgaacactggccccagtgcatgtgggagaatctcagagaagtcaccccaaggtctagctttcggagcaagaattagaaagcctgaatagggctgcccattgagactgtgttctctaatccaactatgtcarctcttcaaaagtacatattttgatatccctctgaatgattcatgaatctatttcagaaatgatttgaaatgcacaaggatgaggaagaattgtaattaatcaatactcccaaatctctaacacgcatcacagtctgttaaagaagagaagcatataatttaaaataatttcatcaaagtgtttttttaattcttcagaattaaaacagaagaatctagacacttggaaatttcagccattcaaaacacctcaccttctcaatcatgcaaattaaacaatggattatcatacacatttaga

SEQ ID NO: 22452 - DNA, 601 bp, Human
tgacctgttttttcggacaaacttgtgccttgtttatgggaaactgtccactagaagccactgagggctcaaagcagagtcggcaacaacagtcagatataacagctagaaaacagtaggaaataagaaagagtattttaaaagctcagcaatctggagctttctgatacagggcaaacaacatgacctaacacaatgtctcctaagagaacaatgtgccagcacaacagttaatattcagagtgaaagcccaaaatatcaagaaaagttgaaataagagaaaatcttcattccttttttyttttttattattgagatggagtctcactctgtcacccaggctggagtacagcggcgcgatctcggctcactgcaacctccgcttcctgggttcaagcgattctcctgcctcagcctcccgagtagctgggactacaggcacgcgccaccacgcctaattttttgtatttttagcagagacagggtttcaccgtgttagccaggatggtcttgatctcctgacctcgtgatctgcctgcctcagtctcccaaaagtgctgggattacaggtgcaagccaccaagcccagccacattccctt

SEQ ID NO: 22453 - DNA, 601 bp, Human
ctctctatccactgtacctagcatggtgcttggttctgtacaagtattcaataaagtgttttttgaattaatgaattttgaacaaactcaaagctagttgttggaatttcgctgtaaactttattatttggaacacagctttgatttcagaaatataaatggcacctgtgggttgatggggctagtggccctctgagaagtttgccgtatgctggcaaagtgtcagtgcgtggatacaatctcacgtcagcgtccactgagttttgtgtgtaaaactgagctaatctgacctgttttttcrgacaaacttgtgccttgtttatgggaaactgtccactagaagccactgagggctcaaagcagagtcggcaacaacagtcagatataacagctagaaaacagtaggaaataagaaagagtattttaaaagctcagcaatctggagctttctgatacagggcaaacaacatgacctaacacaatgtctcctaagagaacaatgtgccagcacaacagttaatattcagagtgaaagcccaaaatatcaagaaaagttgaaataagagaaaatcttcattcctttttttttttttattattga

SEQ ID NO: 22454 - DNA, 601 bp, Human
cggtcacgtctctgtctctctatccactgtacctagcatggtgcttggttctgtacaagtattcaataaagtgttttttgaattaatgaattttgaacaaactcaaagctagttgttggaatttcgctgtaaactttattatttggaacacagctttgatttcagaaatataaatggcacctgtgggttgatggggctagtggccctctgagaagtttgccgtatgctggcaaagtgtcagtgcgtggatacaatctcacgtcagcgtccactgagttttgtgtgtaaaactgagctaatytgacctgttttttcggacaaacttgtgccttgtttatgggaaactgtccactagaagccactgagggctcaaagcagagtcggcaacaacagtcagatataacagctagaaaacagtaggaaataagaaagagtattttaaaagctcagcaatctggagctttctgatacagggcaaacaacatgacctaacacaatgtctcctaagagaacaatgtgccagcacaacagttaatattcagagtgaaagcccaaaatatcaagaaaagttgaaataagagaaaatcttcattcctttttt

SEQ ID NO: 22455 - DNA, 601 bp, Human
atcgctctgcattcacttctgtgtctcctgcatcaggcgcccattccacaagaaatgcggtcacgtctctgtctctctatccactgtacctagcatggtgcttggttctgtacaagtattcaataaagtgttttttgaattaatgaattttgaacaaactcaaagctagttgttggaatttcgctgtaaactttattatttggaacacagctttgatttcagaaatataaatggcacctgtgggttgatggggctagtggccctctgagaagtttgccgtatgctggcaaagtgtcagtgygtggatacaatctcacgtcagcgtccactgagttttgtgtgtaaaactgagctaatctgacctgttttttcggacaaacttgtgccttgtttatgggaaactgtccactagaagccactgagggctcaaagcagagtcggcaacaacagtcagatataacagctagaaaacagtaggaaataagaaagagtattttaaaagctcagcaatctggagctttctgatacagggcaaacaacatgacctaacacaatgtctcctaagagaacaatgtgccagcacaacagttaatattcagag

SEQ ID NO: 22456 - DNA, 601 bp, Human
ggagtccaaactcttcacaaggccttacagaatctgactcccacttggggatctagcgccattaaccttttcacccacacttcaccaaaatgaacttaaaccacagcccaatctatgtcttaaatttgggcctttggacatgatgtgctctctgcctggaatagaggcatatgctccgcgtgctcccctgtccacatccctctgctggctactcctgtcaccctgcagaatttggctcaggtgtcccctcctctgggaagcctttcctaatctcgctggtctagagaagaggccgcttccmtgtgctcccatacataataacaccgagtccagtgggactttagctctgggcacaaacgctacagaactgcaagaactgcagacagctggggcccacaaaacatgggcaagtgattgtgtcctgaccccaggacctctgagttcaggtaagcattttacaggggacatgagctgtgcccagtgccttctgaatacccacggcagggcagcatcgctctgcattcacttctgtgtctcctgcatcaggcgcccattccacaagaaatgcggtcacgtctctgtctctctatccactgtacct

SEQ ID NO: 22457 - DNA, 601 bp, Human
tcttgtcaaagggtcctgttcctttcttacctaagccatcatcatccaggtcactcaagtgcagaacgccaccaaatcgggagaagcggcggtctccgctgaaggtgctgagcagcagaggctgcgcgtcagatatgagtgcgtacatgcgagtggctccgccttggtgtagggtcacggtcaggaatgccaccttagacacgtcatctgaaacgaaccacagttcctgctggcctcacagaaaggaaggcattacagaacacggaatagcaccccatcctcaagtgacactgatcactcrggatcctacaggacagtcggtttcggtgctggtcatctccggcagtcagggaggtacaaccagcttgggcaccaaggcacaaacaccagagagcttcagtgatttccctccaggcaggtattcttttttccagtcttatccccataatacagtctccacacagccacctttttattttctcgtatcacaaactaggtcacccccatgactgacacatccaaacgcaagtggactctggatggagtccaaactcttcacaaggccttacagaatctgactcccacttggggatctagcgcc

SEQ ID NO: 22458 - DNA, 601 bp, Human
catattaccagcttcaagaagtgcaactccctctctggtcttgcctcattcaagatctgtctaaaggtccttgggccactgggctgtcaattataagggcagagcccagatgacccaattaggggacccaccccctgggcaaagggactcaattcttgtcaaagggtcctgttcctttcttacctaagccatcatcatccaggtcactcaagtgcagaacgccaccaaatcgggagaagcggcggtctccgctgaaggtgctgagcagcagaggctgcgcgtcagatatgagtgcgtacaygcgagtggctccgccttggtgtagggtcacggtcaggaatgccaccttagacacgtcatctgaaacgaaccacagttcctgctggcctcacagaaaggaaggcattacagaacacggaatagcaccccatcctcaagtgacactgatcactcgggatcctacaggacagtcggtttcggtgctggtcatctccggcagtcagggaggtacaaccagcttgggcaccaaggcacaaacaccagagagcttcagtgatttccctccaggcaggtattcttttttccagtcttatccccataa

SEQ ID NO: 22459 - DNA, 601 bp, Human
ggcaatggaacaggaacccgtctctattttaaaaagagaaactccaatggccatggcctgttttctttcttctgtgctgtgggtgcctaaccaagcagtggcaggctgtgtgaccagggacctacataacaccaagtccagtgggactttagctctgggcacaaatgttgcagaactgtaagaactgcaggcagctggggcccacaaaacatggacagatgatggtgtcctgaccctaggaggtatgaattcaggtaagcactttatagtggacatgagttaacaaggaatcagcaattartgatcctttcccaataagttatagaattttgtagaacacttaccttttcttctggacatggagttatccatgatttgcatttgccagtcatgtcaccaagggtggtctctttgccattatatacatatactcggccgtcttctcccccaatcagtccagaggttacatctgctatcctcaggggggctgccatgatgatttcatctgaaaacaataaaaaccgacagaaggaagtatttgactcctcactgtcatcttttccttgttccgctactggatcctaacccaacctcttacaaa

SEQ ID NO: 22460 - DNA, 601 bp, Human
cataataaactttcactaattttgcaatttaaaaaataattttaaattttttaaaataggtggggtacggtggctcatgcctgttatcccagcactttgggctgtaatcccagcctggccgacatggtgaaaccctgtctctactaaaaatacaaaaaattagccaggcgtggtggtgcatgcctgtagtcccagctattcgggaggctgaagcaggaaaatggcttgaacctgggaggaggaggttgcagtgagccgagaccgtgccactgcactccagcctgggcaatagagccagackctgtctcaaaaaaaaaaaaaaaaaaaaaaagttaaataatggccaaatgctttaggcccaggaaatgtaacttaaggaaactcacccaaaaaaggaataaacaaagaaatgaaacaaaaagcaaaagagaggacgttttaatgaaactccagtggctggccgagcatggtggctcatgcctgtaatcccagcactttgtgaggccaggtagaagaactgcttgagcccaagagttcaataccagcctgggcaacatagtgaggccccatctctacaaataataaaaagattagccgggtg

SEQ ID NO: 22461 - DNA, 601 bp, Human
atttttaattctctttgtacatttttgtattttctaaaatttccataataaactttcactaattttgcaatttaaaaaataattttaaattttttaaaataggtggggtacggtggctcatgcctgttatcccagcactttgggctgtaatcccagcctggccgacatggtgaaaccctgtctctactaaaaatacaaaaaattagccaggcgtggtggtgcatgcctgtagtcccagctattcgggaggctgaagcaggaaaatggcttgaacctgggaggaggaggttgcagtgagccragaccgtgccactgcactccagcctgggcaatagagccagactctgtctcaaaaaaaaaaaaaaaaaaaaaaagttaaataatggccaaatgctttaggcccaggaaatgtaacttaaggaaactcacccaaaaaaggaataaacaaagaaatgaaacaaaaagcaaaagagaggacgttttaatgaaactccagtggctggccgagcatggtggctcatgcctgtaatcccagcactttgtgaggccaggtagaagaactgcttgagcccaagagttcaataccagcctgggcaacata

SEQ ID NO: 22462 - DNA, 601 bp, Human
aacaagtgagaccaccaaatcccacccgtagtactaacataaacatcaatgaagttcagtccttgggctcacctttgccttggacctcacggtgatgagggagctcccaaaccttgagctggcctgtaaaacatgccgtctgttaatgggctttgaagaacatagtgtaatactttatccgtttaaaataaaccaaggggcattgttttggtaatttttctttcttcagtctttcaagggatacttacttcaggagaaatcaatacatattgggcctgaagaaaaaaattgaggagagagmcaatgttattactgtttgtgtggctttttaaaatcaattttaattatacccttataccctcatttctacttttttttttttttttttttttgagaaggagtcttgctctgtcgcccaggctggagtgcagtggcgtgatctcagctcactgcaacctctgcctcccaggttcaagcaagtctcccgcttcagcctcgtgagttgatggaattacaggcgcccaccaccacgcccggttaatttttttgtatttttagtagagaggcggtttcaccacgttggccaggccggtctcgaact

SEQ ID NO: 22463 - DNA, 601 bp, Human
cctatacagtggatgaatgcaatcagtggtttacaggtatattttaaggttaaactttttttttttttttttgagacagagtcttgctccatcacccaggctggagtacagtggcaccatctaggctcacggcaacctccacctcccaggttcaagcgattctcctgcctcagtctcccgaatagctgagactataggcatgcaccaccacgccgggctattttttgtatttttagtagagccggggtttcaccatgttgaccaggctggtcttgaactcctgacctcaggcgatccaccracctcggcttctcaaagtgctgggattacaggtgtgacccaccgcacccagccaaggttaaactttttaatctgccatatcgaaatttaaactgtgtacacttttagatctagcaatcctacttttaagattctcacctgtggggatacttgctcaattataaaaagctacacatacgtacaagaatgctcactatggccttgtctgtaatagccaaaaaaaatggggggccaaggtgggtggatctcttgagcccaggagttcaagaccagcctgggcaacatggtgaaactcttgtct

SEQ ID NO: 22464 - DNA, 601 bp, Human
ctcccaccttccaccctggtccacaggaacctggtccacagcacttaacaagtcttacagacctggttatatatataaatctatgaaggcttctgcagcccttcaacccactgtaaagacttattcttcagactactcattagcatttaatcctatactaatttgcattttatttgactttccatgtatatgaatcttattttcaagaacagggactctgccctctctgtttttatttcttatagcctatacagtggatgaatgcaatcagtggtttacaggtatattttaaggttaaacwttttttttttttttttgagacagagtcttgctccatcacccaggctggagtacagtggcaccatctaggctcacggcaacctccacctcccaggttcaagcgattctcctgcctcagtctcccgaatagctgagactataggcatgcaccaccacgccgggctattttttgtatttttagtagagccggggtttcaccatgttgaccaggctggtcttgaactcctgacctcaggcgatccaccgacctcggcttctcaaagtgctgggattacaggtgtgacccaccgcacccagccaa

SEQ ID NO: 22465 - DNA, 601 bp, Human
gctctgctgaggctcctgagctgatggaaggcagccccatgagaagtttctgaaatacagagacagtgagagcactacttaagtagacgccggatcctaattctagtttgttacgactaatttcattactgaatgctcttatgccacagaaaggaaggaatcttcagaacataacttgtacccaaatctcagaaaaaggccactctgatcatcctctgattgtcaatacccatttttgaaacataacatctgatttatctttacacccagagcgttcaatgcccccaagctcaggtatgtkctggaaaagtgaagtaattttaacactaacccaggtaaacaataattaggaaggtacatttgcagtgttttacaaaaaggaataaaatataagttacttttagattatatataccactactctcaactgatgtaagctatagttgatatatgtatagttttatataatacatgggttcttgacaatgcctaatttttgaaacaaataaaattttagatataagccaagcttgtcatataaaggatccctgtgatcagaccttccgagaatcttcccataaagttaataaccatatttttg

SEQ ID NO: 22466 - DNA, 601 bp, Human
gaccatgtctcaggtttctttgtctatctcacaggtgcttgatacaacactgctcactatacactaagttactgctctgctgaggctcctgagctgatggaaggcagccccatgagaagtttctgaaatacagagacagtgagagcactacttaagtagacgccggatcctaattctagtttgttacgactaatttcattactgaatgctcttatgccacagaaaggaaggaatcttcagaacataacttgtacccaaatctcagaaaaaggccactctgatcatcctctgattgtcaatrcccatttttgaaacataacatctgatttatctttacacccagagcgttcaatgcccccaagctcaggtatgttctggaaaagtgaagtaattttaacactaacccaggtaaacaataattaggaaggtacatttgcagtgttttacaaaaaggaataaaatataagttacttttagattatatataccactactctcaactgatgtaagctatagttgatatatgtatagttttatataatacatgggttcttgacaatgcctaatttttgaaacaaataaaattttagatataagccaa

SEQ ID NO: 22467 - DNA, 601 bp, Human
ctagaaataataataatagctaaaatttgttgaggttgtatcatgggtcagacactatgcttagccctgtgcttatcttatcccttaatacccagtgtcaattaatagggaaaatctacacttaagaaaacagcatcaaatggtactttattctccctctctttcccaatttatggaattactcatttactaaatttgcctggccttcggcttctctctgttttgtcagagtctagtcatctttccagatgcagctccgggcccatgatctctgcaggcccttccctgactccaccagcaragacttctgctgcagttgctgtctgacctcgtttggctcttggtcatcatacaccaacctggatggtcttgtgggcctgctgtattttcccacctagactacaagcacctggggctgggaccatgtctcaggtttctttgtctatctcacaggtgcttgatacaacactgctcactatacactaagttactgctctgctgaggctcctgagctgatggaaggcagccccatgagaagtttctgaaatacagagacagtgagagcactacttaagtagacgccggatcctaattctagttt

SEQ ID NO: 22468 - DNA, 601 bp, Human
tacgggtgatcaaactggctgacagtattttggtcagagcaggatatgacagtttcttatttaattttgaaaactactgatgaaatctagaaataataataatagctaaaatttgttgaggttgtatcatgggtcagacactatgcttagccctgtgcttatcttatcccttaatacccagtgtcaattaatagggaaaatctacacttaagaaaacagcatcaaatggtactttattctccctctctttcccaatttatggaattactcatttactaaatttgcctggccttcggcttcwctctgttttgtcagagtctagtcatctttccagatgcagctccgggcccatgatctctgcaggcccttccctgactccaccagcaaagacttctgctgcagttgctgtctgacctcgtttggctcttggtcatcatacaccaacctggatggtcttgtgggcctgctgtattttcccacctagactacaagcacctggggctgggaccatgtctcaggtttctttgtctatctcacaggtgcttgatacaacactgctcactatacactaagttactgctctgctgaggctcctgagctg

SEQ ID NO: 22469 - DNA, 601 bp, Human
tctcgaactcccgacctcaagtgatccacccgcctcggcttcccaaagtgctgaaattacagatgtgagccaccatgcctggtctttaaatattttcagtggtggcaaatcttcatactccgaggtcggatttgatttgtggaaactgacaaaagttattctgaaccaaagctggcacatgaggtacgggtgatcaaactggctgacagtattttggtcagagcaggatatgacagtttcttatttaattttgaaaactactgatgaaatctagaaataataataatagctaaaatttgtkgaggttgtatcatgggtcagacactatgcttagccctgtgcttatcttatcccttaatacccagtgtcaattaatagggaaaatctacacttaagaaaacagcatcaaatggtactttattctccctctctttcccaatttatggaattactcatttactaaatttgcctggccttcggcttctctctgttttgtcagagtctagtcatctttccagatgcagctccgggcccatgatctctgcaggcccttccctgactccaccagcaaagacttctgctgcagttgctgtctgacctc

SEQ ID NO: 22470 - DNA, 601 bp, Human
ctgactacaggcaataagttgggaaagaagaaaggtttagatgcaaagggagcgaggaagtaaactgtggaaggagacatgagtaagcagaatgtctgctatttcacatatttctggtgcagtcatatatttactgtatcagatttccagagggtgtggctgttagtgtgtctctctactcccaggagccccatgtctatcaggatctaccaccgctccactggatgtgccactttgtccatcaaaatgctcaccatggatgtgattcagcatgagagaggtgggcagagtggggaaatgyagtgaaatcttcaatctgagccaaggctatagacgtgaagtgccccggagagtcgggctcccaaagaactccttccagcagcaatgacgacttggttctgtaagggacacaagacagaattcatggctcattcataacatctattgagttcctatggtagtccaggcatcatgctatgctctagaaatataaagatgaataagacactggccagatcccctggcttgaactcaaatgccactttccctttgtttacagaccgctttctcacatctataagttctgaaaaccgcagctaag

SEQ ID NO: 22471 - DNA, 601 bp, Human
ggtctggagctcaagatcagcctggccaacatggagaaaccctgtctctactaaaaaaatacaaaaattagctggtcgtggtggtgtgcacctgtagtcccagctactaggtaggctgaggcaggggaattgcttgatcctgggaggcggaggttgcagtgagccgagatcacaccactgcactccagcctgggctacagagccagcctccgtcaaaaaaaaacccagaacattagtagaaaaaacagtgaaatctgaataaagtctgtagtttagttagtcatgcaccaatgttaatttygtaatatgacatggtgatgtaagatgttatcattaagggagactgaatgagggactgtattattttacaacttttctataaatctgaaaatattcccaaatataaatttgtaaaaaatgaagaggaaacttacaggtttttaaaataccgaaagaaacataaccattttaaatgtaatgcgtagaccaatgtctagatccaaactaaaacaaactataaaaacaaacaaacaaacaaaatgcctgtttgagacaatcagactgaaggttagatgacaaagaattgctaattttgttggat

SEQ ID NO: 22472 - DNA, 601 bp, Human
tttccccaaacccataacctcagtctaatcatgaaaaaaacaagataaacccaatttgtagaggattctacaaaaatatctgaccagtgcttttcaaaaccgtcaagatggtaaaatgaaggaaacgactgggaaattgtcatggattgttggcaactatggaaacaggatgaataaatataatgttggatcgcgggatagtaaaaggacattagcaaagggccgggcgtggtggttcacacctgtaatcccagtactttgagaggcccaggtgggtgcatcacttgaggtctggagctcragatcagcctggccaacatggagaaaccctgtctctactaaaaaaatacaaaaattagctggtcgtggtggtgtgcacctgtagtcccagctactaggtaggctgaggcaggggaattgcttgatcctgggaggcggaggttgcagtgagccgagatcacaccactgcactccagcctgggctacagagccagcctccgtcaaaaaaaaacccagaacattagtagaaaaaacagtgaaatctgaataaagtctgtagtttagttagtcatgcaccaatgttaattttgtaatatgacat

SEQ ID NO: 22473 - DNA, 601 bp, Human
ttctttccccaaacccataacctcagtctaatcatgaaaaaaacaagataaacccaatttgtagaggattctacaaaaatatctgaccagtgcttttcaaaaccgtcaagatggtaaaatgaaggaaacgactgggaaattgtcatggattgttggcaactatggaaacaggatgaataaatataatgttggatcgcgggatagtaaaaggacattagcaaagggccgggcgtggtggttcacacctgtaatcccagtactttgagaggcccaggtgggtgcatcacttgaggtctggagytcaagatcagcctggccaacatggagaaaccctgtctctactaaaaaaatacaaaaattagctggtcgtggtggtgtgcacctgtagtcccagctactaggtaggctgaggcaggggaattgcttgatcctgggaggcggaggttgcagtgagccgagatcacaccactgcactccagcctgggctacagagccagcctccgtcaaaaaaaaacccagaacattagtagaaaaaacagtgaaatctgaataaagtctgtagtttagttagtcatgcaccaatgttaattttgtaatatga

SEQ ID NO: 22474 - DNA, 601 bp, Human
acatacttcacctctgtggcattctttccccaaacccataacctcagtctaatcatgaaaaaaacaagataaacccaatttgtagaggattctacaaaaatatctgaccagtgcttttcaaaaccgtcaagatggtaaaatgaaggaaacgactgggaaattgtcatggattgttggcaactatggaaacaggatgaataaatataatgttggatcgcgggatagtaaaaggacattagcaaagggccgggcgtggtggttcacacctgtaatcccagtactttgagaggcccaggtgggygcatcacttgaggtctggagctcaagatcagcctggccaacatggagaaaccctgtctctactaaaaaaatacaaaaattagctggtcgtggtggtgtgcacctgtagtcccagctactaggtaggctgaggcaggggaattgcttgatcctgggaggcggaggttgcagtgagccgagatcacaccactgcactccagcctgggctacagagccagcctccgtcaaaaaaaaacccagaacattagtagaaaaaacagtgaaatctgaataaagtctgtagtttagttagtcatgcacc

SEQ ID NO: 22475 - DNA, 601 bp, Human
catagtctggcagggaaaaaaaaagttaaagagaaagaaaaaaggagcctgaagtgatcatgcctctgggtccagctagtaatttatgggaagtacagagaatagaggagcatgttaaaataaaggtatcctcactttaccatgttacctcaaggcaacacctggagggtaagtaaaccaaatccagaatagggaaaattctacagggcagtttcttccaaaaataaatggcactagaaacaaacgtagacatctagcacccagatcttggctattaatacctttttttttttttttttttgagatggagtctcgttctgttgtccaggctggaatgcagtggggcaatctcggctcactgcaacccccgcctcccagttcaagcgattctcctgcttcagcctcctgagtagctgggacgacaggcacatgccaccacacccagctaatttttgtatttttgggagagacggggtttcaccatgttggtcaggctggtctcgaactcctgacctcatgatttgcccacctcggcctcccaaagtactgggattacaggtgtgagccaccgtgccggctggttaataccatttttctattg

SEQ ID NO: 22476 - DNA, 601 bp, Human
agtaattaaatagttaatgagtgacaagtactctcttagaagagaatcacagttcataaacataggtgaaatgatggaaattgaaagaattgccattttgtaatccctaacaatgatgatgatcaatagctagtaaaaccacaagttgaaaagaatatgggagaaactataatgtgtggattggggttgatatcacaggaacacaccgatgaaggtcggcatcactgaaaacgagacaacccctgatgtgatacaatagaagtgtgttcacagtatctcttctgacatagtctggcagggmaaaaaaaagttaaagagaaagaaaaaaggagcctgaagtgatcatgcctctgggtccagctagtaatttatgggaagtacagagaatagaggagcatgttaaaataaaggtatcctcactttaccatgttacctcaaggcaacacctggagggtaagtaaaccaaatccagaatagggaaaattctacagggcagtttcttccaaaaataaatggcactagaaacaaacgtagacatctagcacccagatcttggctattaatacctttttttttttttttttttgagatggagtctcgt

SEQ ID NO: 22477 - DNA, 601 bp, Human
gttctttttttgtttaacttatttagggttgagtttttattactgtaactaaaaatgttgactcataggtgagtaggaggggcagggtagaatgaagagagaagatttgacaaagggttatattgcatacatatataagacatccattcaaaacctatgaaataaatcaagaattacaaactcagaagcctatgggggttagaaaaatgacagacacaagtgaagttgagcaggttcaggggaccatgaatgtttttcactttcctcttaacagttagcaaacacaccctgaaacaagagrgcgaggtggggcagtccttattcagatccaacaattgctgccctgtgaaaatgagctcaggatcaccacatcttccaatttctaaagacaagtcagaaatcagaatttgcatatgaaaatgatgtcaactcatttagaaaattgtaaaacaccatgtggcaagttgtcataggcaaaaaataaaaacaaagaacaaacacaaaacgcataacccaacaactcacatttgcatctttggaggttgctagggcaacaacgcattattgtgaaaatttataatcaagcatttacctcgccttt

SEQ ID NO: 22478 - DNA, 601 bp, Human
cattaaagaagccagctaaatcccaccaaaaccaagatggtgatgagagtgacctctggtcgtcctcattgccacactcccaaacagcaccatgacagtttacaaaggctatggcaatgtcaggaagttaccctatatgatctagaaaggggaggcatgaataatttaccccattgtttagcatattatcaagaaataactataaaaatgggcaaccagcagcccttgggactgctctatagagtagccattcttttattcctttactttcctaataaacttgcttttgctttgcactgcwgactcgcctgaaattctttcttctgcaagatccaagaaccctcggttggggtctggatcaggacccctttcctgtaacattgggaggaagacacatgctgatgtctgcaactactttgaaacaattcagaaaaaaaaggaagggagaaagcaaatgtagcaaaatgttaacaattggtgaatttagttgaaaaacattcaacttggaggggtggggcagaatcaggatcataggcttggcttctgctacttgccagagtgggtgctcatggtgtgaggaaaggagcctcaatgctcccag

SEQ ID NO: 22479 - DNA, 601 bp, Human
gaccaggaattaaaggtgaagggagggggcagttcgttgatttcacttctgtgtagtatttacttcagaaagtaccccatgtaaatggggatatttatttgcatacttcaagcaggccaggatgcctcagatagtgtgaaggaagtagggaaagatgagaaggagggaaggggcaagggagagaaagaaagggggaggaagagattggaggggagaggggagaagaaagggatggagaggagctgttcaccgggatgtggaaggaactgctcacccccttcggccagcttttatggaactrttgaataagaagtgatttcctggcaatttcaactatttattccctcttgctttttttggttttaggatactgttctgaatgttcagtgtcattgaatacttttgcccttccacataaacagcagctcttaaaggaaaatcagtattagaggcagttgtttcattttcatactcaccatcctgcaacttgtacaactgttcttttgtttccagaaattcttcatcaaactaaatttttaaaaaagaaacgtatatatacatagtggaatattattcagccattaagaaaacaaaatcctgt

SEQ ID NO: 22480 - DNA, 601 bp, Human
ggtggctcctgctataatggatgggcaaggagggagcagggctgaccaggaattaaaggtgaagggagggggcagttcgttgatttcacttctgtgtagtatttacttcagaaagtaccccatgtaaatggggatatttatttgcatacttcaagcaggccaggatgcctcagatagtgtgaaggaagtagggaaagatgagaaggagggaaggggcaagggagagaaagaaagggggaggaagagattggaggggagaggggagaagaaagggatggagaggagctgttcaccgggatgyggaaggaactgctcacccccttcggccagcttttatggaactattgaataagaagtgatttcctggcaatttcaactatttattccctcttgctttttttggttttaggatactgttctgaatgttcagtgtcattgaatacttttgcccttccacataaacagcagctcttaaaggaaaatcagtattagaggcagttgtttcattttcatactcaccatcctgcaacttgtacaactgttcttttgtttccagaaattcttcatcaaactaaatttttaaaaaagaaacgtatatata

SEQ ID NO: 22481 - DNA, 601 bp, Human
ctttatgggtctgctggtggctcctgctataatggatgggcaaggagggagcagggctgaccaggaattaaaggtgaagggagggggcagttcgttgatttcacttctgtgtagtatttacttcagaaagtaccccatgtaaatggggatatttatttgcatacttcaagcaggccaggatgcctcagatagtgtgaaggaagtagggaaagatgagaaggagggaaggggcaagggagagaaagaaagggggaggaagagattggaggggagaggggagaagaaagggatggagaggagytgttcaccgggatgtggaaggaactgctcacccccttcggccagcttttatggaactattgaataagaagtgatttcctggcaatttcaactatttattccctcttgctttttttggttttaggatactgttctgaatgttcagtgtcattgaatacttttgcccttccacataaacagcagctcttaaaggaaaatcagtattagaggcagttgtttcattttcatactcaccatcctgcaacttgtacaactgttcttttgtttccagaaattcttcatcaaactaaatttttaaaaa

SEQ ID NO: 22482 - DNA, 601 bp, Human
ctaaggggtgcaaggaccaggctttgatttcaaattataatctaatgctcactctcccaggccttgaatgtcacagcagctcctcattcctaatacttaacaatagtgaatgtgcaagaaagggaaaaagcagtatcaaagcatttaaaaatgttgaaatctgaaacaatgacaccctagatatagtattcaatatctgaatcctattcttttgttttactcagactctctctactgaagttccaactggtcttcgtgaccttcttgggtttttgttccctgatctcactaactatgtaasacataaagtaaatgtggtgtgctacagaggttgctaatcagctaaggcatcagtaagctgacaagtgacaacactcgagaggggccacagtacagggttctctccttgaggttcttgccaaagagattgtgcttgtctgctatgtagtggagaatgcttcgggtctgtaccaacttcatcccgtcaatttcaaccatgggcacttgttggaacagcaggtggttacctgagaatggaagcccagagttagaagtgatcttttcttctctgtcccccaacccctaaaaaatgctctgtgga

SEQ ID NO: 22483 - DNA, 601 bp, Human
gaaatggttcttctactcatatcaaattatcagggaggatgtcagctgagacagctgttcgacaacttttgttgaatgaatgaatgaggtagtttttgttttctgtatcttctgaagtttctgctgtatccacacaaggtgggaacttggtgaatgcaaggaacaataaggaacaaaggcagggagcccatactttttctagacttctgaatcatgtggtcctagcagagtccaaggggctctaagacaccagctttgtgctgtggctactattcgctcttaggagtccattagcgcttakgttagttcaactgggctcagttttaaaatccttggacagaaaagggtgtttgtggcagcttctttgtggtttgtggtttggttgctctgtgtatgtaggcatctctgccacctaccttttcaaacacaggaaagtatctaattatagccttctgggccatgttaaccacttccttttgctgatcatctggttttaagaaaggatgcatgataagcagttccagcagatccagtgtcccctccacgtacatgtcaatccttaaaacaaaaaagcagttgtctcagtttctcctctctttga

SEQ ID NO: 22484 - DNA, 601 bp, Human
aaccccagaaaatacctctcctttttcctaaatctagttccataaagatggtcagaggaagcttgccaaataggtcttcccatattttcacaccctcttctttagtgtttgcattgaaacactaaaaaagttcctcccagttcaggaataaagaatttgaagctcagaaaagcagatataacaagaagagaaaaacaacaaaaccaaaaacaaaaagagcaaagggaagataaataaaatggaaatggttcttctactcatatcaaattatcagggaggatgtcagctgagacagctgttygacaacttttgttgaatgaatgaatgaggtagtttttgttttctgtatcttctgaagtttctgctgtatccacacaaggtgggaacttggtgaatgcaaggaacaataaggaacaaaggcagggagcccatactttttctagacttctgaatcatgtggtcctagcagagtccaaggggctctaagacaccagctttgtgctgtggctactattcgctcttaggagtccattagcgcttaggttagttcaactgggctcagttttaaaatccttggacagaaaagggtgtttgtggcagc

SEQ ID NO: 22485 - DNA, 601 bp, Human
acctagctacagaaaccccagaaaatacctctcctttttcctaaatctagttccataaagatggtcagaggaagcttgccaaataggtcttcccatattttcacaccctcttctttagtgtttgcattgaaacactaaaaaagttcctcccagttcaggaataaagaatttgaagctcagaaaagcagatataacaagaagagaaaaacaacaaaaccaaaaacaaaaagagcaaagggaagataaataaaatggaaatggttcttctactcatatcaaattatcagggaggatgtcagctgagacagctgttcgacaacttttgttgaatgaatgaatgaggtagtttttgttttctgtatcttctgaagtttctgctgtatccacacaaggtgggaacttggtgaatgcaaggaacaataaggaacaaaggcagggagcccatactttttctagacttctgaatcatgtggtcctagcagagtccaaggggctctaagacaccagctttgtgctgtggctactattcgctcttaggagtccattagcgcttaggttagttcaactgggctcagttttaaaatccttggacagaaaaggg

SEQ ID NO: 22486 - DNA, 601 bp, Human
gcctgtgggaaagataccataaaacctagctacagaaaccccagaaaatacctctcctttttcctaaatctagttccataaagatggtcagaggaagcttgccaaataggtcttcccatattttcacaccctcttctttagtgtttgcattgaaacactaaaaaagttcctcccagttcaggaataaagaatttgaagctcagaaaagcagatataacaagaagagaaaaacaacaaaaccaaaaacaaaaagagcaaagggaagataaataaaatggaaatggttcttctactcatatcraattatcagggaggatgtcagctgagacagctgttcgacaacttttgttgaatgaatgaatgaggtagtttttgttttctgtatcttctgaagtttctgctgtatccacacaaggtgggaacttggtgaatgcaaggaacaataaggaacaaaggcagggagcccatactttttctagacttctgaatcatgtggtcctagcagagtccaaggggctctaagacaccagctttgtgctgtggctactattcgctcttaggagtccattagcgcttaggttagttcaactgggctcagttt

SEQ ID NO: 22487 - DNA, 601 bp, Human
agggtgatttaagaaatctaagtgatagatcatcttcaaggggcccactcttatttcccagttctgctgctagaacatcaagaggtgtagtcataaactcaacccaattataaaattagacttcctcttacatgtcccaaaacagagaaaatgaaaagcttgagttcatcttgactcccattctgagggtaacgtataggtgtggggcttataagaatagattgtgattagggagaggcaagaagcagtagtagcaaaggggagatccccttcacagtcaactcttggatgcccatgggtrtctgcatgtgcacaagtgtgtgtgtcacagggactccgaacacaattccaggtcaaatatagctactggagccagagtggcatagtacaatgcatcctgaatttgtagtcagaggccagagttccaaccctgctctccattttctggccatgttaccttggacaggtcactgaatctcttcatgacttcatttcattatgtgtaaaagggacaacggttctcacctcataggcgtgttgcaagaaaccctgacacagtctgggcccttgggacctaagaatgagcagtgaacctttgcca

SEQ ID NO: 22488 - DNA, 601 bp, Human
agagtgagagagagggggagagagagagagagagagcgagagagagagagagaaagtacaaaaaaggtgtggaaatgaaagcatccttaaatatctgctgtggatctgaatgagacattgaagtggggaagggaaaattccttatttctggatttagcatctggtgttttgaaaggatatatctactccaaaaatgtatctacagaaatgcatgcaggaggcttggggaggggcagggtgatttaagaaatctaagtgatagatcatcttcaaggggcccactcttatttcccagttctgytgctagaacatcaagaggtgtagtcataaactcaacccaattataaaattagacttcctcttacatgtcccaaaacagagaaaatgaaaagcttgagttcatcttgactcccattctgagggtaacgtataggtgtggggcttataagaatagattgtgattagggagaggcaagaagcagtagtagcaaaggggagatccccttcacagtcaactcttggatgcccatgggtgtctgcatgtgcacaagtgtgtgtgtcacagggactccgaacacaattccaggtcaaatatagctac

SEQ ID NO: 22489 - DNA, 601 bp, Human
agaatcttaaaaatattacacatacacacacacacacactccccaaagccaaccaaacaatagacactgaaggaaggcccaagagttctaggccaatcttctaatacatagttttatttacctggaggaaaggaaatgcagacaggatattaggaattttctcttctagagctaaaatggtttggagtaaaatcacatctgcaaggctcagctgattaccaacaagaaagctttgtccgtgaccccttaaaatctgtagggaaatggtgtgcatcagttacaatattccacatggagagastgatgaggctattgaatcagtgcagtatctgagaagaggtgaaactatgaccttgtcatttcatgctttcataaataacatcaattaagagaacgcaccctatatctgacagagagagtgagagagagggggagagagagagagagagagcgagagagagagagagaaagtacaaaaaaggtgtggaaatgaaagcatccttaaatatctgctgtggatctgaatgagacattgaagtggggaagggaaaattccttatttctggatttagcatctggtgttttgaaaggatatatctac

SEQ ID NO: 22490 - DNA, 601 bp, Human
tttccaggagtgcagttatggaacaaaattaagatgaaaatttctgagctgggtgtgctggcacatgcctatagtccctgctactcaggagactgaggtgggaggatctcttgagcccaggagttcaagaccattctgggcaacatagtaagatcccaccttaaaaaaaaaaaattttacacttcaatgatctttcaacttgaaggatttaaggaccagaaaaataactttgggtccttactttcatttcatttgccaaactagaatcttaaaaatattacacatacacacacacacacaatccccaaagccaaccaaacaatagacactgaaggaaggcccaagagttctaggccaatcttctaatacatagttttatttacctggaggaaaggaaatgcagacaggatattaggaattttctcttctagagctaaaatggtttggagtaaaatcacatctgcaaggctcagctgattaccaacaagaaagctttgtccgtgaccccttaaaatctgtagggaaatggtgtgcatcagttacaatattccacatggagagagtgatgaggctattgaatcagtgcagtatctgagaagag

SEQ ID NO: 22491 - DNA, 601 bp, Human
ttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgccagaataaccctgagggataatttgaaccacacaagtctttccttggaattctcagaaggagaatggtaggaatcctttggggtgatgtttagggtgctaacatctytcatttgctctcagagctcaggcttagaatttcctaacttgagaccatactatttctgagaaagggagtcatagcctgatgaatgagactgttttgatgtttatctcgcccactattccatcagtagatacatgtgagtgtgagaccacctcatctctatggttatttctatggaaagtcccctgaggcaaactccctgtgcatggagttttttccaggagtgcagttatggaacaaaattaagatgaaaatttctgagctgggtgtgctggcacatgcctatagtccctgctactcagg

SEQ ID NO: 22492 - DNA, 601 bp, Human
cccaggagttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgccagaataaccctgagggataatttgaaccacacaagtctttccttggaattctcagaaggagaatggtaggaatcctttggggtgatgtttagggtgcyaacatctctcatttgctctcagagctcaggcttagaatttcctaacttgagaccatactatttctgagaaagggagtcatagcctgatgaatgagactgttttgatgtttatctcgcccactattccatcagtagatacatgtgagtgtgagaccacctcatctctatggttatttctatggaaagtcccctgaggcaaactccctgtgcatggagttttttccaggagtgcagttatggaacaaaattaagatgaaaatttctgagctgggtgtgctggcacatgcctatagtccctgc

SEQ ID NO: 22493 - DNA, 601 bp, Human
taaaaacaggtggcaggccaggtttggcccaggagttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgccagaataaccctgagggataatttgaaccacacaagtctttccttggaattctcagaaggagaatggtaggwatcctttggggtgatgtttagggtgctaacatctctcatttgctctcagagctcaggcttagaatttcctaacttgagaccatactatttctgagaaagggagtcatagcctgatgaatgagactgttttgatgtttatctcgcccactattccatcagtagatacatgtgagtgtgagaccacctcatctctatggttatttctatggaaagtcccctgaggcaaactccctgtgcatggagttttttccaggagtgcagttatggaacaaaattaagatgaaaatttctgagctgggt

SEQ ID NO: 22494 - DNA, 601 bp, Human
attccacagatttttttcaaccatttaaaaatgtaaaaattattcttaactcacaagctgtataaaaacaggtggcaggccaggtttggcccaggagttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgccagaataacmctgagggataatttgaaccacacaagtctttccttggaattctcagaaggagaatggtaggaatcctttggggtgatgtttagggtgctaacatctctcatttgctctcagagctcaggcttagaatttcctaacttgagaccatactatttctgagaaagggagtcatagcctgatgaatgagactgttttgatgtttatctcgcccactattccatcagtagatacatgtgagtgtgagaccacctcatctctatggttatttctatggaaagtcccctgaggcaaactccctgtgca

SEQ ID NO: 22495 - DNA, 601 bp, Human
tggcaagctttttccataaaggaccagtcagcaaatattttaagttctgcaggccatatggtctctatcagatctactcaactctgctgtagaaaaacaaaagtaaccttgacattgtgtaaatgagtgggcatggctttgtaccaatgaaatttatgaatactagaatttgaatttcatataatttttatgtgtcatgaaatattattccacagatttttttcaaccatttaaaaatgtaaaaattattcttaactcacaagctgtataaaaacaggtggcaggccaggtttggcccagaagttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgccagaataaccctgagggataatttgaaccacacaagtctttccttggaattctcagaaggagaatggtaggaatcctttggggtgatgtttagggtgctaacat

SEQ ID NO: 22496 - DNA, 601 bp, Human
gataacttggtcaaacatatagcaatttggtctgtatccaggctgtttcagggattggcaagctttttccataaaggaccagtcagcaaatattttaagttctgcaggccatatggtctctatcagatctactcaactctgctgtagaaaaacaaaagtaaccttgacattgtgtaaatgagtgggcatggctttgtaccaatgaaatttatgaatactagaatttgaatttcatataatttttatgtgtcatgaaatattattccacagatttttttcaaccatttaaaaatgtaaaaaytattcttaactcacaagctgtataaaaacaggtggcaggccaggtttggcccaggagttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgccagaataaccctgagggataatttgaaccacacaagtctttccttggaa

SEQ ID NO: 22497 - DNA, 601 bp, Human
gtatgtgtgttactctttggagagttagtgtatctctcttggcttttgataacttggtcaaacatatagcaatttggtctgtatccaggctgtttcagggattggcaagctttttccataaaggaccagtcagcaaatattttaagttctgcaggccatatggtctctatcagatctactcaactctgctgtagaaaaacaaaagtaaccttgacattgtgtaaatgagtgggcatggctttgtaccaatgaaatttatgaatactagaatttgaatttcatataatttttatgtgtcatkaaatattattccacagatttttttcaaccatttaaaaatgtaaaaattattcttaactcacaagctgtataaaaacaggtggcaggccaggtttggcccaggagttacagtctgcacattagacttggagataaaaggctaaggttctagataaaactcaagcatccactgcctaagccagcttggctgctgatttctttattctgggtctctacttcctcaagtgaatattgaagtcattaaatgagtttttttttaaaggcccttctctcctttaaagttctatgatcaatcctgcca

SEQ ID NO: 22498 - DNA, 601 bp, Human
gtgtgtctatgtgtacacaagcatgtatatatatgcatgcctggaaagatttcactttgtttttttttttgagacacagttttgctctgtcacccaggctggagtgcagtggcatgatctcggctcactgcaacctccacctccccagttcaagtgattctcctgcctcagcctccgagtagctgggattacaggcacatgccaccatgctcagctaattgttttatttttagtagagatggggtttcaccatgttggccagactggtcttgaactcctgaccttaagtgatccacccacytcagccacccaaagtgctgggattacaggtgtgagccactgcgcccggcctagatttcacctttaataagcttagcattctacctacttctgggttcagcatcccacctatttggggccaaaggtacttctagtacttctaaatgtgtttctcagaaaccacacagtctagtggaaagagtacagacttagatccctgactcccctgtggctcccaactcagtcatccacagtcttgcaactatgcagaatgtaatgtttccaagctggtaattttcatctgtaaaatggagatagtgaa

SEQ ID NO: 22499 - DNA, 601 bp, Human
tgatcacagattaaaactgtatttacgcagataatgcttggggcttaaaaaagggttgttattatagtatcatcaatgtaaaataccaataggtcctggtgctacagtttaccaaaaaaccttgatctctatcatttaccctagacttttaaaatcttttgtgtccattcaatgaaaagtactttactgcctgtgaggtgtgtgtctatgtgtacacaagcatgtatatatatgcatgcctggaaagatttcactttgtttttttttttgagacacagttttgctctgtcacccaggctgsagtgcagtggcatgatctcggctcactgcaacctccacctccccagttcaagtgattctcctgcctcagcctccgagtagctgggattacaggcacatgccaccatgctcagctaattgttttatttttagtagagatggggtttcaccatgttggccagactggtcttgaactcctgaccttaagtgatccacccacttcagccacccaaagtgctgggattacaggtgtgagccactgcgcccggcctagatttcacctttaataagcttagcattctacctacttctgggttcagca

SEQ ID NO: 22500 - DNA, 601 bp, Human
attctgaagttttaaaatattgatgctcaatctgatcacagattaaaactgtatttacgcagataatgcttggggcttaaaaaagggttgttattatagtatcatcaatgtaaaataccaataggtcctggtgctacagtttaccaaaaaaccttgatctctatcatttaccctagacttttaaaatcttttgtgtccattcaatgaaaagtactttactgcctgtgaggtgtgtgtctatgtgtacacaagcatgtatatatatgcatgcctggaaagatttcactttgtttttttttttgagacacagttttgctctgtcacccaggctggagtgcagtggcatgatctcggctcactgcaacctccacctccccagttcaagtgattctcctgcctcagcctccgagtagctgggattacaggcacatgccaccatgctcagctaattgttttatttttagtagagatggggtttcaccatgttggccagactggtcttgaactcctgaccttaagtgatccacccacttcagccacccaaagtgctgggattacaggtgtgagccactgcgcccggcctagatttcacctttaataa

SEQ ID NO: 22501 - DNA, 601 bp, Human
gaaaaacattgtatttttcattcacagaatcaaatcttaccaattctcagtaactgagaagaaaagcccatttgatctaatgaaaaatctgaactatatgaagaagcatatgctcatcatatataattattctaataaaaccttttaaagatatttaaataaaaccatttatttaaaagtgaagaggtcattttaaatagctactatttattaattgcctattatgtgcaaggcacagccttaattaagcacacacacaaacatacatacgtcactaatagtaacaaaaaccctaataatkatgccaattaattatatataaatatgacaattttctcttttcattacgtacttaagctctacttgtatgattttaaatattataccaaaatttagaatcttgttccaaatgatgtattgtttcaagatttatctggggttcatagttatcaaagtatagtaaaatttttgtgactttttaaatccattaatcaacacaggaataaccctttaaattcaacacagatctggtgtccgattctgaagttttaaaatattgatgctcaatctgatcacagattaaaactgtatttacgcagat

SEQ ID NO: 22502 - DNA, 601 bp, Human
taacagtagtcaatttgaagcagtgggagtggggaaggaacaaagaaatctgtaactggttgtgatcaattagctgtaaacaccactcggactagccacctgaagtgcactgatctgctgggagaaaatgcatgagccacttaagtaaaggtgctttaaaaagtcactagatggtacaatttatatcttaagattcagcttcttcagagtttttactcctatcagtaagtgaatcctctttctggctatgtgcaggaaatagccagttgcatttttttcatagcctctggctcagataccrgatatttatataaactggaatggaagaaaaacattgtatttttcattcacagaatcaaatcttaccaattctcagtaactgagaagaaaagcccatttgatctaatgaaaaatctgaactatatgaagaagcatatgctcatcatatataattattctaataaaaccttttaaagatatttaaataaaaccatttatttaaaagtgaagaggtcattttaaatagctactatttattaattgcctattatgtgcaaggcacagccttaattaagcacacacacaaacatacatacgtcac

SEQ ID NO: 22503 - DNA, 601 bp, Human
acttaaggtgaaaaaaaaggaaggggaaaactcactgaaaacacctccagtgtattgttttgtattgttttttaacagtagtcaatttgaagcagtgggagtggggaaggaacaaagaaatctgtaactggttgtgatcaattagctgtaaacaccactcggactagccacctgaagtgcactgatctgctgggagaaaatgcatgagccacttaagtaaaggtgctttaaaaagtcactagatggtacaatttatatcttaagattcagcttcttcagagtttttactcctatcagtaartgaatcctctttctggctatgtgcaggaaatagccagttgcatttttttcatagcctctggctcagataccagatatttatataaactggaatggaagaaaaacattgtatttttcattcacagaatcaaatcttaccaattctcagtaactgagaagaaaagcccatttgatctaatgaaaaatctgaactatatgaagaagcatatgctcatcatatataattattctaataaaaccttttaaagatatttaaataaaaccatttatttaaaagtgaagaggtcattttaaatagcta

SEQ ID NO: 22504 - DNA, 601 bp, Human
tgcaaaatggcccaccaaaatttgttcaataaatacttgttgaagagttccaagcagaaatgaaatttagcatttgtttagcaggggtgtccaatcttttggcttcactgggccacacataaaatacactaacactaaaggtagctaatgagctgaaaaaaaaacctcaaaatatctcataatgttataagaaagtttatgaatttatgttaggccacattcaaagttgtcctgagccacatgcagcccgcgggctgtgggttggacaaggctaggttaagatctgatctctatgattatwtacaatctctgtcatcaatcaccggtatcaagatcagagtttacacaaatctccaggttcacaaaaaggtaagcactctttacagaaatggcaaaagtaaaaacatactcaaaatagaattatgacacttaaggtgaaaaaaaaggaaggggaaaactcactgaaaacacctccagtgtattgttttgtattgttttttaacagtagtcaatttgaagcagtgggagtggggaaggaacaaagaaatctgtaactggttgtgatcaattagctgtaaacaccactcggactagccacctg

SEQ ID NO: 22505 - DNA, 601 bp, Human
gcaccatgacagagctgggatccattaagacatgactgtagacaataccatctctaggaacacactgtcactcacacatggatgtgttgttttatggcctaaagatgttgtagacggttctcacataaatttcatcagggggaggcttcttcttgctgccaggttcaaggaatctcttaattgtagggatattacttagtttcactgtgtattcctgaaaaaggaaaaccaaaactttaaggctaacaaaaaaggtattagatactacgaagatatggttatgcaaaatggcccaccaaartttgttcaataaatacttgttgaagagttccaagcagaaatgaaatttagcatttgtttagcaggggtgtccaatcttttggcttcactgggccacacataaaatacactaacactaaaggtagctaatgagctgaaaaaaaaacctcaaaatatctcataatgttataagaaagtttatgaatttatgttaggccacattcaaagttgtcctgagccacatgcagcccgcgggctgtgggttggacaaggctaggttaagatctgatctctatgattatttacaatctctgtcatcaat

SEQ ID NO: 22506 - DNA, 601 bp, Human
gtcatttactagacattcggttgttattaaacactaaaaattaggcagagactggaggggataaggataagagaacaggataaggagagcagaaagacgctcaggagagtagaaagacactcaggagagaacaagagatcctgcccattcttattatgaggatgaactggctacaggacatgagtagcccaatcagatctaacttaaataccagcctctccaaaaaagttttccaataaagatcccctaacaattatttactggacaaaaaaggttgatatttctagaagagatgatctckttgacacaaaagacccaacttaggacccaacttaatacatagatagcaccatgacagagctgggatccattaagacatgactgtagacaataccatctctaggaacacactgtcactcacacatggatgtgttgttttatggcctaaagatgttgtagacggttctcacataaatttcatcagggggaggcttcttcttgctgccaggttcaaggaatctcttaattgtagggatattacttagtttcactgtgtattcctgaaaaaggaaaaccaaaactttaaggctaacaaaaaagg

SEQ ID NO: 22507 - DNA, 601 bp, Human
cactccagcctgggtgacagagcgagactccatctcataaataaataaataaataaaatgcaaggtcaaaagaaataatctcctataccaaactaggtactcacaaaaaaattttttaattgaaaataatctcctttgtgtaggacaaaagttcactgttcacccaggcctagctaacacccaaccgtgcccagcattggcaggtgccctcctgccatggagacccacactcccacaagtctcggactgtgacccccatgtcatgaaggcccctcatcctacagaccaaaacttcctgacygggcaggcagcacagaccggccactgagatgcgtggaggcacctggggtacaccccggtcacaaccctggtcacaacccccaggtcacaaccccaggtggggaaagatgcaggacggaggctgtctacctggagcaggtcgctgaggtccaggagcatgtctgcagcaggagtcaaggatcctgtcgagtggctgcaagctcaggttactcgcccaccttcaaatgggcaggaccgcaggactgcacctgcagggagctggagtcgcccctccaaatataagctccacctttgatcagga

SEQ ID NO: 22508 - DNA, 601 bp, Human
tcttgctctgtcgcccaggctggagtgcagtggtgcaatctctgctcactgcaagctctgcctcccgggttcacgtcattctcctgcctcagcctcctgagtagtcaggactacaggcgcccaccaccacgcccagctaatttttttgtgtttttagtagagatggagtttcaccgcgttagacaggatggtctcgatctccagacctcctgatctgcccgcctcggcctcccaaagtgctgggattacaggagtgagccaccgcacctggccgcagttttttgtttgttttcttgagacrgagtttcactcttgttgcccaggctggagtgcaatggcgcaatcgtgactcactgcaacctccacctcaagggttcaagcgattctcctgtctcaccctcctaagtagctgggattataggcatccgccacaacgctcagctaatttttgtatttttagtagagacggggtttcaccatgttggccaggctggtcttgaactcctgacctcaggtgatctgcctgcctcagcctcccaaagtgcggggattacaggtgtgagccaccgcgcccggcctaaatacatgcagttctttacag

SEQ ID NO: 22509 - DNA, 601 bp, Human
gaacactgcaagtgaggaatctccaaagggcctttacatggaaactcacgtttaaaaagccatgtgtgcaaaacgcgtgcagtttttttgttttagtttgtttgtttttgagacggagtcttgctctgtcgcccaggctggagtgcagtggtgcaatctctgctcactgcaagctctgcctcccgggttcacgtcattctcctgcctcagcctcctgagtagtcaggactacaggcgcccaccaccacgcccagctaatttttttgtgtttttagtagagatggagtttcaccgcgttagmcaggatggtctcgatctccagacctcctgatctgcccgcctcggcctcccaaagtgctgggattacaggagtgagccaccgcacctggccgcagttttttgtttgttttcttgagacggagtttcactcttgttgcccaggctggagtgcaatggcgcaatcgtgactcactgcaacctccacctcaagggttcaagcgattctcctgtctcaccctcctaagtagctgggattataggcatccgccacaacgctcagctaatttttgtatttttagtagagacggggtttcaccatgtt

SEQ ID NO: 22510 - DNA, 601 bp, Human
agggaccgcacacaaagggtcctgtctgcgctagaggcaagagacagaggcaagagccagaggcagcgcttgtgggggatgcctctgatcagggaccctgcccgctgggagggctgggcccccacagcagctcctcctggtcaccatccaccccagtggggcgcagcttccatcttctccattatatccgagggctccatcacaagggctggtggctcacagagtgtgccttctgaaggaatttcccctcctcacagtttctgggggttccagggatccctggggtctgctcaccaaactrgggggcgtgtcagcacatgtagtgtgtgtgtgcatccgcatgcagtgtgcagacatgcatgtgtgtacacacgcatacagtgtgtctaggtgtgactcacgcatgtcatgtatgagtgccccagcccctgtgctgggttcctgccaggcccctgcatcttgatcgtcctgatcccaccatctctctttaagccacagcagaaccatgatctgctgctggcctctgcctgcccacctcaaactccacaccccccaaccttgtgtcccagagacacagggatcaatgagacctgaacactgc

SEQ ID NO: 22511 - DNA, 601 bp, Human
gagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagcsgcaccccagaagtaggcaacctggggtcaaggccgctctgccctgagagttctgccccttatgccaggacacgcagaggccaacggggcagccaggaggtcctggagggctgaggaccccggtgggccaggccagagtcagccccgggaggctggaggcagctctcagtgctctgcaaacatacggcccagcccaccagcactcaggagtcaggaaagtgtgaggccaggacccagaccagcatcccccaggcaggcagggcccgctgtacctgctccgcagaggcccgaggggcgccgg

SEQ ID NO: 22512 - DNA, 601 bp, Human
gtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactrtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacgggcagggatgcccatgcagccgcaccccagaagtaggcaacctggggtcaaggccgctctgcc

SEQ ID NO: 22513 - DNA, 601 bp, Human
ccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgrcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactatccgcgtagtcgcccagctgggggcgggggacagcctggcagccctgtggcaccctcaggagcaacaacctagcatctcaggagagagaggccacaccactgtccgcgtcagaagccgggccccacgagaccacg

SEQ ID NO: 22514 - DNA, 601 bp, Human
cgtagtcgcccagctgggggcgggggacagcctggcagccccgtggcacctcaggagcaacaacctagcatctcaggagagagaggccacaccactgtccgcgtagtcgcccagctgggggcgggggacagcctgacagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactrtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgacagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccaca

SEQ ID NO: 22515 - DNA, 601 bp, Human
caccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcacctcaggagcaacaacctagcatctcaggagagagaggccacaccactgtccgcgtagtcgcccagctgggggcgggggacagcctgacagcccygtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctgac

SEQ ID NO: 22516 - DNA, 601 bp, Human
cccgtggcaccctcaggagcaacaacctagcatctcaggagagagaggccacaccactgtccgcgtagtcgcccagctgggggcgggggacagcctggcagccccgtggcaccctcaggagcaacaacctagcatctcaggagagagaggccacaccactgtccgcgtagtcgcccagctgggggcgggggacagcctggcagccccgtggcacctcaggagcaacaacctagcatctcaggagagagaggccacaccactgtccgcgtagtcgcccagctgggggcgggggacagcctgrcagccccgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggacagcctggcagccctgtggcaccctcaggagcaacaacctagcatctcaggagagagaggccacaccactgtccgcgtagtcgcccagctgggggcgggggaca

SEQ ID NO: 22517 - DNA, 601 bp, Human
ggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggactctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcrgcgcagggatgccggtacctggcctgccgggtagagtggactctgtgggcacgagggtaagggcccggatgaggagtgagggccctgccgacctggggctccaattccggagttggggtagttgaccaggccacggccacatccacccaccagcaccaagggcaaagtgagagtctgagtgacagctgcgacctggggggtcacagaggtccaactagaacagtcgcccagctgggggcgggggacagcctggcagccccgtggcaccctcaggagcaacaacctagcatctcaggagag

SEQ ID NO: 22518 - DNA, 601 bp, Human
cggctgggaaccagggcaacatctgtggcggcccaggacaacactgcggatcccggtcacggagatgatggcctgagaagacgtgtctgtgccaggcagtgagaccctcacttggcatggctactcctgaacgacatgaccctctctatcttattgtgggtggcggctgcacccattccattttcaaatcaaggaaaattaaaatgaaggcttccgagagcttcacgtaatccctcaaagcaaacaaactaactctaagatgactgtgcgggaaacacagcttgtgatgggagctggggaytctgaggatgcggagccaggctgggcaggaaaggggcgaggccacagctggcagctgacacaggttcaccaaggccacagtgggcccagaacctccagtgcaaacatggagatcatgtgtgcagatggaacggcttctcaggtggactgaatcctgcagcgcagggatgccggtacctggcctgccgggtagagtggactctgtgggcacgagggtaagggcccggatgaggagtgagggccctgccgacctggggctccaattccggagttggggtagttgaccaggccacggccacat

SEQ ID NO: 22519 - DNA, 601 bp, Human
tcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatasctgaactgtgcttgtcggatgttcctccacggggcctggcactcaggccttgcccctcggcgcccaggtcccttctggcggcttctccacccctacccgatcctgcccggacctctgctcactaggagaaaggcccacaggcaccctcatccctcacaagagaaccccaatcctaggcggaagactcagaaggcctgaagagaggaggctgggctagaacctcagcacctggcagtcgggcaggaaggggccctgcaggcctgtgagccatggggctcagttcttacgaacgcctctaca

SEQ ID NO: 22520 - DNA, 601 bp, Human
ggattgcttgagtccaagactttgagaccagcctaggcaacacagtgagactctgtctctacccaaaaaaaaaaaaaaaaattagccacgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggcygaagtggtaggatcacctgaggtcaggagtttgagaccagccaggccaacacggtgaaaccccatctctattaaaaataacaaaaattagctgggcatggtggtgggagcctgtaatctcggctactcgggaggctgaggccggagaatcgcttgaatccaggaggcggagcttgcagtgagccaagatcgtgccactgtactccagcctgggcggcaagagcgaaaatctgtgtcaaaaaaatgaataaataacaataaaaacaaatacctgaactgtgcttgtcggatgttcctccac

SEQ ID NO: 22521 - DNA, 601 bp, Human
cttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccacgcatggtggtacacacctgtagtttctgctmcttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaattagctgggcatggtggtgggagcctgtaatct

SEQ ID NO: 22522 - DNA, 601 bp, Human
agggggggtcgcactcctcctccaggtcgatcttcatgaactcatcaatggtcaactgactggtgggggtgtcttcaaattccgtgagcctaaaatggagccagacatgggaaatggagctggtggctctgaaaccagctgtttaaaactgagctttcgcctgggcgtggctcatgcctgtgatcccagtgctttgggagcccaaggtgggtggattgcttgagtccaagactttgagaccagcctaggcaacacagtgagactctgtctctacccaaaaaaaaaaaaaaaaattagccasgcatggtggtacacacctgtagtttctgctacttgggaggctgaggtcagggagaatcgcttgagcccaggaggttgaggctgtaacgagctgtgatagcgccactggcctccagcctgggcagcagagtgagattttgtctcaaaaaatacataaaaaataaaaggccaggtgctgtggctcatgcctgtaatcccagcatgtgggaggccgaagtggtaggatcacctgaggtcaggagtttgagaccagccaggccaacacggtgaaaccccatctctattaaaaataacaaaaatt

SEQ ID NO: 22523 - DNA, 601 bp, Human
tggactcaccatcttttgccaggctggccaggccccccttggcctttggccggctgttttctagttcaatctcaattgcatcctggtaactggatatttcacctgaagtcataagttaaaagcaaaaagtcagcataaaatcaattttcccaacaaaacagaagcattacatgggaagattggttggttaccttcaacctcctccagtttttttgacaggacttgttcaagctgaaagggaacagggcaagaggcttcgtgaagggaggccctggtgcacagcgcagcctctggggtgccscgtgggccccagggaccacaggctgctagaacttaggggtacgcagcgatggaggtggagctatgggcctgtgtcccccatgggaagaggtggcacttcccagagtctgtgtgaggggcatcccggagcctcgggctctggctggtcatagcactgaagagcggctatgaggctttgggatggcaccagctctgctacaaccccagtcggggtgtgtggcttccccccaaggctggcaagcccagcacagacagacaccaaagccggcgctacctgcttcatccgcagcttcctctgccc

SEQ ID NO: 22524 - DNA, 601 bp, Human
tggtgagctgagattatgcaactgcactccagcctgggtgacagagtgagcctgtctccaaaaaaagaaaaagtccatgtgtaactgctgctcaccagagtgtatattcaaggcaatgggatatgtccaccctggctgcaatcctcaagcttgacccaaataaattatgtagattacttttgcctctgcttcttcctttaaggttggcaaaactcatcttaaaacatcccactctggattttgtgtgtgtgtatactggggacagggtctggctctgctgcccaggctggaatacagtggygcaatcatagctcactgcacatcgaactcctgggttcaagtgatcctccggcctcagcctcccgaggagctgggactacaggtgcacactcccacgcccagctaatttttttattttttgtagagatggggtctcactatgctgaccaggctggtcttgaactctgctcaagcagtcctcctgtatttgcctcccaaagtgctgcgattacaggcatgaaccaccatgcttgacccactccctagtcttagactgctttcttctgaatgtgttccaatacaagattcctggctagcactg

SEQ ID NO: 22525 - DNA, 601 bp, Human
ggtggtgaccaagggcctgtggaccccgtgggagccacagatctgtgggtcttcttggttgtcactatggcttcacaggtgtgtgcagacatcaaagttcagaaatcaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacscaataatgccgcacccaatagtttaacgatgtacagccaatcacgaatgaacgttactattgtaagccaatgagaattcccaacagacaactttgtatctatccaatcactgtccctttttgcctttaaaaatccatctgtagctgaggctggctcactcctgtaatcccgcactttggcgggccaaggtggacagatcacttgaggtcaggagttcgagatcagcctggccaacgtggcgaaaccccgtttctacaaaaaatacaaaaattagctgggcgtggtggcgcatgcctgtag

SEQ ID NO: 22526 - DNA, 601 bp, Human
gctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtgaaaaaagtagctcactggtggcctggggcaggagggggggtggtgaccaagggcctgtggaccccgtgggagccacagatctgtgggtcttcttggttgtcactatggcttcacaggtgtgtgcagacatcaaagttcagaaatyaaagggcacattttaaatatgagcagttttcatacggcaatcacacctcaataaggctgttaaaaatcacccaatggtaaatttaaaagactgagaaaagaactttcacgggaggaatgtgactcctcctccttgagctacgtgttcatttcttgaaaccacttgctgttgccacaagtagctctaaactaacgcaataatgccgcacccaatagtttaacgatgtacagccaatcacgaatgaacgttactattgtaagccaatgagaattcccaacagacaactttgtatctatccaa

SEQ ID NO: 22527 - DNA, 601 bp, Human
agcaagatcctgtctctatgaagaaatgtaaaaattatctgggtgtggtggtgcccgcctgcagtcccagctacttgggaggctgagatgggagggttgcttgagcccaggaggttgacactgcagtgagctatgatggaactattgcactccactctgggtgacagagtaagaccgtctcaaaaacaacaaaaaaagacatacacacttgcctttcacataacccagcaatttcactcctcagcaattgacccaaaaggaaatcaacgtccacacaaggacttgtacacgagtgttcacragcgcatctgaaacagcctcaaacgtgcaatgtcctctaacagatgaatggctacacaccctcagcgtgctgaaggactaccgactgccacacaatacaaacgaacaaaccattgatgcgtgactcaacacacaccctcagcgtgctgaaggactaccgactgccacgccacaacacaaatgagcaaaccattgatgcgtgactcaacataattacactgtgaaaaaagccgaagggaaaaacatatactatgtgatcctactcctacggaattctacagaatacaactaatttatcgtg

SEQ ID NO: 22528 - DNA, 601 bp, Human
cacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcagggaccccagggcyggaggtctgccgccccactcggggcttcctgctgcttccgagctgccgggggcaccaccaaggagctcccggtataagtctttgttcaggtggctggccgcggcttccagctcctcgtcctctgtgtcctcctcgccacacaagctggacgcggtgtcctcggtggagcctaggtgtacacaatccacctgttaaccaggcagagggccagggtgcccgcttttgtgacaaaaaacaatgctaccaagctgccaggtaacccatagaacggctgtcagtgcacggtgcctggcggtcagg

SEQ ID NO: 22529 - DNA, 601 bp, Human
gcctgtcctggcagggatgggggatgggacccacctttctcctagagctcccagccaaatgggcaaggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattcyggcgtcggcacacacccaattcttcacgccaggaccactgacgcccacacagccccattggggggactggtggtgccaccacccaagcccaccgcccgagaccaccacacctcccgacagaggatggcagcatccggctctccccatgagaggcacacgcctgaaagatctcccgatgacctcagcgtcccccagggccccatcagaactcactggggtcgctgctctgagaggagatgcattcgcggatggagtctgagatgcccaggctggctgcagtggggagggggtccagcaggg

SEQ ID NO: 22530 - DNA, 601 bp, Human
gccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatgggacccacctttctcctagagctcccagccaaatgggcarggtgagggggggcaagatgggcacggtggcctggcctgggcactatggggcaggggtgcctcgtcattgccacgcccaagctcagcaagtgacgttcccccgaccatgttggacaagcggatgaggggtggagctgccccatgggactcctggacacaacttgtgggctccattctccgtggcccctgtgacctgaaggcggtcccagtgagggtgacgagactcactgcattctggcgtcggcacacacccaattcttcacgccaggaccactgacgcccacacagccccattgggggg

SEQ ID NO: 22531 - DNA, 601 bp, Human
gagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgaggccagagacggctcctctcagcactcacaggcagcccttcctcagcyccagccagaatggccctttctgctcagggtcactgtgccgctggctgccccagggcctgtgcatgtcccctctgcctgttgctctgtgtgactcgcctgggttccacccacacagcagccccaaccatcaggattgtctctaccccggcccagatatcacttgataaacattcgcctggctcctcacacagaggccaggccctggtgcccgacgggaggcagggcttgagggtgaagcgttgcaggaaggtctaggctctcagccagggaagcctgtcctggcagggatgggggatggga

SEQ ID NO: 22532 - DNA, 601 bp, Human
tgggtctgggctaagggctttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcagrggagccagctccccatcactgagcccataggtctggggatagaaatgagggaatagaaatgattccggagtccaggcctgagggagccctccatgatcatgctcaggacaccccaaaacctgcctgtcacccctgcccagccccacgcagtccaggcagcatctgcacagcctggaattgggacagcctctccttgccacagccccacgccatagctgcctgccccgtgctgccaagtcaactccagcacagggccagactgtctgaggtgctctcctgccatgctgctccagggccgag

SEQ ID NO: 22533 - DNA, 601 bp, Human
gccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagctcaccgtctcctgaagcatcttctggagggaagcacagcatccgcgtcactcagggccagcactgattataggagcgtggccaccacctgggctggctcaggaccctgggtctgggctaagggcyttctagaaccccgtcccctcctctgcactggtgggtcgcgccctgtctgcccacatgaccgcacctctttaaatgcctagctcaggacactaagcgaagccagcagaacactgaactgaagctgcaaaggaaaaccccagcacttctgtgctttttgtaaaaaagcaactttttaagaacaggagacagaggctgtcaggccccaaagaccgagggagggcacggaagctgggcaggaaggaaaggtcaggccacggagtgagatgggggtctgtgctcaggggagccagctccccatca

SEQ ID NO: 22534 - DNA, 601 bp, Human
cagagtgcaggccacaggtccccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgcygcaggctatgtgccgagggccgcaaggaccaggcgcaaagccaggggcctctcgacaggccgcccccgagccgacactggagaagagagtgtgggggggggtcccgggaacagtggccagaaggccaggagcccacttcacccagcggggtgggctctgggcaggggaggtggccaaccccgcccgaccactcagggctccttgggctgcagcgccctcccaagcccagcccctcttgggaaggggtgctgccacgtaccctgtcaatctccaggtcatcaatgccactgaggtccagct

SEQ ID NO: 22535 - DNA, 601 bp, Human
atgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagaccctctagggcagcttgcaagccctgccggcaccaggaccctggccagccagagtgcaggccacaggtycccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacccctcgaggggctgcccctggtgctatttgtgcgatgtgtgcctgctgcaggctatgtgccgaggg

SEQ ID NO: 22536 - DNA, 601 bp, Human
gcaggtactcggcgttctccctcatccacagctcggccttcacgcgggcttccgactcattcaggatgtactgggcgagcacagggaagtggggctggcttttagccttcgcacaccggggcatgctaaggtcgcgctggccagcgggaagtatttccaccgttagaggaaggggaacccggggcagcctctatttagtgcggagcctgggctgaggcctcatcgcgcggggcgagttggggacctgttgctctgtggcctgtcccaaggccaaccacgcaggccacatgtgtgagacccyctagggcagcttgcaagccctgccggcaccaggaccctggccagccagagtgcaggccacaggtccccacaaaggggccaagtgagggtgagagcctcccactcaggtacagatgggccaggctggaggggtctgaggcaccacgtggccatgaaatcagggaagacgacttcctgcctgacagagggcaagtatattgagataaactgcaaagagctggtcccaatggctggaagccctggggtttgggggcgcacagcgcatgtggagtcagtgggtgccctcttgtgtctagagacc

SEQ ID NO: 22537 - DNA, 601 bp, Human
ccctgctgcccctgggtcccacacagggcagggccacatgcacacggcagggcgatgtgctgctgcactgtgagggctgcagcagagatggctactcagtgaagacagacaatccaccccagcaccgctgcccacgtcaaaggccccagctgcccgaagaccctggatctccttctaggagctggagccatagaccacttcagggcaatcagcctgcaccacccctgctgccccccgctgcacgatgaccttcctgcgtggcccagcaaggcctgggacgtgctgctgggtggggtggagyccctgggctcctaactctctgaccacaagctccccgggtcctgctgagcgggtaggccccacatctgccatcccagccacctccagcttcgtctgagggaccccagtctcgcaggcagggaactggctccccgtgttttctcctgctcagtcactcagaggctcaaccactgctgcctgcaccacgaggctgaaggcacattccgccagagagtaagctggcagagcaagtcaccgtgacggccacaaggcagggaggcatgacagtcggactttcccagggcgtcagaagagcaaaccc

SEQ ID NO: 22538 - DNA, 601 bp, Human
aaaggccaaggagaaaccaccgcaaataccgcaaacaacaggaggccctgacggggctgccgagagtcagcactgccccacaggcggaagcagctggagacaacgcaagagatcccaagaagcagtaggaccagcagacacacccagcccggagactcggtggggtggagtgaaggtcggaaccaccaaagggtggacccagaagctaagccgccaaccccatctccactgccagagggacacatggaccagccacaggcccccaagacgcagcaggtgagcccagctgcccatggcctcstcaggagagcctgcagccgccacccagcggcaagctgtgcacagaggccgacccactccaaggcggccctgcatggagctgcagagcctcgtgaccctgtgcgctgaggccagcacatcccgcctttgacgtccctcagccacgttctccacccacatcctccttcctcagcagtgtgctgctctcacccatcacctcagcagagacggcaatgcagccagggtgcgcagagcaggcacagggcggcagggctggggactcttcttcccgaacccaggctggagaaggcaccgaccccac

SEQ ID NO: 22539 - DNA, 601 bp, Human
gacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacaccygggccctgtctgggccagctggtcagatgtgacagagggggctgtgaaccctgtcaccaggcaccagaatcacccaactgggacaggacccccacctccagcgctgacagaggctggctaggcaggcagaggacacggagactaaagcctcagatcggacctgggagtgctcaggcacaggggaaccgagccacagacctgccctgacttcacctctgccccactgacctcctacgcatgccaggagctgtgctaggaatgcacccccagaggaccagtgcatggctgatgtggaggaga

SEQ ID NO: 22540 - DNA, 601 bp, Human
acactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggaacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggacccccacctccagcgctgacagaggctggctaggcaggcagaggacacggagacta

SEQ ID NO: 22541 - DNA, 601 bp, Human
tgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacgcaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgtgacagagggggctgtgaaccctgtcaccaggcaccagaatcacccaactgggacaggaccccca

SEQ ID NO: 22542 - DNA, 601 bp, Human
cacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacgctgcaggcatacagacacaggcacacacacactgcatacgcagrcaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagacacacatgcacacccgggccctgtctgggccagctggtcagatgt

SEQ ID NO: 22543 - DNA, 601 bp, Human
gcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacacactgcacacacacacatgcacacacactgcatacacaggcacacacacatgcacacacactgcatacacagacacaggcacacacacacatgcacacacacrctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacacatgcacacaaatactgcatgcgcacagacacaggcacacactgcatgcacacagatacaggcatacacgcactgcatgtacatgtatacacacacagagagac

SEQ ID NO: 22544 - DNA, 601 bp, Human
tgcacacacacacgtactgagtgcaccaacgcacacacgtactgtgtgcatacgcactgcatgcacagacacaggcacacacacatgcacacatacactgcaggcacacagacacaggcgcacacacactgcatacacagaaacaggcacacacacactgcatacacagacacaggcacacacacactgcatacacaggcacacacacacatgcacacaaatactgcatgcacacaggcacacacacacatgcacacacacacactgcatacacagacacaggcacatacacatgcacacrcactgcacacacacacatgcacacacactgcatacacaggcacacacacatgcacacacactgcatacacagacacaggcacacacacacatgcacacacacgctgcaggcatacagacacaggcacacacacactgcatacgcagacaggcacacacacactgcatacacagacacaggcacacacacacatgcacacacactgcatacacaggcgcacacacacatgcacacacacgctgcaggcatacagacacaggcacacacactgcgtacacagacacaggcacacacacacac

SEQ ID NO: 22545 - DNA, 601 bp, Human
ctcccctgccccgctggaactgcctgagctgcccaggcctgagtgggggtgggagtgtggggggtccccagccctgaggtcttcatgcttccgtcttagaacactaaatattcccgaatcagatcatggccatgttggggggaagactgatgggtttctaaagcaggaagcagtgcacgaacacgcagatgtgtgtgcacacagactcacagatgcacacacactgcacacagttgagagacttaagacacacacacacgccccacgcacacagagaaacacagtgtatacagacacatgyatgcacacacgtgtacatagagacaaagacctgcacaccacaatctgtagacatacaggtacacatgttgcatgcacacacactgcatgcacagagagacacataggcgtgcacacctgcatttgcacacaaaaacttacacacatgcacacacactatgtgcagtcacagatacaggcacacactgtgtgcagacaccagaacacatgcacacacacacgtactgagtgcaccaacgcacacacgtactgtgtgcatacgcactgcatgcacagacacaggcacacacacatgcacaca

SEQ ID NO: 22546 - DNA, 601 bp, Human
agggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttgggctcaggctgctccctctcgcagccgcgccagcacctgctgaccccgcttggctgaagctyggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagacaagctcggagggagcggctgcccacatccctgtgtggctcagctgcccacacccatgcat

SEQ ID NO: 22547 - DNA, 601 bp, Human
ctactcctgcagaacccggctggagagagggtgcgtagtgttcatgagtgcagaaccgcaagggctcctggggtctgcgggctagctgggggcctgtctcaagggcttccccctcttccacgcagtatcctgtgtgaacctgaggcagccaggccacacgggagggcctgagagcgcctggagaacaagctcccacctggcatcacctcggccatggctttggcctgtacgggggtccccagccaggggcctgaggatgtggggcgctgcggcccattgttcacgcaaacccactgttggrctcaggctgctccctctcgcagccgcgccagcacctgctgaccccgcttggctgaagctcggccccagcccagcctggggggatcctggggcctgtaagcaggcaagagggcagctcatctggtgggcccccactttgtcccccttccagatatgggcgctggggcccacagcccacactggcccctctgcctgtccccagagtgggacgctcaggcatgaggacagactgatctgcatgggctagaggaagaccccgagggtcaaagcagcccgagtgaccacagagtgaggaggagac

SEQ ID NO: 22548 - DNA, 601 bp, Human
gaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggygctgttaggagggtgcgcttcctgcagggacacaccctccctcccccacctggcactgaggacaggctgaaattcaagccacaaggtcctgctgcactgacccaaggtcctgacagacaagtccagcttttccagaaccaggaagcagctgtgccaggcctcaccctggggggccagaaagctccctactcctgcagaacccggctggagagagggtgcgtagtgttcatgagtgcagaaccgcaagggctcctggggtctgcgggctagctgggggcctgtctcaagggcttccccctc

SEQ ID NO: 22549 - DNA, 601 bp, Human
ctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgcgcttcctgcagggacacaccctccctcccccacctggcactgaggacaggctgaaattcaagccacaaggtcctgctgcactgacccaaggtcctgacagacaagtcca

SEQ ID NO: 22550 - DNA, 601 bp, Human
ccatgtggtccctctccagactggagacagtctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggcsggtgggactaagtccccaggagattcatgctctggaaggtgaggccagcaggcccccattgagaagggccctgagaccccgctggctcaaggagaggtagtttttttcttttttttttttctgagacggaatcttgctctgtcgccaggctagagtgcagtgacgcgatctcggcccactgcaacctctggaagaggcagtttctttgactttggcagactgtaccttagctagagaggagcagatgctggcgggcaggaatacggggctacagggagagcggtgctgttaggagggtgc

SEQ ID NO: 22551 - DNA, 601 bp, Human
ggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcytggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatgctctggaaggtgaggcca

SEQ ID NO: 22552 - DNA, 601 bp, Human
acacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacaktctggacaccagggctcctggtggtgctgtatcctcaggccaggcctccagcctgcttcctggagcctgacagctgctgctccgccctccccactcccatccccaggcccactgtgcagtggagtgggggcctctggggatggcagctggccctgcagcggggcttctcagcaggctgacctcaatgagacaccccactgtggtctctccagaagtggctggcgctccaggaggcaggcctggcagttgggtgggaggcctgatcttggccggtgggactaagtccccaggagattcatg

SEQ ID NO: 22553 - DNA, 601 bp, Human
ggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccgcaacctccagcacggacacacagggctgtcgggcgggcaatgagagggctcagggcctgtggggaaggacgcagcrgggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccctctccagactggagacagtctggacaccagggctcctggtggtgctgtatcctcaggccaggcctccagcctgctt

SEQ ID NO: 22554 - DNA, 601 bp, Human
cccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacatctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccrcaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggctctgacgtgtcagatgaaccctcgggacactgggaagggaccccatgacaggtggaccttagcagaacatctagacgtggagctctgctcggggtgaagctgatagcaggtgtgagccaggctgaggccccgggctccccatgtggtccc

SEQ ID NO: 22555 - DNA, 601 bp, Human
tctctgtccctttggaagcctggttctgcgtccaggttctgtgtgctccatcagtgctcactgcacatcaacacagagctctgacccgttcacattctcaacagcgagcagcactcgacacaaacacagaagctgcagacgccccgctccccagcccactccccttccaacagtgcctgagccctcaaggagctgcctggtgccctacctcactcagggaggaggggagggagggtgaagggacactgtcagacccgagagtgcttccccaaccctcaccaggcccagggcaatccctacwtctgctgacaacaccctgcacagggcctgctcgccggcccgccacacacaaaggccaaaggtgccttccacatgccaagtcttcttggagactgctggtccccccagggagacaggggggcccaggggagaggacgcaggcattacccgcaacctccagcacggacacacagggctgtcgggcgggcaatgagagggctcagggcctgtggggaaggacgcagcggggcagagcccttccctccagggcacagctgtgtggggaggcggtagggggcctgaggcagggccctgcctggct

SEQ ID NO: 22556 - DNA, 601 bp, Human
gcttggcctgccctgacccccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccrgcaaccgggagctcccaccctcgggcctcgattctctggccatgccaggcaagtatggggcagcaggggcaggcgcctctgtcaggcctgctctccctgtggtcacagaccaagcatctgggcccaggaagaagtgggctgcctcccaaggtctccctgccctggctgcgtgggacaacacacctctcccgtggccaccttctttgctggctgcgtagacaccagaggcctcaacctgcaaaaggaagcacagcatggcggcctcagcccaggctcccgaacgcctgcccacttgttccc

SEQ ID NO: 22557 - DNA, 601 bp, Human
caacagacccctcagacccaccagggctggcccaggatgctcagccactcccgccacaccagtggctcccggggttggccagggctcccaggcccactggccccttctggcctcctgggggctgtgccatgagctgtgtcagcatcaagatcccaccctcaggcctctgccagcccctgctcctgtatcctactgggccccaccccagtgctcggggagcatgcagaacacctttccagaccataggcctcggccgaggacactgtggcctcagcccccgggggcttggcctgccctgacscccagaacacagacagaggctctgctccggcccctgccccagcccccgccacctgccagcaccttcaccctcgtttcctgggccagaccagtccccaacaagtgacagtccaggtgaaagacccctgagccctggagggctgggccctgtgacctggcagtgcctgcttcctacatacaggctccctgcaggcaccaggcccacagcaaggctgctcagccttggcccgagcgctgagcagcaggcacacaacggtccccacttcctgcccgctcctgctccagcaaccgggagctccca

SEQ ID NO: 22558 - DNA, 601 bp, Human
gctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgatccagctctgacagggagcgccactgccctctggctctgtccacgggsaactcccagcgccaggacactatgcaggctatgcccgcactgcctacagagctatgctcaggacgggtgggcgccggtctcagctgtcgggcactcagttcacctgccggcagccgcagggctcctgggcccacaactcaagtggccctggagcaggggtctgacccccatgctgctccaggcggtgcaggcagcggggaggggggtctggaggaggcaggggtgggggtgtctgcctcggacgaggcaggtatctggatgcagggccacagctggaggcagaggaccttcaaggagctg

SEQ ID NO: 22559 - DNA, 601 bp, Human
gtccacccggtcccctgtggcacacccatgtccagcccaggctgatgcacacccactcaacagctgctgcagtagttggggggacctaaagaccccacacccctcactcagggcagcccctgggtctcaggggctaatatccacagccaggccgtgcagccagcagaccgacatgacggctggccacagatcgcaacacagaatcagacaagcctcaggcaatttctgttaagtaacaacagatcttcctgctttactaaatctattcttcccccaagccctcgagaagccctggcaggamccaggctggctactgagctctgggcgggggtaggggggtctggcctgctgcgggccaagttggggcaggacatacagcccattccatggggaggatgaggcccctgggggtcagtgaggcacggctctgcctcaaggccaccccctcctaaggacacagggtgaagccccctcggccacatccggggcagccatgccagagctgagacctcctacgagtggtactggggccttcccacgaagaggcctggggaggctctcgggcctccgtctgccctccctcctcgatggggggcctgat

SEQ ID NO: 22560 - DNA, 601 bp, Human
cagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaattactcaatgttaaactatactttccactaaattgaacagaatgatacatcctataatattagattaactttgtaaattaattcagccacatttattgaacatttactctgtactatgaacacttactttactaggtgctatccagaagttaagatgagtctttttttccccaataggggctctacttacttagagaatttcaaagatatgcagtgtgtattttgagcaaagatagattaccttaggttggggactagaaagccaagtgtttgtacatctcttcatcctacatattttcc

SEQ ID NO: 22561 - DNA, 601 bp, Human
cctgagaaccaagctatggaaaaaattttgctcaattttaagaaaatctaacatatcaagctcctcaactccaaaatattccacaaatagctgctatttactatactgagtaataatcatttaaaattattcaacactttatttgagcatctactatgttcatggcactaaagtagaaatgaagatgaacagttcctgcctcaaaataaatgagtagtatactgctttagatcatgggtttcctagtccattaaaaacactttttggtcatattttctggacaccccgacccttttggtayagaatataacctatgtaattctctaaagttaaattaacctcacttttcttgctctaatatgtgtaaaactgaccttctaggaaagcatatacagtttatatttttgacttcttggtatcttttagtgatagacatacctcagattgagaagcactgattgacattagattaaatcagagcttcctatgacaatataaacaataccttcattaatctgatccccctacctacttcttcagcatcatctcatatctgtctccactaatcatattatagaatctttgttacctgcaccatgtt

SEQ ID NO: 22562 - DNA, 601 bp, Human
gcagttttgcctttcctttgtctctagtcataagtctcctataagaggctgttcctcattctaccattcctttgcatggataggattccatggaatagattctcatcactgcatttatcacattatttcctaagtagtacagtacatctactggaagattagccacgtgttgagttttgtctttgcattttcatgcctagaataatgccgggcacacataggcatattaagatttgaatagtgaaaaagtttttaattccatggggattttatttaaacagaaaaatataagaccaattaraattatttttaaagcataatttcaagaaatatgactgattttgtttaaaaacatgttttcctttataatgctgccacctggtgttgctgtgtttagagatgtccctttgtaaagaattgagggtttgagttgagtttggtttggtttttggcaaatcagcttttcctttgtatatttattttgtaataaactatggaagatcttgcctttaagtgtgagaacacaagcaatgttacttttatacctttatagaatatcttgcctatgtccttcctgtagttaggtagggttttttttttg

SEQ ID NO: 22563 - DNA, 601 bp, Human
aaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggktatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtacaaccatgcctggctaatttttgtatttttagtatagacagggttttgccatgttggccaggctggtctcgaactcctgacctcaggttatccacctgccttggcacccggcctcttttagtttctttaaaatgt

SEQ ID NO: 22564 - DNA, 601 bp, Human
tcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagcgattctcatgcctcagcctcccaagtagctgggactacaggtgtgcaccaccacaccgggctaattttttgtatttttagtagagacagggttttgccatgttggccaggctcttgaactcccaggctcaagcgatccacccrcctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatcttta

SEQ ID NO: 22565 - DNA, 601 bp, Human
tgcagtggcgtgatcttggctcactccatttcccgagctcaagcgattctcatgcctcagcctcccaagtagctgggactacaggtgtgcaccaccacaccgggctaattttttgtatttttagtagagacagggttttgccatgttggccaggctcttgaactcccaggctcaagcgatccacccacctcagcctcccaaagtcctgggattacaggcatgagccaccacgcccagcctggatatctgaaattcttaactgaaattagtcaaattatcttgtactggggatttttttttwaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgt

SEQ ID NO: 22566 - DNA, 601 bp, Human
ttttgtatttttagtagagacagggttttgccatgttggccaggctcttgaactcccaggctcaagcgatccacccacctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtsagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgttgctgcaaaggacattatttcattcttttttatggttgcatactgtggattttattgggtctttattttgtattagcattttaaaaccctaaatgtgacacagtatgcat

SEQ ID NO: 22567 - DNA, 601 bp, Human
caacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcycagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaattt

SEQ ID NO: 22568 - DNA, 601 bp, Human
taaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcccagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggt

SEQ ID NO: 22569 - DNA, 601 bp, Human
caaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggytcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatt

SEQ ID NO: 22570 - DNA, 601 bp, Human
ctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaaktttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacct

SEQ ID NO: 22571 - DNA, 601 bp, Human
cagaagtttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcaytacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataattttt

SEQ ID NO: 22572 - DNA, 601 bp, Human
ccctgaagaaaggagggggaacatttcccctggtgagcgcagtcccacttctcctagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaakcccccactactaaatggcctctctccactaccccgactatccctgcacataaactccgttttttttttttctgtttctggtctcttttctctatcgaccagggagcacaggagttatgggtggggggtgattttgcatttgtagaagcgtccagatactaggtttttaatagaggaaccccaggagggtggaggtgcttggggatccggtgcctagctcccttgcttaggcccgggtccagggctggcgcggggccgctgcaatctctgggaagcgggggcttctgggtcgcgctcagct

SEQ ID NO: 22573 - DNA, 601 bp, Human
gattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatcygaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttg

SEQ ID NO: 22574 - DNA, 601 bp, Human
ccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggasgataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaa

SEQ ID NO: 22575 - DNA, 601 bp, Human
gctttaagctgcttgtccactaatgttatgatatgaaaaaatgtcaaagctagattgtttcttttcactatagcttcagaactgaccttaatagaattaaaaagccctgaagatgcaattctagacttttatagttttaaaaaaagtgtaaatttacttaaatatgtaatataggaaaacaatacattaaaactatacttgtacattgaaacgataaaatattatgtaagcatttaaagttgtggctatcaaactaagaaaaatgccatgatataaagcagccttaagtgttttgtgtaayaaggtgagtcatagatggaaattaaattatattattgacaaatggttagagcttgatgagaattagatttaaaaaatctatacataggtaaagtttagaaggaaataagattttaaaaagttatttattgtatactccaactggatcttctttctcttacattgggtgttaaatagtgcgaagacaaggcaagcagctcttgaaggtattaaaaatgcactggcttcaaaaatgctgtatgaatttattctggaaaggagaatgactttaactgatagcattgaacgctgcctgaaaaaa

SEQ ID NO: 22576 - DNA, 601 bp, Human
gtaagtatctaactggcagaggaaaaagcttgtgtcacaaggcccattgttccatcattaccttgcaattgagaattgggcaataactttggaacatggccagcttgagaacccagtgatttatttccctacttcttggcagtggtggtgtaatactttagagagcagaaaccagtaggggttggtacagcagtgtttgactgtggttcattatacttaatttttgctatctatagaactgaagtttagggatcctcatggagagagttttgtctaatataatctttatgaaactgcttgratttctcagatacccaatacatcaagctaatgaaggcatgtgatgcttcataattaatatcaaacaaatgaataaaatattaagtcagcataggtttgggatgagatgggttcagtaacttctctaagccaaagatggaaataaacactgctcattagactgggacatgtgctttgcagttacccattcacttgtccactcacagatgttagttaccatggcttggctctcgaagggatttgagtttgtgatagtttgatcagtcgacccaatttgctttgtacctgtttttggtttagc

SEQ ID NO: 22577 - DNA, 601 bp, Human
ttagagagcagaaaccagtaggggttggtacagcagtgtttgactgtggttcattatacttaatttttgctatctatagaactgaagtttagggatcctcatggagagagttttgtctaatataatctttatgaaactgcttggatttctcagatacccaatacatcaagctaatgaaggcatgtgatgcttcataattaatatcaaacaaatgaataaaatattaagtcagcataggtttgggatgagatgggttcagtaacttctctaagccaaagatggaaataaacactgctcattagactgggacatgtgctttgcagttacccattcacttgtccactcacagatgttagttaccatggcttggctctcgaagggatttgagtttgtgatagtttgatcagtcgacccaatttgctttgtacctgtttttggtttagcacttaccatcttatgttccaggaaatcctttatctcgggcaaactgggtcatttggtaaccctaatttgtcatctctattttaaggattgctaagagaaaggaatgcctcaaatcttaccattggaagggagaatgtattcttaagatatgtgattc

SEQ ID NO: 22578 - DNA, 601 bp, Human
gtcagtagctaataattctccttatgtgagaaattggactcaaatttagcaatcaatttaattttattgagctagttaatagcttcttaacctcaacgcatggaaaccagatgtcccaatttttaatcttacattcctctactggccagaaatggcagtttcttttcttttttttccttggaaatgcatttttaaaatgaagtcataatgcagtttaaattatacatgttgaatttgtttaagtttgtataaacatatatatagacacatacatacatgtatatacatatacatatatattcacatttatatacacacacacacacacacacacacacacacaccccacgtatcttttctccaacttaataaattacacaggataaccaggagaactcatccagacatatttcatttgacttgaatttttatccaaggacaaaaatgaactgggttacaaaacagaacctagtgtttttatttgctttttttttttttttttaaaataagctttttatatgtgggtgctggttgggggatagttatagggtgttcaaaaattaaatccagggcgttagtgaaatacatagacagatttaaa

SEQ ID NO: 22579 - DNA, 601 bp, Human
ataattctccttatgtgagaaattggactcaaatttagcaatcaatttaattttattgagctagttaatagcttcttaacctcaacgcatggaaaccagatgtcccaatttttaatcttacattcctctactggccagaaatggcagtttcttttcttttttttccttggaaatgcatttttaaaatgaagtcataatgcagtttaaattatacatgttgaatttgtttaagtttgtataaacatatatatagacacatacatacatgtatatacatatacatatatatacacatttatayacacacacacacacacacacacacacacacaccccacgtatcttttctccaacttaataaattacacaggataaccaggagaactcatccagacatatttcatttgacttgaatttttatccaaggacaaaaatgaactgggttacaaaacagaacctagtgtttttatttgctttttttttttttttttaaaataagctttttatatgtgggtgctggttgggggatagttatagggtgttcaaaaattaaatccagggcgttagtgaaatacatagacagatttaaaatagggttcat

SEQ ID NO: 22580 - DNA, 601 bp, Human
aattctccttatgtgagaaattggactcaaatttagcaatcaatttaattttattgagctagttaatagcttcttaacctcaacgcatggaaaccagatgtcccaatttttaatcttacattcctctactggccagaaatggcagtttcttttcttttttttccttggaaatgcatttttaaaatgaagtcataatgcagtttaaattatacatgttgaatttgtttaagtttgtataaacatatatatagacacatacatacatgtatatacatatacatatatatacacatttatatayacacacacacacacacacacacacacacaccccacgtatcttttctccaacttaataaattacacaggataaccaggagaactcatccagacatatttcatttgacttgaatttttatccaaggacaaaaatgaactgggttacaaaacagaacctagtgtttttatttgctttttttttttttttttaaaataagctttttatatgtgggtgctggttgggggatagttatagggtgttcaaaaattaaatccagggcgttagtgaaatacatagacagatttaaaatagggttcatac

SEQ ID NO: 22581 - DNA, 601 bp, Human
aatttagcaatcaatttaattttattgagctagttaatagcttcttaacctcaacgcatggaaaccagatgtcccaatttttaatcttacattcctctactggccagaaatggcagtttcttttcttttttttccttggaaatgcatttttaaaatgaagtcataatgcagtttaaattatacatgttgaatttgtttaagtttgtataaacatatatatagacacatacatacatgtatatacatatacatatatatacacatttatatacacacacacacacacacacacacacacacaccccacgtatcttttctccaacttaataaattacacaggataaccaggagaactcatccagacatatttcatttgacttgaatttttatccaaggacaaaaatgaactgggttacaaaacagaacctagtgtttttatttgctttttttttttttttttaaaataagctttttatatgtgggtgctggttgggggatagttatagggtgttcaaaaattaaatccagggcgttagtgaaatacatagacagatttaaaatagggttcatacagcaaatgagttttgaattattcaaggct

SEQ ID NO: 22582 - DNA, 601 bp, Human
tagtagactctggagctgttctgcctaccttcagatctctttctctcttactagttggataatattgggcaacttctctatgcctcggtgtccttatcattaaaatggataaattattagtcacaacctcatagagtttttgagaacacatgataggtacagtgtaagtgttagctgttacttggaatgttggttgaattgagtattgcatttggcagtagtctactagtggccttttaggaactgtagagtaacttaatataagagacattatttggtgggcagaattaagatcttgggrgccattgctggtgcaatcctcacttgggaaaatttaacaaaatatagttagaccttttccaggtctcacccattccattccccagctgagcggacaggggaagtgctacagcacagcgagaaaaaagataatcaaagaccaaatatactccttggagccaaatctgaaatcacctagattttatacttcagaagcagcaacttagcattcttcttgtttttttgcccttgtttgtataataactgactctgtgtaaaaatatctccataccttgacaaagatattctgccttgattagca

SEQ ID NO: 22583 - DNA, 601 bp, Human
catttcatcctaattccattcaacttttgaaaccatttaattggtaactgttattttgctatgaaataattatcttcagctgaccagtttgttgtatttatattgtgttagattctgttgtatttatattgtgttaggttcaaacaggctgttcataacagtaagatctataacttaatggatgtttatgtcctgtgttttatatatttctaatagttcatttccctataaaaaacctaggagatgtgggtggtaataactgttatataagaggagcctgagacagattgctaatgtagtkctgcctgaggttgtatagatctacatggtggatgcttgtgattcaaacctagatgttctgactgcaaaacctatgtcttaaatatggtattaaactgcctcgtatggttgtgatggctacacagattttttttaaaaaggtgagttctatatacctccaagtctagaatattgataaaatagttaatgcttcagaatttattggggaatttattgtctttttaatgcttacaaccattgtttgaaaggttgggtattttcttttttttcagatgataaaatagatttataatttataaaa

SEQ ID NO: 22584 - DNA, 601 bp, Human
actgttatataagaggagcctgagacagattgctaatgtagtgctgcctgaggttgtatagatctacatggtggatgcttgtgattcaaacctagatgttctgactgcaaaacctatgtcttaaatatggtattaaactgcctcgtatggttgtgatggctacacagattttttttaaaaaggtgagttctatatacctccaagtctagaatattgataaaatagttaatgcttcagaatttattggggaatttattgtctttttaatgcttacaaccattgtttgaaaggttgggtattwtcttttttttcagatgataaaatagatttataatttataaaacttggtatggagagcagtagattgatgattctgatctaggacttttgaccctgttgtgtagtaatgactgctggttttttttattattataagagtatattaagatatttatttctctgggagctcatttcttatttgtcccagagtggtacagctctattatataattatcgtaaagtcctattaataggcttttggaagctgtttatggacttttttattacgtgttacattttattttcttccttcctttttttg

SEQ ID NO: 22585 - DNA, 601 bp, Human
aatagttaatgcttcagaatttattggggaatttattgtctttttaatgcttacaaccattgtttgaaaggttgggtattttcttttttttcagatgataaaatagatttataatttataaaacttggtatggagagcagtagattgatgattctgatctaggacttttgaccctgttgtgtagtaatgactgctggttttttttattattataagagtatattaagatatttatttctctgggagctcatttcttatttgtcccagagtggtacagctctattatataattatcgtaaastcctattaataggcttttggaagctgtttatggacttttttattacgtgttacattttattttcttccttcctttttttgtgtttttaatgcccaagtatatagagtcttttttctaaactacttagcatttaatttttcaagttttaataggatattgaacttggtgattcacaaactaaacttgattgggttttatccattgctaagattatattaccgtgaagtttttcaatctcagcacgcactgttgatattttgggctggattatattttgtcattgtaggggtgggggctgtc

SEQ ID NO: 22586 - DNA, 601 bp, Human
ctattatataattatcgtaaagtcctattaataggcttttggaagctgtttatggacttttttattacgtgttacattttattttcttccttcctttttttgtgtttttaatgcccaagtatatagagtcttttttctaaactacttagcatttaatttttcaagttttaataggatattgaacttggtgattcacaaactaaacttgattgggttttatccattgctaagattatattaccgtgaagtttttcaatctcagcacgcactgttgatattttgggctggattatattttgtyattgtaggggtgggggctgtcttgtgcattgaaagatactttgcagcatccttggcttctccccactaggtgccgatagcacccccttctcctagttgtgacaaccaaaaatgtctcagacatagtcagatgttcaatgggaggtaagatcatccccagttgataatcactggcagtgattctcacttcttagaacaaattaaaataatgtatagaattttcttaaattttgatttattcttctatacaaattaaaaaaccctttacatatacatatatacacacatatatatgtttaaa

SEQ ID NO: 22587 - DNA, 601 bp, Human
cagcacgcactgttgatattttgggctggattatattttgtcattgtaggggtgggggctgtcttgtgcattgaaagatactttgcagcatccttggcttctccccactaggtgccgatagcacccccttctcctagttgtgacaaccaaaaatgtctcagacatagtcagatgttcaatgggaggtaagatcatccccagttgataatcactggcagtgattctcacttcttagaacaaattaaaataatgtatagaattttcttaaattttgatttattcttctatacaaattaaaaamccctttacatatacatatatacacacatatatatgtttaaaatactgtaaaagaacaagtagccaataaaatgagtaggagactgctagtccctgaaatgtacttgttttttataaataaaattattcccatcttgttatgatgcaatctgattctttggaatttaaacacagtttggtctattttaatacccactttgcatcttattaatgggtgttgtctctaacttagatataggaggttgaattggaacatttgaagaaaacatttgttggaatagttaagaatatgtaattggaa

SEQ ID NO: 22588 - DNA, 601 bp, Human
gaagctatattggtatatctgtctctcactgaactttgaaatcccagtaatgtcttatatatggtgggaacacaagaaatatttgttggatgcatttacttggaagggaaatgttaattgttttgctgtagtacatcatcttgtagtcagcatttctgggttcgatttttgcatgaaaacatgtgtttatgtgtgcctagtccctaaataccatgaagatttacattgccttatgcaactggatattttccaaatgtagactgttctttgttagctctatatgaggtcagaaaagaaaaayaataataaaggaaacaaaattgcttttcttgtccaggactttttttatgaagacatggagtccttgacgcagatgcttagggccttggcaacagatggaaataaacaccgggccaaagtggacaagagaaagcagcggtcagttttcagagatgtcctgagggcagtggaggtaggcttcttaaatgctgtaatagcttctcattttgaaattggattgtttcaggctgaacttgacaattgtaccattttgttgattgaatttcacctttgaaaataatttctcattttacgacctagc

SEQ ID NO: 22589 - DNA, 601 bp, Human
aaagcagcggtcagttttcagagatgtcctgagggcagtggaggtaggcttcttaaatgctgtaatagcttctcattttgaaattggattgtttcaggctgaacttgacaattgtaccattttgttgattgaatttcacctttgaaaataatttctcattttacgacctagcaggtttttaacaatataagtgaagactttttttttttcaaaacaaaagaaaattaatgctggtgtataaagatactttattttagttttttttcttttaaataaaaagacccatagtgatagaaatgtrtttgaccttggtgtatttgtcatcatttaaaccatggtgcttagcatatacattcttagtgtacagtgttttttgtgaatttaataagttattgcctaccccttagactccaacccagcttgattgtcatttatttatttatttgagatggagtctcgctgtgttgcccagactggagtgcagtggcacgatcttggctcactgcaacctccgcctcccgggttcaagtaattctttgcctcagcctcctgagtagctgggattacaggtgcccaccaccatatccggctaattttttgt

SEQ ID NO: 22590 - DNA, 601 bp, Human
caggctgaacttgacaattgtaccattttgttgattgaatttcacctttgaaaataatttctcattttacgacctagcaggtttttaacaatataagtgaagactttttttttttcaaaacaaaagaaaattaatgctggtgtataaagatactttattttagttttttttcttttaaataaaaagacccatagtgatagaaatgtatttgaccttggtgtatttgtcatcatttaaaccatggtgcttagcatatacattcttagtgtacagtgttttttgtgaatttaataagttattrcctaccccttagactccaacccagcttgattgtcatttatttatttatttgagatggagtctcgctgtgttgcccagactggagtgcagtggcacgatcttggctcactgcaacctccgcctcccgggttcaagtaattctttgcctcagcctcctgagtagctgggattacaggtgcccaccaccatatccggctaattttttgtatttttagtagagacagggtttcaccatcttggccaggctggtcttgaactcctgaccttgtgatccacccgcatcggccttccaaagtgctgg

SEQ ID NO: 22591 - DNA, 601 bp, Human
gaaaattaatgctggtgtataaagatactttattttagttttttttcttttaaataaaaagacccatagtgatagaaatgtatttgaccttggtgtatttgtcatcatttaaaccatggtgcttagcatatacattcttagtgtacagtgttttttgtgaatttaataagttattgcctaccccttagactccaacccagcttgattgtcatttatttatttatttgagatggagtctcgctgtgttgcccagactggagtgcagtggcacgatcttggctcactgcaacctccgcctccygggttcaagtaattctttgcctcagcctcctgagtagctgggattacaggtgcccaccaccatatccggctaattttttgtatttttagtagagacagggtttcaccatcttggccaggctggtcttgaactcctgaccttgtgatccacccgcatcggccttccaaagtgctgggattacaggcgtgagccaccgtgccagagatcttcatgatctttctaggaaagctggaggctaaaaaccgaaataacaaaacccagcattttaacaaggccacttaaaatcattatctgatgctt

SEQ ID NO: 22592 - DNA, 601 bp, Human
tagtagattgtaagggtctctactggccctcaaaccgggccagccatagcactcagtactgattattcagaggaagacacaagtgacgtttcagcttacaccagtattaacagccctttgttgtgtattcctcaggcactgttaaatggaaaccattcctatcccatagtgatctacccgcccaccttcttttcttcatctcaggatctcccttgtccctccagcctctgcttcaatgcacctgcctgagaaaggcctgtcctcagggctttgctgagagttgtttctcttttttttttttcactggaacctagctttttctggagcacccagcttctcggatgggtctttaaatgaaggttgctcaactgccacaaaggatatgtaaacatcttagttgtggtagtggctgccacaccatttctttttatttaaaacatttcttgaggctcatggattcctcaaatcagcaagcacttaatgttttaggtgttttgccatacagttttcttatctcattatacctcttaagcaatagaatagtctccttctaaaggagaaatgggaaccaaaggaatacagaatagttaagtagcagagc

SEQ ID NO: 22593 - DNA, 601 bp, Human
gcctgggtgacacgagtgggaccttgtctcaaaagcaaaacagagaaaagaatattgctgcttgtttgcccattaggtgtatttctttcattttatgaaacatattttgacaacacgttaaaatttaatatgtacatatatattttacgtataattctatcttaatataggaacggtgttcattatttgtttctttttattctttggagtttttatgtttaagaataagtatttacatagtccttttgtatcagataatagcctgctaagtgaagtaccagactcgttttacaaatgaggmaacttaagagagttaaatagtaattaatatcatttttacttaacatttctttttttttttttgagatggaatcttgctctgtcactcagactggagtgcagtggtgcaatctcggctcactgcaacctctgcctcccaggttcaagtgattatcctgcctcagcctcctgaatagctgagattacaggtgtgcattaccacacctggctagtttttgtatttttagtagagacagggttttgccatgttggccaggctagtctcgaactcctgacctcaggtgatccacccactttggcc

SEQ ID NO: 22594 - DNA, 601 bp, Human
tttatgtttaagaataagtatttacatagtccttttgtatcagataatagcctgctaagtgaagtaccagactcgttttacaaatgaggaaacttaagagagttaaatagtaattaatatcatttttacttaacatttctttttttttttttgagatggaatcttgctctgtcactcagactggagtgcagtggtgcaatctcggctcactgcaacctctgcctcccaggttcaagtgattatcctgcctcagcctcctgaatagctgagattacaggtgtgcattaccacacctggctartttttgtatttttagtagagacagggttttgccatgttggccaggctagtctcgaactcctgacctcaggtgatccacccactttggcctcccaaagtgctgggattacaggcatgagccaccatgaccagcctgcatttcaaaaatccttaatttatgtatttttttttgtgctgagatgaaattcatataacagactattttaaagtatacagttcagtggcacttattacattcatgatgttgtacaactctagttccaaaacattatcacctcaaaagaaaaccttctgttcatta

SEQ ID NO: 22595 - DNA, 601 bp, Human
gctgggattacaggcatgagccaccatgaccagcctgcatttcaaaaatccttaatttatgtatttttttttgtgctgagatgaaattcatataacagactattttaaagtatacagttcagtggcacttattacattcatgatgttgtacaactctagttccaaaacattatcacctcaaaagaaaaccttctgttcattagcagtcacttcccttgtgctaccccccgccactggcaaccgctaatctgctgtctctggatttactttttctggagatttcatacaaatggagttatayagcatgcaaccttttgtgtctggcttttttcatttagcataatgctttggaggttcattcatgttgtagcatgaattcagagagctttattcttttttgtggcagaataatattccattgtatggatatatatcacattttgtttatccattttaacagttgatggacatttgggctgtttgcatcttttggccgttgtgaatagtgttgctctgaacattcacatacaaaattttttttgaaaggctctttgcaattttgggaggtattacctaggagtggaattgtgctgggtcagat

SEQ ID NO: 22596 - DNA, 601 bp, Human
ataatgctttggaggttcattcatgttgtagcatgaattcagagagctttattcttttttgtggcagaataatattccattgtatggatatatatcacattttgtttatccattttaacagttgatggacatttgggctgtttgcatcttttggccgttgtgaatagtgttgctctgaacattcacatacaaaattttttttgaaaggctctttgcaattttgggaggtattacctaggagtggaattgtgctgggtcagatgatagttttacatttaactttctcagaaaccaccaaackcttttccatagctgctgcaccagtttacattctcatcagcaatgtagaaagaaaggttccagtttctccacatcctcactaataattattttaattatagccattctggtgggtgtgaagtgtttaattacattttatagaacctggatattttatcagttttatatccacataattgtttcttgtacggcattttaagttttttttaagaaacattaatatttttacatacttctctcttttgaataatttttttgaagaaatcccctgcataatgtattgccaaattactttccaaag

SEQ ID NO: 22597 - DNA, 601 bp, Human
agttgatggacatttgggctgtttgcatcttttggccgttgtgaatagtgttgctctgaacattcacatacaaaattttttttgaaaggctctttgcaattttgggaggtattacctaggagtggaattgtgctgggtcagatgatagttttacatttaactttctcagaaaccaccaaactcttttccatagctgctgcaccagtttacattctcatcagcaatgtagaaagaaaggttccagtttctccacatcctcactaataattattttaattatagccattctggtgggtgtgargtgtttaattacattttatagaacctggatattttatcagttttatatccacataattgtttcttgtacggcattttaagttttttttaagaaacattaatatttttacatacttctctcttttgaataatttttttgaagaaatcccctgcataatgtattgccaaattactttccaaagttactcttatattggagacgatatttaaattgtctccagcaatgaatgaaggcatgtagctgttacacaaagatttgacaccattgagttttataatttaaaaaatgtgtttatttaat

SEQ ID NO: 22598 - DNA, 601 bp, Human
catcagcaatgtagaaagaaaggttccagtttctccacatcctcactaataattattttaattatagccattctggtgggtgtgaagtgtttaattacattttatagaacctggatattttatcagttttatatccacataattgtttcttgtacggcattttaagttttttttaagaaacattaatatttttacatacttctctcttttgaataatttttttgaagaaatcccctgcataatgtattgccaaattactttccaaagttactcttatattggagacgatatttaaattgtytccagcaatgaatgaaggcatgtagctgttacacaaagatttgacaccattgagttttataatttaaaaaatgtgtttatttaattgatattaaaatggcacttcatcacttttttccttgttctaattgacagccaagtaggactattttctgcattagtcatgatttgtcttttcttggatgaaacaatgttgatgtccatttttcactgttggtttttgaaatcgtctaactttcttggcgttttacaatttgattagtacttttcttaatatggaatagccattaactctttattt

SEQ ID NO: 22599 - DNA, 601 bp, Human
ataaacatttaaatgtttatagggtcaaattagttcatttcttttctttgtgacttttaccctttttctgttttgtaagaatatcttaagtcttactgatgcacgtttttcctttttttcattttagcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcytggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctg

SEQ ID NO: 22600 - DNA, 601 bp, Human
cagaagagccctcaaagggctgggtaggaatacctcatcctctggttgggtaggaatactccatcctgtagtggaggaaaataagatcccctaggggtttggggagggcatggcatgagaattttgtggttgtcctctggatataatgcaaactggcctccaggaatatctaggggctgggtgtggaggttcatgcttgtaatcccagcactttgggaggattgcttgaggccaggagttcgagaccagcctgagcaatatagccagacccccgtctctacaaaaaaaaaaaaaaaaaaaataggcaactgcagtggctcatgcctgtagtcccaggtatttgggagtctgagatgagaagttcaaggttacaatgagctatgatcacgtgattgcactccagcctgggcgactctatttcgtaaaaaaaaaaaaaaaaaaagtaggccgggtgcagtggctcacacctgtaatctcagtattttgggaggctgaggagggtgaatcacctgaggtcaggagtttgagaccagcctggtcaacatggtgaaacctcgtctctactaaaaatacaaaaattagctgggcatggtggtgcgtg

SEQ ID NO: 22601 - DNA, 601 bp, Human
tataatgcaaactggcctccaggaatatctaggggctgggtgtggaggttcatgcttgtaatcccagcactttgggaggattgcttgaggccaggagttcgagaccagcctgagcaatatagccagacccccgtctctacaaaaaaaaaaaaaaaaaaaataggcaactgcagtggctcatgcctgtagtcccaggtatttgggagtctgagatgagaagttcaaggttacaatgagctatgatcacgtgattgcactccagcctgggcgactctatttcgtaaaaaaaaaaaaaaaaaaagtaggccgggtgcagtggctcacacctgtaatctcagtattttgggaggctgaggagggtgaatcacctgaggtcaggagtttgagaccagcctggtcaacatggtgaaacctcgtctctactaaaaatacaaaaattagctgggcatggtggtgcgtgcctgtagtcccagctacttgggaggctgaggcaggagaatcacttgaacccgggaggtggaggttgcagtgaaccaagattgtgccactgcgctttagcctgggtgacagagcgagactctgtctaaagaaaacaaaacaa

SEQ ID NO: 22602 - DNA, 601 bp, Human
ggttacaatgagctatgatcacgtgattgcactccagcctgggcgactctatttcgtaaaaaaaaaaaaaaaaaaagtaggccgggtgcagtggctcacacctgtaatctcagtattttgggaggctgaggagggtgaatcacctgaggtcaggagtttgagaccagcctggtcaacatggtgaaacctcgtctctactaaaaatacaaaaattagctgggcatggtggtgcgtgcctgtagtcccagctacttgggaggctgaggcaggagaatcacttgaacccgggaggtggaggttrcagtgaaccaagattgtgccactgcgctttagcctgggtgacagagcgagactctgtctaaagaaaacaaaacaaataaacaaaaaaaacaaaaaacggtgtcttggaatggggtggctttaggtcccctttggatgacacagccaaggtctgtaatgcccctccccctttcctccttgccttgtcctccagcctccagccatgcaatggatgcaggtatctggagagagacgagggaagcctggaggtacctactgagcaagctatgcccgtgccctcccacacctcctagtcatcata

SEQ ID NO: 22603 - DNA, 601 bp, Human
ttccggcctctccgcaggatggtcctggatggagatctcaggaaggggaaactcctcaaccccaacccaaccccttggagcctccctaaacctacctcagcgtcagaacctcactcattttggagatgaggagactgtgatccagagaggagtaaaagcgccgggctagtccagagtcatagaacaagttaacagcagatcttgcctccctatccagggcaatttccctcacccctggatttcaccatctgtggtgcagacctagcaaccctgacaacctctggctcccaacactctctcrttcactctactctattcgtatgagtaattcctcctgtcactgagtgaggtttcttctgggaatggagggccaaagtcatgaggagtcagggaggaaactcagcctacccctccctgcaaggcgagtagcaaaaccacctggggtacagcaagagtgaaggtaaaaccagattggacggttggagacaggcactttgggtagaagcagaggaaggagtggggcaggagagaagacacaaaggcagcaacttccctattccttcctgcccttggaagctggggtcctctgacaagcctccag

SEQ ID NO: 22604 - DNA, 601 bp, Human
ggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccytctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgattgtgtttggttgatttattctcagttagacacagggatgcaccaggggtggagagacggggacagattttgggaggtgagtattgtgtggtccccagacctgtctgtatggtaagggactgcagaa

SEQ ID NO: 22605 - DNA, 601 bp, Human
atgttgtgtgtgtgtgtgtgtgtgtgtgtgtgtgtgtacacacacaaaaaacatatatatataacacatatatatactatatataatatatattatatacattatatgtaatatatataatattatataatatataattatatataatattatgttgtcccttggttgggtagggctgggccccatctcttaacctccagtccttagctctatgtgccctttgctctaagccattccatttacctgctttgtactgatcacaaacacatgaagtgctgtttgtaaaattataaaattcagsactgccaggagatttgaaacaacttacctgccctattctcctttccttaggagttaacggaaaaaaaaaaaaaaaaaaaacggctagatgcagtggctcacacctgtaatcccagcactttgggaggccaaggtgggcgaatcacctaaggtcaggagtttgagaccagcctggtcaacatggagaaaaataataataattagccaggtgtggtgcatgcttgtagtcccagctactcaggaggctgaggcaggagaatcgcttgaacctgggaagcagaggttgcagtgagccaagatc

SEQ ID NO: 22606 - DNA, 601 bp, Human
cttttttttgcgatagggtcttgctctgttgcccaagctgaagtacagttggtgtgatcattgcccactgcggcttcaaccacccaggcccaagccatccccccatgtcagcctcctgagttgctgggatcacaggtgtgtaccaccatgcccagctaatttttgtgttttttgtagagatggggttttgctatgttgcccaggttgctctcgaactcctgggctcaagcccgtctcggcctcccaaagtgctgggattataggcatgagccaccgcacctggcctacttcttgtcatacwcagtcccagagctggtcatcagcaggggatctttctgtagtgtagttctgtgccatccagtataggagccactggctacatgtggctagttacattttaatttaaatcaattaaaattgaatcaaattaaaacttcagttgcatagtctcgccaaccactttcacaagtgatgagtggctcttgtattggacagcacagatagcgaccatttccataatcccagaaagttctgttggatggtgctggtatagattctgtatcttatccccttaccaccccacagcttattctttctggag

SEQ ID NO: 22607 - DNA, 601 bp, Human
cttagttcatttttcttaaaattgtcttccttttctgcaaaacctttgtgcaactccctttgtggctgatgatgtaagacttgactctgtcttctgccagttactacaaaacagttctctgatagcctagactaaaaaaaaaagtgtaataaacacattgtctgcctgcgctgggctaggtgctgatgatctttggggaaaggtatgtgtcgaggagaaatgggaaataaggtacctgtaatactgcttatggaagacagttaaagccacacagtggagtgagacacttagaaagccattrtgttttagaacattgacctggcagtgattggagggcactaataatgaaggtcagggaggtcaatctgaagaagcaatggagcctgtagtcattagggtatgaatctcagggtgtgggcaatggatgtatcataaaagacgaggatccatgaagctttgcaaaggaagaaagaacagaatttggtgatagaatacagggaacagaggtgggggaaaaggtgattttaatttaaattacctaatctaggagcccaaagaaaatgagctctggctgataatgggaaggttggaagaaaaaaca

SEQ ID NO: 22608 - DNA, 601 bp, Human
atgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggygggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagc

SEQ ID NO: 22609 - DNA, 601 bp, Human
aagtgatactctcccatatctgataaaagaaaaaaattctactctgactttgcttatatttcttatgttgatactgactgctcatcgtagtgatgctagatggtttatattcctctcaattgctttctagcttatttacctctaattgccatggctgactttccaaataaagaggaatgatatttcttacctgcgacaaatagtttgttgcgagaggaagcgatctggaaggtctgaggttcctttcctcttcccgaagctgtgtagactgcagcaggtggcagccgctttagcagccagmgttggcagccaggagggcaaaatgcactgggagacaattccttgctgactgtccaggcagtcgccaggggagcaaagggctcagcaagctggggagagaatgaggaagaaggtggagggaggagactgctgtcggcactccttgggcccgccttcaaacaggctctttcctagggcaatggaagtcgaaataaagtggcagaggatacgagtacttcttttaatgtaatatcactattttcatgaaatcttttcttccgtaaaagttggggctctgtgccttccaaaacctgtacctctt

SEQ ID NO: 22610 - DNA, 601 bp, Human
gaacctctcctctaaagtgatactctcccatatctgataaaagaaaaaaattctactctgactttgcttatatttcttatgttgatactgactgctcatcgtagtgatgctagatggtttatattcctctcaattgctttctagcttatttacctctaattgccatggctgactttccaaataaagaggaatgatatttcttacctgcgacaaatagtttgttgcgagaggaagcgatctggaaggtctgaggttcctttcctcttcccgaagctgtgtagactgcagcaggtggcagccrctttagcagccagagttggcagccaggagggcaaaatgcactgggagacaattccttgctgactgtccaggcagtcgccaggggagcaaagggctcagcaagctggggagagaatgaggaagaaggtggagggaggagactgctgtcggcactccttgggcccgccttcaaacaggctctttcctagggcaatggaagtcgaaataaagtggcagaggatacgagtacttcttttaatgtaatatcactattttcatgaaatcttttcttccgtaaaagttggggctctgtgccttccaa

SEQ ID NO: 22611 - DNA, 601 bp, Human
aaaaataagtttttaagtttttgtttttgagtctgtagactcaaagcaaaaaaatcaaaatggaactgatgtagtttaaatggcctagtttgaaaaggagaattgagttgaatctcaaagaatgcttaaagatttgaatagatagagaaggcaatggaccagcatttatgtgataatcaaaacaatgttgtggtgggggtgaactgaatagagcgatgtttttttcttttcttttctttttttttttttttttgagacatggtcttgctctatcacccaggctggagtgcagtgacacagyaaacatggctcactgtagccttgacctcctgggctcaagtgatcctcttgccttagccttttgagtagttgggactacaggcacatactaccacatctggctaatttttgtatgttttggagagacagggtttttgccatgttgcccaggctggtcttgaactcctgagctgaagcaatccacctgccttggccttccaaagtgttgggattacaggagtgagccactgcacccaacctgtgatttttggattgtagtggaacagtcctgctattttgcagtgaacacaaggtaaagtcg

SEQ ID NO: 22612 - DNA, 601 bp, Human
ggaaattaggacacatgagttccagttttgtctggggcaagtcacttaattttaagggtctcagttccctcatttggacaaggaagttggctagtcaatctttaaggtctgttccagctctaccaacctgcaattctagactctagttaaagctgtaaggagagaaccattgatatgtggcaaacggcctagtaaccacttcttcataattctaagacagtaaatatttatggcatatttattatacaaccagcattgttaagccactaagagtttaaaaacatactattaggctgggcayggtggcttatgcctgtaatcccagcactttgggaggccgaggcggctggatcacttgaggtcaggagttcgagaccagcctggccaacatggtgaaaccctgtttctactaaaaatacaaaaattagccaggcatggtggcatgtgccttgtagtcccagctacttgggacactgaggcagaataactgattgaacccatgaggcagaggttgcagtgagccgagttcgtgccactgcactccagcctgggtgacacagcagggctccatctcaaacaacaacaacaacaacaaacatac

SEQ ID NO: 22613 - DNA, 601 bp, Human
aacatgtcctagttacctgccccaaactgaaacctgggagtcattcttaactcctttgtctaatctttcccttgtctgataaatactgtagattctaactcagaaatgtctccagaatttggtatctcctctccatctccaacagcactgttttaaatcaagccctcattacccctggcatcttctattttaatactcttctacttggttttcttgcttccagactctcctccattgttgccacagttattctctctgccaggccagaacttccccttcccctgcctttttttttttttttgcctgcaaaccctgcctcatctttcatcccgtaactcccagctttaatagttcctctaggaaaacttctctgctctttcattcctagctaattattctctcctcagagtcctacctccttcacacctgttcatgcttcttaaatagctcttactaccctaaattgagattactttgattaaaaataggtctgttcagctttcatctgagttttaagacaatgagttgtcttttttcccctgaattttcaacacctggaaagagcttaccacacagtaagaactcaataaatgttgtatga

SEQ ID NO: 22614 - DNA, 601 bp, Human
taccaagtataagagacacttgcatgtggcaatagtgttaacagtttataactcatttgacctgacagctttgaaattatgtcattctagataaactatttggaagagttaacattatttccattttgcccatataaactataatttttataccgttgcctaattcaattcacataaaatgcaacttgcagtatactttgatgaaagcttggaaagaagagtcagactacaaaggccttgtgtaagcagactaaagagtttgaactgttttttcctgaaaaaaaaaatactgacttaaatwggagaaagatatggtcaaatttgtgttttaaaaactcactctagaagcaacataaacaatggatctggtccgtgtgcagtggctcatgcctgtaatcccagcactttgggaggctgaggtgggtggattgcttgaggtcaggagtttgagaccagcctgaccaacatggtgaaaccctgtctctactgaaaacacaaaattagctgggtgtggtggcacatacctgtagtcccagctactcgggagggtgaactgcttaaacccaggaggctgtggttgcagtgaagtgctccactgcac

SEQ ID NO: 22615 - DNA, 601 bp, Human
tttgaggcctcaacatttttaccataaataaggcaaatgtagtcacattttacagaaagaatgcatttctaaagatctcacatagttcaaggttaccttttcttttcttttgttttttggatacagagtttcgctcttgttgcccaggctggagtgcaatggcacgatctcggctcactgcaacctccactgcctgggttcaagtgattctctgccttagcctcctgagtagctgggattacagtcatgcaccaccacgcccggctaattttgtatttttagtagagacgggtttctccayggctggtctcgaactcctgacctcaggtgatcttcctgcttcggcctcccaaagtgctgggattacaggggtaagccactgtgcccggcctaattttgtattcttttagtagtgaggggggcgggtttctccatgttggtcaggctggtctcaaactcctgacctcaggtgatctgcccgccttggcctcccaaaggctgggactacaggcaagagccactgcgcccagccaaagttaacttttctttggaaaaaacgtaaaagtttgagaggagatattcttggagtacataaacctac

SEQ ID NO: 22616 - DNA, 601 bp, Human
ctgagctgcctacttagactttctttgagagaaaaattctctatcttattcagctactgtatctttggatgtctttgttacaacaaactaatctttaccctagctaatacatattgtgcttaattaaccctattatctccaagataaagtccaaatttcacatcttggggtgagagaacgtcttgctctacaccctgtttatcactctagcttctctcaccagtctcctactcctactctacttccattctgaattaccctgaattcatcataaatgccatggtttctttcagcttttggsctctgaatgtggtcttcttgccccacccattcctatctcctctacttccagaattttctgccccaccccaccaccaacccggaaccttccaggcttcttcccaaagcatttctgagaggaggtgttactgattttggacaattctaatgcttcaatccctttttcctatgcaacgctccccctacaacagaatccatgacttcatgctaatcttaggacctatgaaacaggcaaagtctattttgtagattctaagagctggagaattttttaaggcatagagaagcatcttttgctaga

SEQ ID NO: 22617 - DNA, 601 bp, Human
gaattctcttggtttttcttcttcccttttggttagtctgctctctgttgtttattagcttctttctactgcatcctttaaatgtaggtattccccccagttcagtacttggcttttcctctctcactttacacatttcctctgatttgtctttttatctctatagattcaaatgccatttctatgcataagccttcaatatctctatctccagcccaaatctttgtcctgaactcagaaccacatgtagaagagtttttggacatctccactaggacgttccacagacatctcagatccraaacgaaatgcgtcatccatcctcctctttgtatacaccaaaacctgctcttcctcctgtgtttcctatttcactgaatggtacaaattgcctaagtgaaaaatgtaggcatcatcttttctactttcttctcctttccaaatccaaccctaaatcatgtcctattgattctctcaagtgtttctaaaatccattcacagctcctcatcagcactcccctatgtctaccttaattcatgacaccatcatttcttgtaataactaaaataatagcctctcaacccttaattttgtcctcct

SEQ ID NO: 22618 - DNA, 601 bp, Human
ccttttgtcccaaggggaaatgagaaagtgccatttctggtatctagggctgatcccatttgtgctcggcatgtaccctctactgaagctttaatttgccaatcatcctttctcttctatcaacccagcaattctacctcctgggttttatcctgaagaaaaaatcagacaaatgtgtgaacatttttgtacaggaatgcttatgggaacattgttaataacaacaacaaactggaaacaaacattcaccaattaagaattgattaaataaaaagggcaaagatatgcccttattgtgaartatcatgaacttaatataactgcaattactcgttgccatggagagatgtccatatatatcactaactagaaaaagcagcttaggtatagtacaatcccttttaataaaaatataagcatttctgtgtctgtatatatacatagaaaggagtgtagaaatattgtatcaaaatggtagctatcattatttctgggtggtttttatatttttatctttcatattattatcttttttcattgcctcaattagttacaattaacacattattttcataatcaaaaaagcacaaagctctttatt

SEQ ID NO: 22619 - DNA, 601 bp, Human
gaatagaggtaaggacatccttgggcagtagctttcctagttttgatgttgaccactcccagccatcatagggaaggtacatagcaaatggatgtgaaagcaatcccaatgaccttggagaacccccaacttggaaagccctacctggtgaaacttgagtgctccaaggggaaagggatttctttcttttttttttttttttttttacatcagaaggggttgaatctgaatccagggaaagttgatattgacctaacatctcccaagtgcactggaaagtctgagggaaccctggccaagsctggatatagatacatatatacatgtatatgtatatatatgaaacagacactgacagtaacctctcaaagcaaatccctcttagtgttgtcaaggttcttgaccaaagaactttataggactttatagctagtaatcaacagtgaaaggtgagcacataagggtagcctgttgtatctttttctttttttgagacaaagtctcattctgtcgcccaggctggagtgcagtggtgcgatctcagctcactgcagcctacacctcctggtttcaagcgattcttctgcctcaggctcacgag

SEQ ID NO: 22620 - DNA, 601 bp, Human
tgacctcctctccttcttaactccgaatctcctattctccctgtcatgggatgcatattcagttccaggcctctagttttcccctatacatcaaacagcttacttctctcctctcccattgagtggtgtccacatttgctcaagattaagtagagttccagcaaagaccacaagctttttgggctaatgtcaatttctgtcctctataataaccattcacggctaaagacgatgatgacctcctcccacaaacttaggctagttctagtttctttttctttttgctttgagacagggtctygctctgttgcccagccagaagtgcagtggtgaaatcatagctcactgcagccttgaattcctgggctcaagcaatccccctgcctcagcctcctgagtagctgggactgtaagtatacaccaccacatttggctaatttttaaaatttatttttgtagagaaggggtcagggggtatctcactttgttgcctaggctggtcctgaactcctggcctcaagtgaccctcccacttcggcctcccaaagtgctgggattccaggtgtaagccaccatgcctggcctggccagttctcatttc

SEQ ID NO: 22621 - DNA, 601 bp, Human
ttatcatgtcctgggacacttctctgaaagaatatgatgtcactttttgtatccttgatgttatcaggaggattcatttcctatagagaaaaaaacattacctaattatttcaggacatgaacaatttgaatatatgaagtttgttttgaagtatattaccaaacagaacaaaagtagttttgcttctcaagagttacataaaaaaaatctctgaacagcagtactgacctcctctccttcttaactccgaatctcctattctccctgtcatgggatgcatattcagttccaggcctctakttttcccctatacatcaaacagcttacttctctcctctcccattgagtggtgtccacatttgctcaagattaagtagagttccagcaaagaccacaagctttttgggctaatgtcaatttctgtcctctataataaccattcacggctaaagacgatgatgacctcctcccacaaacttaggctagttctagtttctttttctttttgctttgagacagggtctcgctctgttgcccagccagaagtgcagtggtgaaatcatagctcactgcagccttgaattcctgggctcaagcaat

SEQ ID NO: 22622 - DNA, 601 bp, Human
gaaagtctgtttgtttgcttttgtgaaagttcattcatttcttaatgatgtttttcaagactagtatttattttatttcaccattacaattatagactaataatctcataatctttctaaacataaaaattcagacagttcacattatgaattttttatttgtttatttatttattttattttttgagatggagttttgctgttgttgcccaggctagagcgcaatggtgcaatctcggctcaccacaacctccacctccggagtgcaagtgattctcctgcctcagcctcttgagtagcygggattgagggcatgggtcactacactcagctaattttttgtatttttagtagagatgaggtttcaccatgttggtcaggctggtcttgaacacctgacctctggtgatctgcccgcctcagcctcccaaagggctgggattacaggcgtgagccactgcgcccggcatgaaattttaatagctagtcttcgttttgaacagtgaacattatagatctatcccccaattcatcctcttttttcaaaatgagtttaaaaaggtctctctctttttcacaagctagaaagtatccttcgtat

SEQ ID NO: 22623 - DNA, 601 bp, Human
tcctttccgcccagcgcgcagctccgggtttccagcgtcccaggtcgtcgcacgcacctggaagattccgaaatcctcctgctgtgcatcctgccgtaggccgtgcttccaagggatgcggaagcgcgtgcggctcttgttcacccaggccacgccctccagttgccccaggtccagctgcgacaccagccagggcaggatccgtggctttggggttcccatggtccggcctgcgcgtatagggcatttcctgggcgcgaccggcctcccccggacccacctggcctggagtttccgcacycagacctccttctcacgggccacggcacaggtccttcacccatattttcgggggtacaaacaggaaacctcctcttcccatcctcccatcctcccgagaggctctctaatcagctagggttccttcccatatccatggcacatccttccccagcgtcttcagtgcagaccctccactccctcaattccgccagtatagacctcctccctcccccacatcatcgaaagtaagtatccccactttcagggtagcatcctctttccctagttatttcagtgcagaatcgattcacgtgtaagc

SEQ ID NO: 22624 - DNA, 601 bp, Human
gcctgtgtctcaccccagcgctggcaggcaggtagagagaggagaccatccttggattccacgggctcagggcaaagtcctttgcctcggttatacagcgggccaagggcagccagcgtctgaattcagtcctaatcatgagttcttttttttttgttgttcgagatggagtcttactctgtcaccaggctagagtgcagtggtgcgatctcagctcactgcaatctccgcctcctgggttcaagcaattctcctgcctcagcctcccgagtagctgggattacaggcacgtgccaccacrcccgactatttttttgtatctttagtagagatggggtttcactatgttgaccaggctggtctcgaactcctgaacttgtcatctgcccacctcagcctcccaaagtgctgggactacaggcgtgagccaccgtgcccggccaatcctgagttgttaaccactgtgcaggctgctttgtactggccaggtcgaagcccctgtctcactcacctacaatgaagggccccaggtcaaacacgcctccttccttgtccttggggacctcgccatcaggcccatgcccgctgttggggagcagct

SEQ ID NO: 22625 - DNA, 601 bp, Human
gggcccaggagcctagtcagggatgagaagaggaccctctacccacccttccccgtaaacttgaatgataacccccaccacctcccctgacctaaggccctctgctgcctcgaccaggggactgcttgtttggggaaagtcccctccttccctccctccctccctcccatcagggtggggttgttggaaggccacacccccaagcccccaagcctcagcattcataacaggcccagagtagggggcccatgctcccaaggatgctcagtgaatctggagaagctggttggcattcagtccygtctgaggctgcattgtccaattgcagccattagtcatgtaaggttatttcagtttaaattgtaaccaattaaaacgaatcacgtcctggttgcactcgcctcacctgagtgcttggcccctgtggctagtggctgctgcaccggacagtgcaggtgactgtcatttccatcatggcagaaagtgccactgcacagcgaaaccctaagggatgtagctttcctgctattggtctgttcaccatcattagttacgatgatgatgacagtggcagctaattccctgagcaggctctgtgtac

SEQ ID NO: 22626 - DNA, 601 bp, Human
ctcccagcctgtgtcttggtctacaacacggggacagccatcacccaccaggtccctgggcagaagtgaggaggtgtcagctgccccctgcagtgcttggtcttcatgcattgagcacctgagttgtatatagctgcacagatgggtaaactgagaccctgagcgggaataacaaccatattgggtcagagggcacccaacaccagacacgcacaagtgatcatagcaggaaccagtttattggttgaggtggtggggaacaggggggttggaggcacaccatgaggagcgagggctcagstctccccagggccctggaaatccatgccctccaccaagtcctgcaggtaggccttgtactggtcggaggtgagggagagtgggtggctgttggaaatgtgcaggtccacagtattctccagggaggaggcaccccctacccgggccatttctaccaaggccctgaggcacgtgggcacaacctgcaggggaagtggggacaggagtcagggaaaacacccagccactgtccaccaaggtaggagtcagggcttggaggactacaactccctgcagcccctgctgtaacctaggatgaacc

SEQ ID NO: 22627 - DNA, 601 bp, Human
tgggttgaggtggtctggggatgatgaaaaagcatgggaatggtgattctgaagtgttaaaagaagtcaggaactgctgatcctgtgcaaatctatataattcccatgtctgcaacagagctggctcttcttttcttgcttcccccatcactaaaatgtgccactatggcctccgccatggtgctcacttccactgtttctttgtgaaacatgggccacttcccttgtaagagaaggagagcagcaccaagtgccttggaggagaaaatatctacaaaaattaaacttgcattaggaaatkaatgttatttttttttctttttatttttagggatggcaaaggaggggggtaacatggataaaaactccaaaccacaggaaaatttgtggaaattatttatatttgtataaagtgttttttccctctctccaaaccaagatgattaagaaactcttttagcattgtacactgaaaaatgtgttaaaagggtagatttcatgttatatgtgtgtatgtgtgtgtgtttagccacaattttaaaaagaaagaaaaaatcgaacagtcttctattaaaagtgaaacatctgaatttcttgagca

SEQ ID NO: 22628 - DNA, 601 bp, Human
ttataccaaaatcaatgacttgataagtttgttctgttcaaagttgtattccaaataatactcgagtcatgtaaatgtttctctgctgaagatgtccaagtcccttgaaataaatagccaaagggaaatcatgcctgcacccaattaggctgctcaggcaaaaggatgaaggtagctgaaatgataactctgtaggatgctctcactgggtaactcatgctgatcacaatatttagctagcaatttaatgatgtagctactctaatggttgtaaaatagggaacttagttaattatgactygataaaggttgttgacaagtgtaatattttaaaacatgggttgaggtggtctggggatgatgaaaaagcatgggaatggtgattctgaagtgttaaaagaagtcaggaactgctgatcctgtgcaaatctatataattcccatgtctgcaacagagctggctcttcttttcttgcttcccccatcactaaaatgtgccactatggcctccgccatggtgctcacttccactgtttctttgtgaaacatgggccacttcccttgtaagagaaggagagcagcaccaagtgccttggaggag

SEQ ID NO: 22629 - DNA, 601 bp, Human
agctatattaactaaggtttaacaataccttaggaagactttgcctgaccttttatttgggaactccttgatgtagctgtcactctgctctactcacagccactctctcatttactccacctttaccataaagagagggatgctagcttccctattaagagttcctgggatgtctgaaatccttggagtctacaattcagacttactcttattgccatttgcttttataccaaaatcaatgacttgataagtttgttctgttcaaagttgtattccaaataatactcgagtcatgtaaatrtttctctgctgaagatgtccaagtcccttgaaataaatagccaaagggaaatcatgcctgcacccaattaggctgctcaggcaaaaggatgaaggtagctgaaatgataactctgtaggatgctctcactgggtaactcatgctgatcacaatatttagctagcaatttaatgatgtagctactctaatggttgtaaaatagggaacttagttaattatgacttgataaaggttgttgacaagtgtaatattttaaaacatgggttgaggtggtctggggatgatgaaaaagcatgggaa

SEQ ID NO: 22630 - DNA, 601 bp, Human
tgactacttttaaagtaaaagccacttagttctacacttaatgcagaaaatccataaaaactgacatcaattatagcaaaagtcagctatctggatgattatggcctggaatggaatccatacgcctcagcaggatagggcataaagaaggcaggtaggatgaaaggctaaatcgtaatctctggaaacccattccacagcgccattaggttatttctattatttagaaataactgggcagtaaggaacagctttctgctttttcgggccaaactgcagacatgaacgtttagtgtctctstaaagacatattcgctggggtttaaggagtgactagagagtctgaaaatagatgaaagtggggtccccagcaaaaatctatccagcgttttcaaaacttttttaatagtggggcagaattcttaagctacattgattggcatattacctcatgcatgtgtttttcctgaagggggaaaatattccatttcatatgcaaacatctgagaaagcatcttgcttataccataacagtgaagtctcacggcactgtggcatccctcaccagcaggaagaaattcaaggccagtctctccactcc

SEQ ID NO: 22631 - DNA, 601 bp, Human
aatttgtgggctttgaaaaagcaaactttgttttttgcttcctcaggcacacagccttaaacacctcaacttgactgcatattcataagtaactccagagagctgccataagcaggagctagagagaatatagcggctgcccacgtaaacacggccattgcacacaagcgtgtgtaactgggaaaatctgctagggacagaaatccttaggcttgctgaaagagggctttgtgtctgtctcaaagcccagttacccatgatttgaaaaaggcaggtcggagaaaacccagatcccttgaakattcctgttaggctttcggttctgtgaacctgactcagcttaccttgaaaggcagaaaaatggcaactggaccagttcctatttaagagagatttaattattctgcttaacctcagcctgagctaatagctccgatgatttctgagaagtctgaaatagttttctgaggttagtaaggaaaagtctacctgcaaatgtgcaggttcccgccacttctgttacatatctttcattgcatgtcctaagctatttttcagagaatgccttgtcttcctgggtctttgtgttaattccatatga

SEQ ID NO: 22632 - DNA, 601 bp, Human
aaaaggagtctgcatgttcatttttttaaccgtatgaaatacctgctcttgacagattccatttctgtatttttaaagctgaaataatttaaaagaaacaaacaaacaatgagaccttgtataaccacaataggaatctcactagttaaaccatcctttaaatgacagccattttcttctcaatgcagctttctttatagtgagagtatgaaaagaagtcttttccatgcctacttctgttgagaagattgctataaattgggaccacatctgcaaaaaagaagcattaccaagaaaacarcaacaacaaaacattgaaaattaaaatatttcaaacaatactcttaaacagttgtgcaaatctgtgttggtttttaaaacactgcctgtttcttatttttttttctttcagcttaaagcatattaaaataagacttttatcactttttaaaagaaagcttggctgtcctttggcgaacactaacaatttacaatggcatggcctttgagaaaacagaagtcattttacaaattcacaatgttcctctgatttcaaatggatgccccatttaaaataaaataaaataagaagcacaacctc

SEQ ID NO: 22633 - DNA, 601 bp, Human
gaaatgactattagcgacaatattttgtgctagcgaagattgcatcgacacacagtgcaaaatgggagaggggagaggaagtaagaagacaacttggggtatttaaatagaaaggacaactaagccttattttagttagcttccattgcatccatttaagtctatacatgcctgtaactgtacctagatttaactcaagctctttaagaccttgagctctgagagaatgtgtcagttccttccgacttctgatgtgctgctatacagcatccctttgcagttgtactgtccttgacaatawtaaactcctaacgtagtcataatacacaaaaaatacttatatatataaacccatattgaaaaggagtctgcatgttcatttttttaaccgtatgaaatacctgctcttgacagattccatttctgtatttttaaagctgaaataatttaaaagaaacaaacaaacaatgagaccttgtataaccacaataggaatctcactagttaaaccatcctttaaatgacagccattttcttctcaatgcagctttctttatagtgagagtatgaaaagaagtcttttccatgcctacttctgttg

SEQ ID NO: 22634 - DNA, 601 bp, Human
atatgaataaatccctccttccccaggacgaaactaccatcctccaccatccaaccctctaaacagcacgaatttaaaaatcttgcaattttatttgcatataaaggccgctagatatagaatatcacaataaatttaaagaaacaactgctttcctaaatttcattaacaaagtaacataaaatagaataaagctcaacagcatttacaatgggaaaacagaaatgactattagcgacaatattttgtgctagcgaagattgcatcgacacacagtgcaaaatgggagaggggagaggaagtaagaagacaacttggggtatttaaatagaaaggacaactaagccttattttagttagcttccattgcatccatttaagtctatacatgcctgtaactgtacctagatttaactcaagctctttaagaccttgagctctgagagaatgtgtcagttccttccgacttctgatgtgctgctatacagcatccctttgcagttgtactgtccttgacaataataaactcctaacgtagtcataatacacaaaaaatacttatatatataaacccatattgaaaaggagtctgcatgttcat

SEQ ID NO: 22635 - DNA, 601 bp, Human
ttcctttgctccctcgccttttagatatggtctcagggaagtgagtttgggatagctaaggaaaaacaagagtgagtggttagtttacataaatcaaagaatttgcttagagtatcttgattctctgtcttcagtcttatttatttctttagtatccacctagtctaagcacagaagcaataaagatgggcaagaaaaaaatcactgcttttaaggaactcagaatctagtggcaaagacagtcgaataaaggaaatagtttcagaataacatggtaaatgtcatggaggtatttggggarcaaagcagagaacacctagactttgctaggcgtggcagaagtgggctaaggaagcagtcaggaaaggcttcccagagagtgtggagcttgagctgtaccatgaaggacaaagtgcagttggccagctggacaagggaagggaagagattctacataatgagagtcgcgtgtgcagaaacgaaggaatactgaagcaagccacatgcactgaacccggttgccttctctaccgacttggtattacattggtagtaaacttaagaaggtgttttcatcaaaatgatttataaatgcatctaa

SEQ ID NO: 22636 - DNA, 601 bp, Human
ataaaggaaatagtttcagaataacatggtaaatgtcatggaggtatttggggaacaaagcagagaacacctagactttgctaggcgtggcagaagtgggctaaggaagcagtcaggaaaggcttcccagagagtgtggagcttgagctgtaccatgaaggacaaagtgcagttggccagctggacaagggaagggaagagattctacataatgagagtcgcgtgtgcagaaacgaaggaatactgaagcaagccacatgcactgaacccggttgccttctctaccgacttggtattacaytggtagtaaacttaagaaggtgttttcatcaaaatgatttataaatgcatctaagtcttaaaaacattaaaaaatgaaacagcggttttcagtgggggcaagtttgcccccagcggacatttagcaacatttagagacatttttgattgccacaacttagaagtaggggacgctcctggcagctagtggggccgtggccgggctgctgctcaacatcctgcaatgcacaggacagccccacaacaaagactcacctgccccaaaatgtcaatagtgccaaggtggggaaaccctgttctg

SEQ ID NO: 22637 - DNA, 601 bp, Human
aacatggtaaatgtcatggaggtatttggggaacaaagcagagaacacctagactttgctaggcgtggcagaagtgggctaaggaagcagtcaggaaaggcttcccagagagtgtggagcttgagctgtaccatgaaggacaaagtgcagttggccagctggacaagggaagggaagagattctacataatgagagtcgcgtgtgcagaaacgaaggaatactgaagcaagccacatgcactgaacccggttgccttctctaccgacttggtattacattggtagtaaacttaagaaggtrttttcatcaaaatgatttataaatgcatctaagtcttaaaaacattaaaaaatgaaacagcggttttcagtgggggcaagtttgcccccagcggacatttagcaacatttagagacatttttgattgccacaacttagaagtaggggacgctcctggcagctagtggggccgtggccgggctgctgctcaacatcctgcaatgcacaggacagccccacaacaaagactcacctgccccaaaatgtcaatagtgccaaggtggggaaaccctgttctgtatgaccaagcagctatgaaaa

SEQ ID NO: 22638 - DNA, 601 bp, Human
agtgcagttggccagctggacaagggaagggaagagattctacataatgagagtcgcgtgtgcagaaacgaaggaatactgaagcaagccacatgcactgaacccggttgccttctctaccgacttggtattacattggtagtaaacttaagaaggtgttttcatcaaaatgatttataaatgcatctaagtcttaaaaacattaaaaaatgaaacagcggttttcagtgggggcaagtttgcccccagcggacatttagcaacatttagagacatttttgattgccacaacttagaagtrggggacgctcctggcagctagtggggccgtggccgggctgctgctcaacatcctgcaatgcacaggacagccccacaacaaagactcacctgccccaaaatgtcaatagtgccaaggtggggaaaccctgttctgtatgaccaagcagctatgaaaacgaccaggttagatgggatatgctgacatagaaagatcatcaagatatagttgaggggaagcaaggcacacaccagtgtgtatctcatgagttcctttgtgtgaacatgtatgtgtacagttaagtatagatgattttcaaag

SEQ ID NO: 22639 - DNA, 601 bp, Human
catgaagtgatgtgactagtaactgttttatagcaagcgcagaggtgatgtttatagagctatttcttgtcttaaccatgcgccaactcctcattgttccttctgcttccttttgcttaaggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcraatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtg

SEQ ID NO: 22640 - DNA, 601 bp, Human
gtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccrtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtata

SEQ ID NO: 22641 - DNA, 601 bp, Human
gcccgggctgtgacaagggcagggaggccttgagacccccgcctgccctgagatagagggagactgcttgctgcaggctgcccctgcgggaaccccttggtgccctaattctcaggacacacaagctgcacaaggctgcacaagctggcttagggaaggggggcgcggtctgtgagagggcgagctgtaccaagatggccctgcaggcccatttcaccctccttccacctagcctgcccagcactcacccagggggagacacaggccagtcaccggaggctctgagaggctggtgggctcyagagtagaactgccggtccctgagcctttattccctgaggaggaagtggatcattagtgaggatgatgcagtttctccgagggctgtcccgggagccctccccttgggtcatgtgagccctggacttccctggagcaggacacgggattggggtgggggtgggaggatctgggcacacgtgtgcagcagcctcggcccacacagcctccgggtggacctgcaggggcctgtttgtgctgtaggcttgacacgtccaggtatctctgtgtgtctgtgtatctcagtgtgagtgtgtgtgtg

SEQ ID NO: 22642 - DNA, 601 bp, Human
acaccagtgaagtaaaaattgtcccctagagacaggatgaagtctgcacccaggatctgcacagtccgagcgatctccttggcattggccatttcccgggccgtgtggaatggggcattggggacccctccccagtcacccacggctacaaagcgcagggcaggggtggcaccatcagccagggagggtagcaacaaggcttgcaggatgagcagcgccgtccacatgtccatctgggagaagagagacaagcataggtggcccgggctgtgacaagggcagggaggccttgagacccccrcctgccctgagatagagggagactgcttgctgcaggctgcccctgcgggaaccccttggtgccctaattctcaggacacacaagctgcacaaggctgcacaagctggcttagggaaggggggcgcggtctgtgagagggcgagctgtaccaagatggccctgcaggcccatttcaccctccttccacctagcctgcccagcactcacccagggggagacacaggccagtcaccggaggctctgagaggctggtgggctctagagtagaactgccggtccctgagcctttattccctgagg

SEQ ID NO: 22643 - DNA, 601 bp, Human
cgcctcctgggcatctgcaggatgggagcttctcttctgcctctggtctccaagcagtcacacagacatttttagctccttctaggaactttgctgctaacagctttagagaaagagttgggaatagaaatatcacattggttgaaagttacaaagtctcacaataaagctggtctctggggagtaggcctgatgtaaggaaatgtgttctcagtcaatattctaagaaccttcatgaaggaaggctgccccgggccttccccctgcctaacagatggtgttcatcacagagaaatggagmaaaccagcaggaaactggtgagaacctgtgggctcttctcacccagagccacaggaatggtgcattactgaggcctgtcctgtggagagctgtgccaggcctggggcaggggctttttaccaggactgtgtgtcagtataccacgcctagcctcactcccagattctggtccaacaagtctgaattgctcccccatcacctacactgataaacaaccaccagtgatctgatgcatttcccaattcatgagccacagctctgacttaaacagtacgtgccagccttcatggagtttaggat

SEQ ID NO: 22644 - DNA, 601 bp, Human
tgagctctaactgtgccactgcactccagcctgtctctaaatataaattcagatagatcctgtctctaaaaataaataaataaataaataaatagaatattgagagggttaagaaggaaatcaggagatgggaaatagaaggaaagaaaagaaggaggtcacactatggtatctttaaactttattgctctgaaggagggtaaaagttccaaagagtggatgtttggtcatagggccagctctgcttcaaactcaacagggacattccttgattcctgaacatctctgatctactgtcccwtcttggccatgcccttccccatactgcctcccaacagggcctctcgcctcctgggcatctgcaggatgggagcttctcttctgcctctggtctccaagcagtcacacagacatttttagctccttctaggaactttgctgctaacagctttagagaaagagttgggaatagaaatatcacattggttgaaagttacaaagtctcacaataaagctggtctctggggagtaggcctgatgtaaggaaatgtgttctcagtcaatattctaagaaccttcatgaaggaaggctgccccgggc

SEQ ID NO: 22645 - DNA, 601 bp, Human
tttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatataaattcagatagatcctgtctctaaaaataaataaataaataaataaatagaatattgagagggttaagaaggaaatcaggagatgggaaatagaaggaaagaaaagaaggaggtcacactatggtatctttaaactttattgctcygaaggagggtaaaagttccaaagagtggatgtttggtcatagggccagctctgcttcaaactcaacagggacattccttgattcctgaacatctctgatctactgtcccttcttggccatgcccttccccatactgcctcccaacagggcctctcgcctcctgggcatctgcaggatgggagcttctcttctgcctctggtctccaagcagtcacacagacatttttagctccttctaggaactttgctgctaacagctttagagaaagagttgggaatagaaatatcacattggttgaa

SEQ ID NO: 22646 - DNA, 601 bp, Human
ggggcaccaccatgtaccctggcattgctgacaggatgcagaaggagatcacagccctggcccccagcaccatgaagatcaaggtgggtcttgcctcagttgtctccatcctgttctttgtataaagtcttgcctacctgggagttcctcggaggcagactgccagacctgataacttgcaggtctcctgggttcaatatcatcctggactggagccaattttatcctacagaattatgttccttgggcattgatgggctgaagacccacttagcatggatctcaaacataatcccaggamtgtcacatgagaagaggctgaaagaatttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatataaattcagatagatcctgtctctaaaaataaataaataaataaataaatagaatattgagagggttaagaaggaaatcaggagatgggaaatagaaggaaagaaaagaaggaggtcacac

SEQ ID NO: 22647 - DNA, 601 bp, Human
acctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaaggtgggtcttgcctcagttgtctccatcctgttctttgtataaagtcttgcctacctgggagttcctcggaggcagactgccagacctgataacttgcaggtctcctgggttcaatatcatcctggactggagccaattttatcctacrgaattatgttccttgggcattgatgggctgaagacccacttagcatggatctcaaacataatcccaggactgtcacatgagaagaggctgaaagaatttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatataaattcagatagatcctgtctctaaaaataaataaataaataaataaata

SEQ ID NO: 22648 - DNA, 601 bp, Human
agacactgtgatctccactaggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaaggtgggtcttgcctcagttgtctccatcctgttctttgtataaagtcttgcctacctgggagttcctcggaggcagactgccagacctgataacttgcwggtctcctgggttcaatatcatcctggactggagccaattttatcctacagaattatgttccttgggcattgatgggctgaagacccacttagcatggatctcaaacataatcccaggactgtcacatgagaagaggctgaaagaatttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatat

SEQ ID NO: 22649 - DNA, 601 bp, Human
atctcaaaaagttatgaaaaaagaaagatgatataacaaaagtgttcctttagaaatatgcttcaggcaacagtgtaaaagatcaggccgggtgtaatacctcacgcctgtaatcccagcactttgggaggccgagatgagtggatcacaaggtcaggagatggagaccatcctggtcaacatggtgaaaccccatctctactaaaaatacaaaatttagctgggcgtggtggcatgtgcctgtaatcccagctactcgggaggctgagacatgagaatcacttgaaccagggatcagagkttgcagtgagctgagatcgcgccactgcactccagcctggtgacagagcagactccatctcagaaaaaaaaaaaaaagatcaatcagaactggggacaataaaggaaaggccatgacaaggaagggggtctgatcttataatccttctgggagatattaaggttctgaactagggtagttgcaacaatcgaagaagggtcatttgaggagctggaggtgtgcatatttaggaagtgatgcctgttgaccagacactgtgatctccactaggcatggagtccgctggaattcatgagacaa

SEQ ID NO: 22650 - DNA, 601 bp, Human
tctaaaattagattttggtgatgtttgcttctgtggatatactgaaaatgactgaattatatctcaaaaagttatgaaaaaagaaagatgatataacaaaagtgttcctttagaaatatgcttcaggcaacagtgtaaaagatcaggccgggtgtaatacctcacgcctgtaatcccagcactttgggaggccgagatgagtggatcacaaggtcaggagatggagaccatcctggtcaacatggtgaaaccccatctctactaaaaatacaaaatttagctgggcgtggtggcatgtgcytgtaatcccagctactcgggaggctgagacatgagaatcacttgaaccagggatcagagtttgcagtgagctgagatcgcgccactgcactccagcctggtgacagagcagactccatctcagaaaaaaaaaaaaaagatcaatcagaactggggacaataaaggaaaggccatgacaaggaagggggtctgatcttataatccttctgggagatattaaggttctgaactagggtagttgcaacaatcgaagaagggtcatttgaggagctggaggtgtgcatatttaggaagtgatgc

SEQ ID NO: 22651 - DNA, 601 bp, Human
gaaacatccagaataggcaaacctctaaagacagaaagtggattcactgttacctagggctggggcagggatggaggggaaaatggggagtgaccgctattaggtatgggggtctcttttgaaggtatttaaaatgttctaaaattagattttggtgatgtttgcttctgtggatatactgaaaatgactgaattatatctcaaaaagttatgaaaaaagaaagatgatataacaaaagtgttcctttagaaatatgcttcaggcaacagtgtaaaagatcaggccgggtgtaatacctcrcgcctgtaatcccagcactttgggaggccgagatgagtggatcacaaggtcaggagatggagaccatcctggtcaacatggtgaaaccccatctctactaaaaatacaaaatttagctgggcgtggtggcatgtgcctgtaatcccagctactcgggaggctgagacatgagaatcacttgaaccagggatcagagtttgcagtgagctgagatcgcgccactgcactccagcctggtgacagagcagactccatctcagaaaaaaaaaaaaaagatcaatcagaactggggacaataaa

SEQ ID NO: 22652 - DNA, 601 bp, Human
gaccatatggtgtatgattccattgacaagaaacatccagaataggcaaacctctaaagacagaaagtggattcactgttacctagggctggggcagggatggaggggaaaatggggagtgaccgctattaggtatgggggtctcttttgaaggtatttaaaatgttctaaaattagattttggtgatgtttgcttctgtggatatactgaaaatgactgaattatatctcaaaaagttatgaaaaaagaaagatgatataacaaaagtgttcctttagaaatatgcttcaggcaacagtrtaaaagatcaggccgggtgtaatacctcacgcctgtaatcccagcactttgggaggccgagatgagtggatcacaaggtcaggagatggagaccatcctggtcaacatggtgaaaccccatctctactaaaaatacaaaatttagctgggcgtggtggcatgtgcctgtaatcccagctactcgggaggctgagacatgagaatcacttgaaccagggatcagagtttgcagtgagctgagatcgcgccactgcactccagcctggtgacagagcagactccatctcagaaaaaaaaaaa

SEQ ID NO: 22653 - DNA, 601 bp, Human
tggccaggcgcggtggctcacgcctgtaatcccagcactttgggaggctgaggcaggcagatcacttgagcctgtgagtttgagaccagactgggcaacatagcgaaaccccatctctatgaaaaatacaaaatttagcagggcatggtggtgcatgcccatggtcccagatactcaggaggctgaggtgggagaatcgcttgagccgcagagatcaaggctgcagtgagccgtgattgtgtcactgcactccagcctgggcaacagggtgagattctgtctcaaaaaaaaaaaaaaaaaagagtagaggtaagtagaccaggcagatggcaagagccagtttggcgtgcaggaccttttgctctagaagactgtgatgccaggctacagtagctggatgtcaacctgcaggcaatgggtgactgtcagatgacatgacgagtatatccatacaatggaatcttatttggcaataaaagggaatgaagtattgatccatgctgtgaccttgaaaacattatactaagtgaaaggagccacacacagaagaccatatggtgtatgattccattgacaagaaacatccagaataggcaaacct

SEQ ID NO: 22654 - DNA, 601 bp, Human
gaatgagatggccacagcagcttcctcttcctccctggagaagagctatgagctgccagatgggcaggttatcaccattggcaatgagcgcttccgctgccctgagaccctcttccagccttcctttattggtgaggtgctgcccacagtccctgccaatctcaggaggggagggtggaggagtgggtgaggtatggagagagaaacaccaggagtcatggccactttgttaattacatacacgtacctcacattttcctaggaagggccaaaaatgtattttaaaaaaaattagggaaaatctcattttaaataaaagggaaaggaaatcaagatacaggaaaagcagaacaggaaatataacatgaaacttaagaatgaggttaaaacacagaaagtttgtaggcagcaatgtagcaaggtcaggttgtagtttagcaagattcttctatctacagtgtggaatcatattgcatggataaaagaccggaggcttggccaggcgcggtggctcacgcctgtaatcccagcactttgggaggctgaggcaggcagatcacttgagcctgtgagtttgagaccagactgggcaacatagcga

SEQ ID NO: 22655 - DNA, 601 bp, Human
aggggaaggtgtcatgtggcccacctgggcaatcggcattttttaggtgggagcctctctaggttctgtaagatcaaacatctgagtctagaccagaaatatgtcctgcaaagcccccaggaaggcctaaggctttgtcagaaatctcatgcaaagtcctgcatgggaatcaagacttgagactccctctttagaaagaggagtagaagaattaagattgaatggagtgacgcttgaccctcttcgcggcaagtctatcatcatcctatgactgaacctaaagtagacgtgaggccaggcrtggtggctcacgcctgtaatcccagtactttgggaggccaagcaggcagatcacttgaggtcaggagttctagaccagcctggccaacatggtgaaatcctgtctctactgaaaacacaaaaattagccgagcttagtggcgcacgcctgtaattccagctacttgggaggctgaggcaggagaattgcttgaactcaggaggtagaggttgcagtgagccaagatagcaccactgcacttcagtctgggtgacagagtgagactctgtctcaaaaaaaaaaaaaaaaaaagaataaagt

SEQ ID NO: 22656 - DNA, 601 bp, Human
caggctgaatggtagtgaagatctgctgatgcatttcattacctaggggcacctttggtttgaggacaaattgaataagtgaggcccgaatttctaaggggaaggtgtcatgtggcccacctgggcaatcggcattttttaggtgggagcctctctaggttctgtaagatcaaacatctgagtctagaccagaaatatgtcctgcaaagcccccaggaaggcctaaggctttgtcagaaatctcatgcaaagtcctgcatgggaatcaagacttgagactccctctttagaaagaggagtrgaagaattaagattgaatggagtgacgcttgaccctcttcgcggcaagtctatcatcatcctatgactgaacctaaagtagacgtgaggccaggcatggtggctcacgcctgtaatcccagtactttgggaggccaagcaggcagatcacttgaggtcaggagttctagaccagcctggccaacatggtgaaatcctgtctctactgaaaacacaaaaattagccgagcttagtggcgcacgcctgtaattccagctacttgggaggctgaggcaggagaattgcttgaactcaggaggt

SEQ ID NO: 22657 - DNA, 601 bp, Human
caatgagaattctgtgactctgtgtctttaaactctcctgagatagactgagaggccttaagctggggctaggcctctggataagaccagatagtcatggaagcagtccctccttccccagagaccagctgcctctgtccacgtccacaccaggactagggctagtttccacaggctgaatggtagtgaagatctgctgatgcatttcattacctaggggcacctttggtttgaggacaaattgaataagtgaggcccgaatttctaaggggaaggtgtcatgtggcccacctgggcaatyggcattttttaggtgggagcctctctaggttctgtaagatcaaacatctgagtctagaccagaaatatgtcctgcaaagcccccaggaaggcctaaggctttgtcagaaatctcatgcaaagtcctgcatgggaatcaagacttgagactccctctttagaaagaggagtagaagaattaagattgaatggagtgacgcttgaccctcttcgcggcaagtctatcatcatcctatgactgaacctaaagtagacgtgaggccaggcatggtggctcacgcctgtaatcccagtactttgg

SEQ ID NO: 22658 - DNA, 601 bp, Human
aagcctgatcctctctgtccacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacaggtatccagccccttttctgattctgactggagctcagaaccaatctggtttaggacaagaagttctcaggaccaatgagaattctgtgactctgtgtctttaaactctcctgagmtagactgagaggccttaagctggggctaggcctctggataagaccagatagtcatggaagcagtccctccttccccagagaccagctgcctctgtccacgtccacaccaggactagggctagtttccacaggctgaatggtagtgaagatctgctgatgcatttcattacctaggggcacctttggtttgaggacaaattgaataagtgaggcccgaatttctaaggggaaggtgtcatgtggcccacctgggcaatcggcattttttaggtgggagcctctctaggttctgtaagatca

SEQ ID NO: 22659 - DNA, 601 bp, Human
ggtgaatattcttaactggtaaaggaaaatatggtagtcagagctcattggtaacagtcctagaaagagactgatgaaaggcaagaatgagaattttataagcctgatcctctctgtccacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacaggtatccagcccctttyctgattctgactggagctcagaaccaatctggtttaggacaagaagttctcaggaccaatgagaattctgtgactctgtgtctttaaactctcctgagatagactgagaggccttaagctggggctaggcctctggataagaccagatagtcatggaagcagtccctccttccccagagaccagctgcctctgtccacgtccacaccaggactagggctagtttccacaggctgaatggtagtgaagatctgctgatgcatttcattacctaggggcacctttggtttgaggacaaattg

SEQ ID NO: 22660 - DNA, 601 bp, Human
agcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacataaaaaataaaaaatatgattgatgattcttgtgatgggtgaatattcttaactggtaaaggaaaatatggtagtcagagctcattggtaacagtcctagaaagagactgatgaaaggcaagaatgagawttttataagcctgatcctctctgtccacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacaggtatccagccccttttctgattctgactggagctcagaaccaatctggtttaggacaagaagttctcaggaccaatgagaattctgtgactctgtgtctttaaactct

SEQ ID NO: 22661 - DNA, 601 bp, Human
tcctggacaatattaaaaaatagtggtgatattgtaatgttttctcatccgttatgatgtggctgtcagattaagaaatacgaggctggacgcagtggcacatgcctgtaatcccagcactttgggaggccgaggcaggtggattgcctgaggtcaggagttcaagaccagcctggccaacatagtgaaaccccacatctactaaaaatacaaaaaattggctgggcgtggtggcaggcacctgtaatcccagctactcaggaggctgaggcaggagaatcacttgaacgtaggagacagrggtttcagtgagccgagatcatgccattgcactccagcctgggcaacaagagcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacataaaaaataaaaaatatgattgatgattcttgtgatgggtgaatattcttaactggtaaaggaaaatatggtagtcaga

SEQ ID NO: 22662 - DNA, 601 bp, Human
attatctgcaaataatgacaattttggtagtcacacctcctatttctattttctgtttcactgcaattggctagaacatcctggacaatattaaaaaatagtggtgatattgtaatgttttctcatccgttatgatgtggctgtcagattaagaaatacgaggctggacgcagtggcacatgcctgtaatcccagcactttgggaggccgaggcaggtggattgcctgaggtcaggagttcaagaccagcctggccaacatagtgaaaccccacatctactaaaaatacaaaaaattggcygggcgtggtggcaggcacctgtaatcccagctactcaggaggctgaggcaggagaatcacttgaacgtaggagacaggggtttcagtgagccgagatcatgccattgcactccagcctgggcaacaagagcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacat

SEQ ID NO: 22663 - DNA, 601 bp, Human
cacattatctgcaaataatgacaattttggtagtcacacctcctatttctattttctgtttcactgcaattggctagaacatcctggacaatattaaaaaatagtggtgatattgtaatgttttctcatccgttatgatgtggctgtcagattaagaaatacgaggctggacgcagtggcacatgcctgtaatcccagcactttgggaggccgaggcaggtggattgcctgaggtcaggagttcaagaccagcctggccaacatagtgaaaccccacatctactaaaaatacaaaaaattrgctgggcgtggtggcaggcacctgtaatcccagctactcaggaggctgaggcaggagaatcacttgaacgtaggagacaggggtttcagtgagccgagatcatgccattgcactccagcctgggcaacaagagcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacata

SEQ ID NO: 22664 - DNA, 601 bp, Human
cactttgggaggctgaggtgggtggatctctttgagctcaggagttcaagaccagcctgggcaacatggctacaacctatctctacaaaaaatacaaaaagttagccgggcattggtagtcacgcctgtagtcccagctactcggtaggctgaagctggagaattgctggagcccaggaggcagaggctgcagtgagctgagatctcaccactgcactccagcctgggtgacactcaaaaaaaaaataaaaaaataaaagacagtataagaaatacataagccagtactagtaccatagtygtttattatcattttcaagtatgttgtacataatgtatgtgctgtacttttatacagctggcagcacagtaggtttgtttacaccagcatcaccacaaacacgtgaataaagcgttgccctatgacgtgatgtcagctatgatgtcactaggcaataagaatttttcagcttccttataatattatggcaccaccattgtgtatgtggtccgaagttgaccaaaatgtcattatgtggacatgactatatgtggccttggtatagaagtgtgctcagcgtaacagaggaaatctcaaaat

SEQ ID NO: 22665 - DNA, 601 bp, Human
tgtcgatcagaaatttccagggctgaccattctcctctccagatccatctcatgttggccaggctggtctcgaactcctgatctcaagtgatctgcccacctcagcctcccaaagtactgggattacaggtgtgatcatcacccccagccaaaaatattttcatttatatcctttattctacaagcttttttctattaaatttattttattttattttttacttttagagcttttttgataaaaactaaaatatacacacattagcctcggcctacacaggttcaggatcatcaataccaytgtatttcatctccacatcttggcccactggaaggtcttcagggttaataacatgcatggagctgtcatctcctatgataacaatacctccttctggaatatctccggaaggacctgcctaaggctgttttacagtcaactttttatttaataagtagaaggagtacactttaaaataatgattaaaaacatagtataagagctgggtgcagtggcttatgcctgtaatcccagcactttgggaggctgaggtgggtggatctctttgagctcaggagttcaagaccagcctgggcaaca

SEQ ID NO: 22666 - DNA, 601 bp, Human
aaacgattctcctgcctcagcctcccatgacttttttttttttttttttttgagatgaagtctcactctgtcacccaggctggagtgcagtagtgcgatctcagctcactgcaacctccgcctcctaggttcaagtgattctcatgcctcaaactcccaagtagctgggactacaggagcgtgccaccatgcctggcttatttttgtctttatttagtagagaaaaaaaaggagtacaccctttaaatgtcgatcagaaatttccagggctgaccattctcctctccagatccatctcatsttggccaggctggtctcgaactcctgatctcaagtgatctgcccacctcagcctcccaaagtactgggattacaggtgtgatcatcacccccagccaaaaatattttcatttatatcctttattctacaagcttttttctattaaatttattttattttattttttacttttagagcttttttgataaaaactaaaatatacacacattagcctcggcctacacaggttcaggatcatcaataccattgtatttcatctccacatcttggcccactggaaggtcttcagggttaataaca

SEQ ID NO: 22667 - DNA, 601 bp, Human
agtgcagtagcgtgatctcggctcattgcaacctctgtctcccacgttcaaacgattctcctgcctcagcctcccatgacttttttttttttttttttttgagatgaagtctcactctgtcacccaggctggagtgcagtagtgcgatctcagctcactgcaacctccgcctcctaggttcaagtgattctcatgcctcaaactcccaagtagctgggactacaggagcgtgccaccatgcctggcttatttttgtctttatttagtagagaaaaaaaaggagtacaccctttaaatgtcratcagaaatttccagggctgaccattctcctctccagatccatctcatgttggccaggctggtctcgaactcctgatctcaagtgatctgcccacctcagcctcccaaagtactgggattacaggtgtgatcatcacccccagccaaaaatattttcatttatatcctttattctacaagcttttttctattaaatttattttattttattttttacttttagagcttttttgataaaaactaaaatatacacacattagcctcggcctacacaggttcaggatcatcaataccattgta

SEQ ID NO: 22668 - DNA, 601 bp, Human
aatataatatcaaagataaaaaatggtacacctgtgtagggcacttacatgaatggagcttgcaagactagaagttgctctgggtgggttagtgagtgagtagtgagaaaatgtgaagacctaaaatgttactgtgtactactgtagactataaacactgtacacatcggctgtactacatttataaaaatattattcttggccaggcacagtggctcacacctgaaatcccagcactttgtgaggctgaggtgggcggatcacctgaggtcaggagttccagaccagcctggccaacacrgtgaaaccccgtctctactaaaaatacaaaaattagttggacgtggtgtcaggcacctgtaatcccagctacttgggaggctgaggcagaagagtcacttgaacctgggaggcagaggttgcagtgagccaagatcacgccactgccctccagcctgtgtgacagagctgagctccgtctcaaaaaatatgtatatatatatattattctttcttcaataataaattaaccttagcttactgtaatgttttttaccttataaactttttaatttttaaagccatttttactttttttgta

SEQ ID NO: 22669 - DNA, 601 bp, Human
ataggtgagaatgcccatgtggaatgccagatgtgagcctagctggtatagttggaaaaaacatccagcaagaactgtttccctcacagtaataattccaggagcttctacacatacacacattccaacaatactggaatgtttctgcttcatgaagcagaaagagtagaacctgtggtggtggaaatgtaagtgcagttacacattgcttaatgacagggatacgttccgagaaatgtgtgtcattaggtgactttgtcactgtgggaacatcagagagtgtacttgcacaaacctagaygctgtagcctactacatgccccggctgtatggcgtggcctattgcttccaggctacagacagtatagcatttaactataattaatactgtagggaactgtaacagaatggttaggtatttgtatagctaaacatattgaaacatagaaaagttacagtgaaaatataatatcaaagataaaaaatggtacacctgtgtagggcacttacatgaatggagcttgcaagactagaagttgctctgggtgggttagtgagtgagtagtgagaaaatgtgaagacctaaaatgttactgtgtac

SEQ ID NO: 22670 - DNA, 601 bp, Human
gcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgggaatgtcaatgagaattttccagccattgggagtctgccaggctcatatggcttttgtctccacyagatctggcaccactccttctacaatgagctgcgtgtagcacctgaagagcaccccaccctgctcacagaggctcccctaaatcccaaggccaacagggaaaagatgacccaggtaagaagccaggaagacttgaacactggcataagaatgcaacatggatgcttggccagatactttctccccttcaaacatcagtgcaacagaactctctgaggacctgctatgtctgtggtccatgccaggccctgggggagtgggtgtggaataatgaactatcaaactggcatagttcctgccc

SEQ ID NO: 22671 - DNA, 601 bp, Human
ttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgrgaatgtcaatgagaattttccagccattgggagtctgccaggctcatatggcttttgtctccaccagatctggcaccactccttctacaatgagctgcgtgtagcacctgaagagcaccccaccctgctcacagaggctcccctaaatcccaaggccaacagggaaaagatgacccaggtaagaagccaggaagacttgaacactggcataagaatgcaacatggatgcttggccagatactttctccccttcaaacatcagtgcaacagaactctctgaggacctgctatgtctgtggt

SEQ ID NO: 22672 - DNA, 601 bp, Human
tctcagcaggagatagtgtacactcagctgcggttttgaaattgtttgacagtgtatactcagctggggttttacaactggttaaatgaatgtcctacagaaatgtgcatagggttaaggcaactacaaagggatgtcgaggcacccaagagccagcaacagagggagctctcacacccctaaacatgaaggggtcaggtgacgagggcagtgtcattggagcttagtgagagcttgagctctgaaagaggggctgcccaacaggaactgtgctcatggagggccacgccattgtcaggaratagaccctgacttcttttgccctcctactttccagcctcttgcaggaatcttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcct

SEQ ID NO: 22673 - DNA, 601 bp, Human
gttgcccaggctaagcggtggttcttaaccaggatgattttgcttcccaaaggacatttggcaatgtctgcagacattttttattgtcacaactggaaaactgctgctagcatccagtgggtggagaccagggatactggtcggccctccacaacaaagaattatccaacctaaaatgtcatagagctgcgattgagaaaccctgctttaaagcaccagcctggccaataatagccagtgaaaattgagcccaagtgcctctgtcagattctcagcaggagatagtgtacactcagctgckgttttgaaattgtttgacagtgtatactcagctggggttttacaactggttaaatgaatgtcctacagaaatgtgcatagggttaaggcaactacaaagggatgtcgaggcacccaagagccagcaacagagggagctctcacacccctaaacatgaaggggtcaggtgacgagggcagtgtcattggagcttagtgagagcttgagctctgaaagaggggctgcccaacaggaactgtgctcatggagggccacgccattgtcaggaaatagaccctgacttcttttgccctcctactt

SEQ ID NO: 22674 - DNA, 601 bp, Human
gcacataaaatgcaatggatttcacgttatacagtggagtgggtaagagcagagacattagaggcaatggcaggaaatccaggtgcaaatcccaccctataagtcttagttttcccatttgtaaagtgaagataaaaaacactttgtgcattaggttgctttggagattgaattagctaaatgcttagtataatcccaaggcatggaacatacttatgtgctcaataagtgacacatatgattcatatatatgtaacagtatctaatttaaaaacataataggccgggcgtggtggcttaygcctgtaatcccagcactttgggagaccgaggcgggtggatcacaaaatcaggagcttgagaccaacctggccaacatgatgaaaccccgtctctactaaaaatacaaaaattagctggacatggtggcgggtgcctgtaatcccagctactcgggaggctgcggcaggagaatcgcttgaacccgggaggcagaggttgcagtgagccgagattgtgccactgcactccactgtgggtgacagagtgagactccgtctcaaaaaaaaaaaaaaaaaacaaaaaaaaaaaccacataata

SEQ ID NO: 22675 - DNA, 601 bp, Human
gcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaagagcagagacattagaggcaatggcaggaaatccaggtgcaaatcccaccctataagtcttagttttcccatttgtaaagtgaagataaaaaacactttgtgcattaggttgctttgragattgaattagctaaatgcttagtataatcccaaggcatggaacatacttatgtgctcaataagtgacacatatgattcatatatatgtaacagtatctaatttaaaaacataataggccgggcgtggtggcttacgcctgtaatcccagcactttgggagaccgaggcgggtggatcacaaaatcaggagcttgagaccaacctggccaacatgatgaaaccccgtctctactaaaaatacaaaaattagctggacatggtggcgggtgcctgtaatcccagctactcgggaggctgc

SEQ ID NO: 22676 - DNA, 601 bp, Human
cattaaccaacagggggttcctaactccccgtcttggcattggaggacctttccctgcctgatccccgcgatcatcttttcctgaaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggrgagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagt

SEQ ID NO: 22677 - DNA, 601 bp, Human
tcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgmaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggagagcgggatttttaaatggtggagctcatggtaaacaaaattatgtgtgcaaaatgttaatagagcctttctaatattcttgtg

SEQ ID NO: 22678 - DNA, 601 bp, Human
aactgggatgacatggagaaggtatctgtagacttccccttaatgagcctgctttaatgatcacccatcatcatgaccctcgtattcataggccactgtgctctgtcaactctccctgtaaaatgcttctcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacagrtcagctcatgtcactcacctcctcagaaatcttcagtagctcttcattaaccaacagggggttcctaactccccgtcttggcattggaggacctttccctgcctgatccccgcgatcatcttttcctgaaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctc

SEQ ID NO: 22679 - DNA, 601 bp, Human
gaccttccagtgcctgaatccctctgtgtggagccctcagccattcatttctcttttcttctctttgcattgcagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcatcatgaccctcgtattcataggccactgtgctctgtcaactctccctstaaaatgcttctcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatc

SEQ ID NO: 22680 - DNA, 601 bp, Human
tttctgggggaagaaaggctgtttttcccatccttatccttcttcagagaccttccagtgcctgaatccctctgtgtggagccctcagccattcatttctcttttcttctctttgcattgcagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcrtcatgaccctcgtattcataggccactgtgctctgtcaactctccctgtaaaatgcttctcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaac

SEQ ID NO: 22681 - DNA, 601 bp, Human
gtgtgtgtgtgtgtgtctgtgtgtagtaggatgaggggaagaagtgtatgggaggggcttgttttatctcagaaaacatcgttgtctgaagagaaagaagaaaggccaccacacaagaaatcctccaccttctcttcctgacaccttcatactcactggcatctgctccatcctgtctcctgctatcctgtttctgggggaagaaaggctgtttttcccatccttatccttcttcagagaccttccagtgcctgaatccctctgtgtggagccctcagccattcatttctcttttcttctytttgcattgcagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcatcatgaccctcgtattcataggccactgtgctctgtcaactctccctgtaaaatgcttctcacttctgtctttcctttcttttcagccccacgaccatttctccaaccta

SEQ ID NO: 22682 - DNA, 601 bp, Human
ttggaaaaattaatttatatgggattgaacaagcctcttgcctttaagaaatttacactttgtgaagaaatacacataactaaccagagatcatgggctgtaatagaggtaaaatatttcacaggaagggaaaagtatcacagaaaaagtaatatctgagaataagaaggatttcagcaggtggagagaatagcaaagatttggagatctaagcaggcacaggggacttgaggaggatgcatacaagtcgtgtgtgtgtgtgtgtgtgtgtgtgtgtgtctgtgtgtgtgtgtgtgtgtggctgtgtgtagtaggatgaggggaagaagtgtatgggaggggcttgttttatctcagaaaacatcgttgtctgaagagaaagaagaaaggccaccacacaagaaatcctccaccttctcttcctgacaccttcatactcactggcatctgctccatcctgtctcctgctatcctgtttctgggggaagaaaggctgtttttcccatccttatccttcttcagagaccttccagtgcctgaatccctctgtgtggagccctcagccattcatttctcttttcttctctttgcattgcagggt

SEQ ID NO: 22683 - DNA, 601 bp, Human
ggagtaagcgctgcactgtggagaccctgctgagctgggggttaggggaaggaaatgtgtgtgtgtgtgtgtgtgtgtgtgtgtgtgtgtgtgtgtgtgtgtgtctgtgcgtgtgtgtgtgtgtgtgtctgtgcatgcacatgcgtgtgtgcacgccaggtgtagggagttcttttctgattaactgatagagcaggaccctttaaatagaaatatccagggccaaaaccaacatacatcaggcacacaatgacactactatgtctggcttacatttggggggttgccaggtttggaaaarttaatttatatgggattgaacaagcctcttgcctttaagaaatttacactttgtgaagaaatacacataactaaccagagatcatgggctgtaatagaggtaaaatatttcacaggaagggaaaagtatcacagaaaaagtaatatctgagaataagaaggatttcagcaggtggagagaatagcaaagatttggagatctaagcaggcacaggggacttgaggaggatgcatacaagtcgtgtgtgtgtgtgtgtgtgtgtgtgtgtgtctgtgtgtgtgtgtgtgtgtgtctgtgtgt

SEQ ID NO: 22684 - DNA, 601 bp, Human
attacctctttaaagaccctatctccaaatacagtcaccttctgtgtactgggggttaggacttcaacatgaatttttggggggacacaattcacatttcagggcagagggaggaggctcaactgccagtgagtgggaggccaagcccatgcctgtccctcctggaagtgtgccctgattgcaggtagggtcaggccccaaagccaagaaactgtctccaaactgattggacaagtagctgactagttctcttctcccccaaatcccaaggtgctccagtccccagctcactcagccacayacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggagtaagcgctgcactgtggagaccctgctgagctgggggttaggggaaggaaatgtgtgtgtgtgtgtgtgtgtgtgtgtgtgtgtgtgtgtgtgtgtgtgtctgtgcgtgtgtgtgtgtgtgtgtc

SEQ ID NO: 22685 - DNA, 601 bp, Human
tactggatgacagccatattgcattaatctcattttaacttaattacctctttaaagaccctatctccaaatacagtcaccttctgtgtactgggggttaggacttcaacatgaatttttggggggacacaattcacatttcagggcagagggaggaggctcaactgccagtgagtgggaggccaagcccatgcctgtccctcctggaagtgtgccctgattgcaggtagggtcaggccccaaagccaagaaactgtctccaaactgattggacaagtagctgactagttctcttctcccscaaatcccaaggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggagtaagcgctgcactgtggagaccctgctgagctgggggttaggggaaggaaatgtgtgtgtgtgtgtgtgtgtgtgtgtgtgtg

SEQ ID NO: 22686 - DNA, 601 bp, Human
aagagaaagaaagaatgcgtgcagcagatgttgggaaagttaatttcttcattattttgcatccatcccagttcggatctcagcatggggtagggaatcctctgttgtccccatctgtcgaggcaacagtgagtcccatcatggagtcccttcttttcctctctcctcccagagtgccccttcctcatcaaggtgcttctacccttaggagtgtacatttcacctataaccactgcctattttttcctagtgatatgttatgctattgatttttaattatataaactatatgcaaatgcakcctccttgtaaaaaaattaaaatattatagatataacccagcacttcttctcccagttcctttccacactcccagaggtaatcatgataatcagtttgctaggtgtccttccagaacttttagcttctttctttggcttgtatatggccaccttctcactgcatcctcccgtggcctaccctctgcatgcatctggatcctaattccctcttcttataaagacacccattgtactggagtagtcatactggatgacagccatattgcattaatctcattttaacttaattacctctttaa

SEQ ID NO: 22687 - DNA, 601 bp, Human
tgggaagggcttccttttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccataggcacctgcaatcgcacatcctggataaaacttcagccggccttctctttatgtgcctggcgcctctcttttctctgggtttttggaagtctgcctrcccagcccctcagctggggccttccccacttctgccccgccccactgggtcctcccagggtaggaggcaatctctgactgtcttccgaggctctgttgcttctccttcatcaccaaatgccaggaatttgtcagatgctgtttgtaactcaaaagaaagaaagaaaaagaaaaagatacaggaaggaaggaaggcagaaaaagagaaagaaagaatgcgtgcagcagatgttgggaaagttaatttcttcattattttgcatccatcccagttcggatctcagcatggggtagggaatcc

SEQ ID NO: 22688 - DNA, 601 bp, Human
tttaagaagtcacagcaggcctctcccctagtatgagccttgctttgaacatatctgggaagggcttccttttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccataggcacctgcaatcgcacatcctggataaaacttcagccggcyttctctttatgtgcctggcgcctctcttttctctgggtttttggaagtctgcctgcccagcccctcagctggggccttccccacttctgccccgccccactgggtcctcccagggtaggaggcaatctctgactgtcttccgaggctctgttgcttctccttcatcaccaaatgccaggaatttgtcagatgctgtttgtaactcaaaagaaagaaagaaaaagaaaaagatacaggaaggaaggaaggcagaaaaagagaaagaaagaatgcgtgcagcagatgttgggaaagttaatt

SEQ ID NO: 22689 - DNA, 601 bp, Human
ctgggattacaggcgtgagccaccgcgcccggccacaagaactttcacagtttggtgattgaaacccacatataggaattcatattcatttcattaaatttaaccttggctgtgtgtggtgggtcacttgtaatctcagcactttgggaggctgaggcaggagaatcacttgaacccaggagttcagaccagcctgggcaacagagggagactctgtttctacagaaaaaaatttttatatcagccagccatagagcatgcctgtgatcccagctacttgggatgctgaggtgggaggatygcttgggcctgggaggtcgagtctgcagtgaactgtgttcttgccactgtactgcagcttgggtgacagagcaagaccccatctcaaaaaatatatatatatatatcttctgattcagctcattttctgtgccttttgagatcttcttggacttttattctttcacccagtgtatttaatattactctctcccagctgttttatctgaaaactttatcaacctgtgctttatattttcattcaattcatttataaaaatgtcacatgagaaagggtcaagagtagagccctgggacatat

SEQ ID NO: 22690 - DNA, 601 bp, Human
ttgatctcctgacgtcgtgatccgcccaccttggcctcccaaagtgctgggattacaggcgtgagccaccgcgcccggccacaagaactttcacagtttggtgattgaaacccacatataggaattcatattcatttcattaaatttaaccttggctgtgtgtggtgggtcacttgtaatctcagcactttgggaggctgaggcaggagaatcacttgaacccaggagttcagaccagcctgggcaacagagggagactctgtttctacagaaaaaaatttttatatcagccagccatagrgcatgcctgtgatcccagctacttgggatgctgaggtgggaggattgcttgggcctgggaggtcgagtctgcagtgaactgtgttcttgccactgtactgcagcttgggtgacagagcaagaccccatctcaaaaaatatatatatatatatcttctgattcagctcattttctgtgccttttgagatcttcttggacttttattctttcacccagtgtatttaatattactctctcccagctgttttatctgaaaactttatcaacctgtgctttatattttcattcaattcatttata

SEQ ID NO: 22691 - DNA, 601 bp, Human
attgtatggaggcttccagcaattagtttacaagccaacttatttactattcagtaactttttttgatattgagattgttcctaattttgatcattttaaacaaaggtgtgaaaacaggccaaatcttttcattcactcatgactatttcacaaagatagattcgtagaataagtattttcaaattccctttcagaaaagtagtacaatttaacactcacaagcagtgaatgtgaagccaattctccatacctttgccagcaagggtggccccaagaaccacacacagtaccccagctaarggcaaaggtagcttttatcctggccatagcacactgctgatggtcaacaagacaccaagtcctgctcacagatgctaaacagagctttcttttttcttttcttttttttttcttttttttttttttttttgagatggagtcttgctctgttgcccaggctggagtgcagtggctcgatcttggctcactgcaagctccgcctcccgggttcacgccattctcctgcctcagcctcccgagtagctgggactacaggcgcccgccaccatgcctgggtaattttctttttttttgtatttt

SEQ ID NO: 22692 - DNA, 601 bp, Human
caagatcaaggcaccagcagattcagtgtctgtctggtgagagcccagagtctgcttccaaggtggcaccttgttgctgcaccgttacatggcagaagggcaagagagagtgagaagggaccaaattcgcccttttataaaaaaacccattcttgagaaggacattagtccattcaagagggcagaaccctgctcttaaaattggtaactaaatttcaacatgagttttgagggggacaaacattcaaaccatagcaccgcctgtgtgttaaacacccacttaggtgctggggctgtaaaragtaaatctaggcgtggccctggcacaggagggactccatttcatagagagaaaagaacacagacccttttgttttagggtgcttgctgccaacagctctggagagacaggctgaagcaaaaacaccaaacatggagaagttatgacagttccccaaagtagtgacgaaggcacatctcaggcttgggaagtgtcctcggtgggtgccaggcctgcctttcccagcctcttctcggtgaagagatctctggctaagttctttaccttctctgagatttggaacatactgctgtttcacct

SEQ ID NO: 22693 - DNA, 601 bp, Human
acagaatatgtgagactgggttatttataaacaatggaaatgtatttctcaaagttctggaggctgggacatccaagatcaaggcaccagcagattcagtgtctgtctggtgagagcccagagtctgcttccaaggtggcaccttgttgctgcaccgttacatggcagaagggcaagagagagtgagaagggaccaaattcgcccttttataaaaaaacccattcttgagaaggacattagtccattcaagagggcagaaccctgctcttaaaattggtaactaaatttcaacatgagttytgagggggacaaacattcaaaccatagcaccgcctgtgtgttaaacacccacttaggtgctggggctgtaaaaagtaaatctaggcgtggccctggcacaggagggactccatttcatagagagaaaagaacacagacccttttgttttagggtgcttgctgccaacagctctggagagacaggctgaagcaaaaacaccaaacatggagaagttatgacagttccccaaagtagtgacgaaggcacatctcaggcttgggaagtgtcctcggtgggtgccaggcctgcctttcccagcc

SEQ ID NO: 22694 - DNA, 601 bp, Human
cacctactgtcttaatccatgtttgttgctaccacagaatatgtgagactgggttatttataaacaatggaaatgtatttctcaaagttctggaggctgggacatccaagatcaaggcaccagcagattcagtgtctgtctggtgagagcccagagtctgcttccaaggtggcaccttgttgctgcaccgttacatggcagaagggcaagagagagtgagaagggaccaaattcgcccttttataaaaaaacccattcttgagaaggacattagtccattcaagagggcagaaccctgctsttaaaattggtaactaaatttcaacatgagttttgagggggacaaacattcaaaccatagcaccgcctgtgtgttaaacacccacttaggtgctggggctgtaaaaagtaaatctaggcgtggccctggcacaggagggactccatttcatagagagaaaagaacacagacccttttgttttagggtgcttgctgccaacagctctggagagacaggctgaagcaaaaacaccaaacatggagaagttatgacagttccccaaagtagtgacgaaggcacatctcaggcttgggaagtgt

SEQ ID NO: 22695 - DNA, 601 bp, Human
tggactgtggggactcgggtatcccagaggcagagcacaccaggtctgggaggggggccactcagacggcaacattgtcattcaatatctattgaacacctactgtcttaatccatgtttgttgctaccacagaatatgtgagactgggttatttataaacaatggaaatgtatttctcaaagttctggaggctgggacatccaagatcaaggcaccagcagattcagtgtctgtctggtgagagcccagagtctgcttccaaggtggcaccttgttgctgcaccgttacatggcagaagrgcaagagagagtgagaagggaccaaattcgcccttttataaaaaaacccattcttgagaaggacattagtccattcaagagggcagaaccctgctcttaaaattggtaactaaatttcaacatgagttttgagggggacaaacattcaaaccatagcaccgcctgtgtgttaaacacccacttaggtgctggggctgtaaaaagtaaatctaggcgtggccctggcacaggagggactccatttcatagagagaaaagaacacagacccttttgttttagggtgcttgctgccaacagct

SEQ ID NO: 22696 - DNA, 601 bp, Human
agttttgccttcaaaatagcagactccaagccacctgaagggctgcagaacagcgttgttgacagcttcaagtcgccttgtggcttctctgagctgctgctgtgctttggaaacgaaattccaggctctccctctttctgtgtgtgggaaacaccggagagagtttggggagggagacaaaagggcccattgaaaacccagacaggcttgaactgtaagtcacaccggagagagggttgctgaggggaccctagagggaggcagtcccggagcacagctttgcttctttggctacttcctygctttggaggttgctttcttctcaaggtggaccacctgctagaacagggcagcactgctgttcactggccagcttggagagaagactgcccatgtgattctaagtcaggcccttgtgactgaaccaccatgaggctggactgtggggactcgggtatcccagaggcagagcacaccaggtctgggaggggggccactcagacggcaacattgtcattcaatatctattgaacacctactgtcttaatccatgtttgttgctaccacagaatatgtgagactgggttatttataaacaatg

SEQ ID NO: 22697 - DNA, 601 bp, Human
agtctagccacaaattaccagaaagcagctgaggaaagtttagaatttctcctggcagagatggtccacgagtctggctccagggtgaaccccttcttcctagagcagcacggggccctttggaggctcaactccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacraaattccaggctctccctctttctgtgtgtgggaaacaccggagagagtttggggagggagacaaaagggcccattgaaaacccagacaggcttgaactgtaagtcacaccggagagagggttgctgaggggaccctagagggaggcagtcccggagcacagctttgcttctttggctacttcctcgctttggaggttgctttcttctcaaggtggaccacctgctagaacagggcagcactgctgttcactggccagcttggagagaagactgcccatgtgattctaagtcaggccctt

SEQ ID NO: 22698 - DNA, 601 bp, Human
ggggctaggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggtgaaccccttcttcctagagcagcacggggccctttggaggctcractccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacgaaattccaggctctccctctttctgtgtgtgggaaacaccggagagagtttggggagggagacaaaagggcccattgaaaacccagacaggcttgaactgtaagtcacaccggagagagggttgctgag

SEQ ID NO: 22699 - DNA, 601 bp, Human
cattatgtctttggtttctggccacctttggggctaggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggtgaaccccttcttccyagagcagcacggggccctttggaggctcaactccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacgaaattccaggctctccctctttctgtgtgtgggaaacaccggagagagtttggggagggagacaaaagggcccattgaaaacccagacaggcttgaactg

SEQ ID NO: 22700 - DNA, 601 bp, Human
caggccggaatttgccttaccctgatttacaatgtctacggcaccttcatttccgttctgtcatcttgtgagatagatactatcatttccatgttctagcggaggaaactaaggcccagggaaggaagggactgggctgtgggaaaggggaaccaggagggagaagagggtaaaggaaggaggagcagtgggaggatttctagagccaaacttgtctcctttgaggtgctggggagggtggattttaacagctctgccctcacattgggtttgaggtggccagggagacgggtgagtgagyaaatgacttgcattcattatgtctttggtttctggccacctttggggctaggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggt

SEQ ID NO: 22701 - DNA, 601 bp, Human
gtgcttgcacctgtaatcccaacactttgggatgccaaggcagtaggacaactggaggccaggagtttgagaccagcctgggcaacatagcaagaccctgtttcaacaaaaaaaaattttttttgaaattagcagaatgtagtggccatgccagccacatgcctgccatcccagctcctaggatgaggagaaaggatccttgagctcaggagttcaagcctgcagtgagcttgatggtgccactggactcaatgcctaggtgacagagtgaggcccagtatctcaaaaaaaaaaaaaaaaagaaaaaccattctgagatataggccatacagaaacaggccggaatttgccttaccctgatttacaatgtctacggcaccttcatttccgttctgtcatcttgtgagatagatactatcatttccatgttctagcggaggaaactaaggcccagggaaggaagggactgggctgtgggaaaggggaaccaggagggagaagagggtaaaggaaggaggagcagtgggaggatttctagagccaaacttgtctcctttgaggtgctggggagggtggattttaacagctctgccctcacatt

SEQ ID NO: 22702 - DNA, 601 bp, Human
gtactcaattctaccattgtaaccaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagtttgagaccagcctgggcaacatagcaagaccctgtttcaacaaaaaaaawttttttttgaaattagcagaatgtagtggccatgccagccacatgcctgccatcccagctcctaggatgaggagaaaggatccttgagctcaggagttcaagcctgcagtgagcttgatggtgccactggactcaatgcctaggtgacagagtgaggcccagtatctcaaaaaaaaaaaaaaaaagaaaaaccattctgagatataggccatacagaaacaggccggaatttgccttaccctgatttacaatgtctacggcaccttcatttccgttctgtcatcttgtgagatagatact

SEQ ID NO: 22703 - DNA, 601 bp, Human
tcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgaggcccagatagtaaatattttaggctttcggagcctgaagttctctgtcacaagtactcaattctaccattgtaacmaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagtttgagaccagcctgggcaacatagcaagaccctgtttcaacaaaaaaaaattttttttgaaattagcagaatg

SEQ ID NO: 22704 - DNA, 601 bp, Human
gcagctgcttacatgtcacttgaagctctcacccaaaaacctgtcgccaactattgtttgaaatctcatcatcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgaggcccrgatagtaaatattttaggctttcggagcctgaagttctctgtcacaagtactcaattctaccattgtaaccaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagttt

SEQ ID NO: 22705 - DNA, 601 bp, Human
gagacgcagctgcttacatgtcacttgaagctctcacccaaaaacctgtcgccaactattgtttgaaatctcatcatcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgargcccagatagtaaatattttaggctttcggagcctgaagttctctgtcacaagtactcaattctaccattgtaaccaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccagg

SEQ ID NO: 22706 - DNA, 601 bp, Human
gatgggccgtgtgacatcatgaccttggggcgagatatctttcctctttccccttgttcattctgccaacatttattgagcacttattatgggccaggcactgtctctgctccttagggacagtggagaggcttctgcagttactggaagagacagataaacagatgagaaccatggagcaaataagtacacgaaaggggtaaaggccaggaggagcccatcactcaacccaggagttatcagggaagacttcctggaggaagaggtgcctgagcttggtcctgaagtaaggaccaagcttggtccttcctggtaaagaggaagcatggtctttgggactcaagtggctcaattccactgaatttagatagcaaggcaggaatcaggtaaaactaaattcagaggggtccgcagggctggattacaagggctttagactctaaaggatcaggctatggggagccatggaagggttttaatctggagggtatctgttgaaggggctgctttggcagctgtgaggagagtggactggaacagggcaagagcgctactgcagcatgcggtggtcctgagctggtggcatgggtgccgtgcaggt

SEQ ID NO: 22707 - DNA, 601 bp, Human
ctctgatctgtgcttggctgaggagaatggagggtttctgcagtccttgaaggctctaggatcattgggggatggagaaaattccacttgccctgtggcatcgtgaggtttcagggtagaaggaacttgggacccatctagttcattctcctctgatgaggacattgaggcctagagacgtacagccactcatccaaaagactcacacccaactgtgacccatttgcagatgtcattactccccccaacccacccaacacacacacaacacatgcacaaagaattaagaggaagatgagaygaaggggccacttctatgtttggcatcagaattcactagcatctcttcacaggtgaggcaggctgggtgtggcagtgcaggccttgaaggcagactgtcaggctaaccaagttactgagcgacctcagcttcctcacctgtaaaatgggggcaagaataataatatctacttggcgatggtgtgaggattaaacgagagaatgcgtatatacagcactcagctcaaggctgtcagggcccggccctgagttctcaaactttaagaatcacctggagtgcttgttaaaacacagattgccc

SEQ ID NO: 22708 - DNA, 601 bp, Human
gatcatatactttgcagaaaagcagcttttcagaatacttgagtcaaagccaacagtggtcctggtgtctgtgagctgtttagtccatgaaatgtctgtgctgggaatgggagggtattttcttcaggtcccctgtgggtctctctgtcctctgatctgtgcttggctgaggagaatggagggtttctgcagtccttgaaggctctaggatcattgggggatggagaaaattccacttgccctgtggcatcgtgaggtttcagggtagaaggaacttgggacccatctagttcattctccyctgatgaggacattgaggcctagagacgtacagccactcatccaaaagactcacacccaactgtgacccatttgcagatgtcattactccccccaacccacccaacacacacacaacacatgcacaaagaattaagaggaagatgagatgaaggggccacttctatgtttggcatcagaattcactagcatctcttcacaggtgaggcaggctgggtgtggcagtgcaggccttgaaggcagactgtcaggctaaccaagttactgagcgacctcagcttcctcacctgtaaaatggggg

SEQ ID NO: 22709 - DNA, 601 bp, Human
cctgatgtcctttgtcttgggttagaatgtctgggaggctgttttaggggatcatatactttgcagaaaagcagcttttcagaatacttgagtcaaagccaacagtggtcctggtgtctgtgagctgtttagtccatgaaatgtctgtgctgggaatgggagggtattttcttcaggtcccctgtgggtctctctgtcctctgatctgtgcttggctgaggagaatggagggtttctgcagtccttgaaggctctaggatcattgggggatggagaaaattccacttgccctgtggcatcrtgaggtttcagggtagaaggaacttgggacccatctagttcattctcctctgatgaggacattgaggcctagagacgtacagccactcatccaaaagactcacacccaactgtgacccatttgcagatgtcattactccccccaacccacccaacacacacacaacacatgcacaaagaattaagaggaagatgagatgaaggggccacttctatgtttggcatcagaattcactagcatctcttcacaggtgaggcaggctgggtgtggcagtgcaggccttgaaggcagactgtcagg

SEQ ID NO: 22710 - DNA, 601 bp, Human
atgccaaagacacaccagccctcagtcactgggagaagaacctctcataccctcggtaagtactgtacggcttttgccacctcttcctttccggggctgcctggcctcctgggtgcgggaggtgcctccagattggcctggcttctgtgacgctggcccagatcacacaccagagcccttggtgggcagcggcacctgcaagcatactgcagcctgctgagaaaaggcgtatctggccatgggacatcctggggcaggggcagcttggaaccgtgctccctgcctcagaatggggactggygggatataatgcctgcagtctctactagccctgctccccagggccagtgcagatccacaccctgatgtcctttgtcttgggttagaatgtctgggaggctgttttaggggatcatatactttgcagaaaagcagcttttcagaatacttgagtcaaagccaacagtggtcctggtgtctgtgagctgtttagtccatgaaatgtctgtgctgggaatgggagggtattttcttcaggtcccctgtgggtctctctgtcctctgatctgtgcttggctgaggagaatggagggtttctgca

SEQ ID NO: 22711 - DNA, 601 bp, Human
gtttatgcaagtgcagcataaaaggaacaaatctaccagcaccggggctgttgccactgagtccttttgcatacatttttcaaatgataactcactctacccaccccccttccctacccccaaggcgatttattgaaaaaaccaccttatatggtaatattgctaacacaccgtcagctggcctttttagggactttgtttaaagaagatccgcctctggggttttatattgctctggtattcatgccaaagacacaccagccctcagtcactgggagaagaacctctcataccctcggtragtactgtacggcttttgccacctcttcctttccggggctgcctggcctcctgggtgcgggaggtgcctccagattggcctggcttctgtgacgctggcccagatcacacaccagagcccttggtgggcagcggcacctgcaagcatactgcagcctgctgagaaaaggcgtatctggccatgggacatcctggggcaggggcagcttggaaccgtgctccctgcctcagaatggggactggcgggatataatgcctgcagtctctactagccctgctccccagggccagtgcagatcca

SEQ ID NO: 22712 - DNA, 601 bp, Human
ttgaggaggagaacccggacttctggaaccgcgaggcagccgaggccctgggtgccgccaagaagctgcagcctgcacagacagccgccaagaacctcatcatcttcctgggcgatggtgagtgagccaggccttccagccctgcagccctcacagccccggcgcccggaccctcagtggttccaggagagccctggggcccaagcctcacacatttctgttccttcagggatgggggtgtctacggtgacagctgccaggatcctaaaagggcagaagaaggacaaactggggcctgagwtacccctggccatggaccgcttcccatatgtggctctgtccaaggtaagtgctgggctaccttagagtcctccaagcacagaaggggaatcctggctatggagtgtggtaggagggagggaccctaaacagctggggctccagtaaggagttagaggcagttggaatcccagaggacagagatcagggtctgggtctccgtgtctgccccagagaagagctcagagtgtctctgtccccagacatacaatgtagacaaacatgtgccagacagtggagccacagccacggcctacctgtg

SEQ ID NO: 22713 - DNA, 601 bp, Human
gggagtaaagcgtgaggttgagaatttcactctgttttctaagtgtttggccagttttcccaataccccttgtcagatgatccattctttccccacaaaatctgccttatgatacatcatatccgtgggcacacttggctgtgactcagggcaggcagcgtgatgatggatagcaggcacaggctgagcccacctccctattgctctcttctccctcctccagtggcctcatttccttgccttacatggctgagtccagaaactcatgctagggcctctccatgcctgtgcattgcacgtyggtagggatgcaagcgctgctaatccacacaagtcaaagccagtccagggccatgtttgctgatcatcttccacctacctttgccaccatgtcttgccccttccagtgagagggcttaggtgcgtgtctgtgagtgctccactcttggcatgtggtctccctcaggaggtaagccggctgcagcttttcttaaacaaggtctcaagctcactctaagaaattttcctggaaatctctggcatgtgggtggcatttatttctagtttccagcataagggcacacatattttttccttatat

SEQ ID NO: 22714 - DNA, 601 bp, Human
gagggagtaaagcgtgaggttgagaatttcactctgttttctaagtgtttggccagttttcccaataccccttgtcagatgatccattctttccccacaaaatctgccttatgatacatcatatccgtgggcacacttggctgtgactcagggcaggcagcgtgatgatggatagcaggcacaggctgagcccacctccctattgctctcttctccctcctccagtggcctcatttccttgccttacatggctgagtccagaaactcatgctagggcctctccatgcctgtgcattgcacrtcggtagggatgcaagcgctgctaatccacacaagtcaaagccagtccagggccatgtttgctgatcatcttccacctacctttgccaccatgtcttgccccttccagtgagagggcttaggtgcgtgtctgtgagtgctccactcttggcatgtggtctccctcaggaggtaagccggctgcagcttttcttaaacaaggtctcaagctcactctaagaaattttcctggaaatctctggcatgtgggtggcatttatttctagtttccagcataagggcacacatattttttccttat

SEQ ID NO: 22715 - DNA, 601 bp, Human
catttagtttactcactgagctctttatatcttgatttactttcactatgttgtcaaaatggtgtttttaaaaaacatattaagttttacatacttacgacatcaaatctcttcatctttatggagagatttatgggtttctgccttgcaagtaacccttataaagaccttctctacagcctagagactaaatgtactgtattttattctagtactttagcacatttctttgcacagcgatgcatagcagacacacctgacagtgataacttaggcatcccctgagaatcaccctgtatgktagatgcacctgaatatgtgctcagagttctgagctaaggaatctgggagtggccaaccgagagattaattccttgtctacaaggaacacctgagccctgagcctgtcccattgaaggtgagtcatacaggggattgaggccatgtgttttgggttaaacgaaggttgccaggtggaggttgttaggtagaggatgctaagcaaaaatgttacagaaactgcattgctttttgcaaacggatgtagttctcctgcccagcctgccaccacttggctgtgcaatactcctgcccagccctg

SEQ ID NO: 22716 - DNA, 601 bp, Human
ttggatgagctatttaaactctattttaaaaaatcactttttcttttcctttttttgaacagggtctcactctttcacccaggctggagtgcagtggcatgatctccactcactgcaaccttcacctcccgggttcaagcaattctcctgcctaagcctcctgagtagctgggactacaggcatgcgccaccacgcctgactaatttttgtattttcagtagggttttgccatgttgcccaggctcatcttgaactcctggcctaaagtgatccactcgcctcagcctcccaaagtgctcrgattaaaggtggtgtgagccactgtgcctggctgtaactcactttcttatctataaaatgaagataataaaactacctgccttatagagctgccatgagaattaaaatgatatgcctggactataaaattcataaatatcttttagtttaaaaatcaattttgctaatttttattattttggccatttttaaattattgatatttttattatttcattatttaataacatgtttatattcagttctatacatccacattaaaactgtgagaataaattcttagaatgaaactggtatgtt

SEQ ID NO: 22717 - DNA, 601 bp, Human
taacccagaaaaagtcctgtgcttgaaatgacttccgtgttcaaatcctaaatcaataataaaagaaatacctagagtggcttctattttctgactgaactgttacaaatacttaaggttgatttgggagtaattaatgatgagctccatcaaactgtggaagttaaattctctgagacttacttctttgcaaatgtaaaatcaagttaatgacattgataatatggctatgttgggaagttagaaacaggtaatatgcctaaaatgcttagcacagactctaacacatagtaagtgctcatgaaaaagtaatagtagtaggttgccattattccattgtatagatgaactctgacttgtgaaaccaatgccttaccattggtcacgtagttcaaaggcagtaaaagacagtagataaaaccagggctctggagaaacacagaacgaaatatgcaatctggccctgttgtttccttggcatgcaaccttggatgagctatttaaactctattttaaaaaatcactttttcttttcctttttttgaacagggtctcactctttcacccaggctggagtgcagtggcatgatctccactcact

SEQ ID NO: 22718 - DNA, 601 bp, Human
actaacccagaaaaagtcctgtgcttgaaatgacttccgtgttcaaatcctaaatcaataataaaagaaatacctagagtggcttctattttctgactgaactgttacaaatacttaaggttgatttgggagtaattaatgatgagctccatcaaactgtggaagttaaattctctgagacttacttctttgcaaatgtaaaatcaagttaatgacattgataatatggctatgttgggaagttagaaacaggtaatatgcctaaaatgcttagcacagactctaacacatagtaagtgctcatgaaaaagtaatagtagtaggttgccattattccattgtatagatgaactctgacttgtgaaaccaatgccttaccattggtcacgtagttcaaaggcagtaaaagacagtagataaaaccagggctctggagaaacacagaacgaaatatgcaatctggccctgttgtttccttggcatgcaaccttggatgagctatttaaactctattttaaaaaatcactttttcttttcctttttttgaacagggtctcactctttcacccaggctggagtgcagtggcatgatctccactca

SEQ ID NO: 22719 - DNA, 601 bp, Human
ttggctctgtttccttacccaaatcccatcttgaactgtaataatctccatgtgttgtgggagggacctggtgggaagtaactgatcatgcgggcgggtttctcccgtgctgttctcgtgatagtgaataagtctcatgagatctgatggtttgataaaggggagttcccctgtacatactctcccttgcctgctgccacgcaagacatgcctttgctcctcctttgcctttgccatgattgtgaggcctctgcagccatgtggaactgtgagtccattaaccctctttttctttataaaytacccagtctgggggcatgactttattagcagcgtgagaacggactaacacaggcatataccttgttttcaagtttggtcccaaaacccaaaatgtgttcccaggaacaatattcattcttcacgaggctttgagaagagagaagggtcctgcagtcaaataacttggaattcctgcctgtcccacaggacttctgagttgactttagcatattaagggctctgagaaactcagtagtagcctgtttaaaaattcattccaatcagctgtggacaaagtaatttaagcagagatctcttt

SEQ ID NO: 22720 - DNA, 601 bp, Human
aaattgcccatgaaagcctttgaaaatgtaaattatgatctacttaaggcattgatatggtttggctctgtttccttacccaaatcccatcttgaactgtaataatctccatgtgttgtgggagggacctggtgggaagtaactgatcatgcgggcgggtttctcccgtgctgttctcgtgatagtgaataagtctcatgagatctgatggtttgataaaggggagttcccctgtacatactctcccttgcctgctgccacgcaagacatgcctttgctcctcctttgcctttgccatgaytgtgaggcctctgcagccatgtggaactgtgagtccattaaccctctttttctttataaattacccagtctgggggcatgactttattagcagcgtgagaacggactaacacaggcatataccttgttttcaagtttggtcccaaaacccaaaatgtgttcccaggaacaatattcattcttcacgaggctttgagaagagagaagggtcctgcagtcaaataacttggaattcctgcctgtcccacaggacttctgagttgactttagcatattaagggctctgagaaactcagtagta

SEQ ID NO: 22721 - DNA, 601 bp, Human
agcaactaagaggctcaatgattttcccacaattgccccaggacccatgaccctccagggccaaatatcactttctcctatgctgccctgatgctacctgtgttatagcaggattagtgagccagagttgtccttgggaaaacaagaaaaattgcccatgaaagcctttgaaaatgtaaattatgatctacttaaggcattgatatggtttggctctgtttccttacccaaatcccatcttgaactgtaataatctccatgtgttgtgggagggacctggtgggaagtaactgatcatgcrggcgggtttctcccgtgctgttctcgtgatagtgaataagtctcatgagatctgatggtttgataaaggggagttcccctgtacatactctcccttgcctgctgccacgcaagacatgcctttgctcctcctttgcctttgccatgattgtgaggcctctgcagccatgtggaactgtgagtccattaaccctctttttctttataaattacccagtctgggggcatgactttattagcagcgtgagaacggactaacacaggcatataccttgttttcaagtttggtcccaaaacccaa

SEQ ID NO: 22722 - DNA, 601 bp, Human
ataaatgctgctgcctttccatgtttcatccagctcagttttctgcttgcatctcactgctctgtttgttccctcaagaacccgtgcttccttctgcttcctggcccagttgtttcttccacctgcaatgtccctctgaaatctatctttctctagaaaacctaatgacttgatggccacctatgaccccacttcttgggttcattcaagtgtaagttccttggaacaaccattcctgccccagtctcttgcctctcctaaggtgtgaatctgtcctctgttatgatggcactcaatgcaygtatctattaaaatacatattactatgcctatctggcctttttatttaagtgtcttctcactctgctgtgagctccttgcaagcaggcactatgtcttgttcatctctgcatctccctctcctagaacagtgtcaggtgcacaaatggagctccagagatgtttgctgctaaaatgaatgcaagcataagatctgcctcacaaagcctaagcatcagcagaaatcataaagacccatagaggggaagccacccagagatcagtcacaataaaatgattagaattcatttaacccaacttc

SEQ ID NO: 22723 - DNA, 601 bp, Human
gcttggttccattacatgtgattcatgtgattttaggcaaattattaatcatctataacctcagttttccaagaggtaaaatactaataaataaacctgccacaaggttgtagggaaaattacataaactgagacatgtcaatgcttatctcagtgcctagcatataagtgctcaataaatgttagctaatagtattattgaactattggactaaacttctactaaatctccatgcaatttcacttcttctagcctgaattccacacaatcacaataactatttttctaaaatgctaatckgatcatgggacgttttcccttgtctacaataactctaacaatgactctcctgtctattgatagaataaaatccccatatgatatgatacatgaagcacttctttatataaatgctgctgcctttccatgtttcatccagctcagttttctgcttgcatctcactgctctgtttgttccctcaagaacccgtgcttccttctgcttcctggcccagttgtttcttccacctgcaatgtccctctgaaatctatctttctctagaaaacctaatgacttgatggccacctatgaccccactt

SEQ ID NO: 22724 - DNA, 601 bp, Human
tgaggtggaagctacattatgccaagtgtccaaattcaccctcacccaagtacaagcaaatctctatcaagaaatatacccctcaaattcataacaagcgttagtcactagtggacccccttctataatccagatgccaaaaaacttctggcattttctttaaatctttgtcttaagtctgatggaaactatacacaactgtgtagataggtttttaacaatgtcttaagagaagaaaaagaaatttggcactgtagaccaaataatctttgtgatgaaaaataaaatcatgaatataacyttaaaataaaattatataagattttaatcatcaagactaaaagcatgatgttgcagtaaatatgtctattagcagccaaaagaactactaattacagggtggataagtggtgatggatcatttggacagaagccattttgacatggaaattgttttgagaacatctactccataggatgcactttgatggatacacaggtgaaaggcttcaagcctagctccagactggcagagcttttagggatttagggattactcttctgacagagtatgatgggcgaaaaaagctaaaatacaagt

SEQ ID NO: 22725 - DNA, 601 bp, Human
tgcaggtgaagggacagcaaataggagacaaaacctgaatccaacccatcgcactctgaatccaagcaaggggggatgcgttctctcatgatatggtcaacactgaggtggaagctacattatgccaagtgtccaaattcaccctcacccaagtacaagcaaatctctatcaagaaatatacccctcaaattcataacaagcgttagtcactagtggacccccttctataatccagatgccaaaaaacttctggcattttctttaaatctttgtcttaagtctgatggaaactatacacarctgtgtagataggtttttaacaatgtcttaagagaagaaaaagaaatttggcactgtagaccaaataatctttgtgatgaaaaataaaatcatgaatataaccttaaaataaaattatataagattttaatcatcaagactaaaagcatgatgttgcagtaaatatgtctattagcagccaaaagaactactaattacagggtggataagtggtgatggatcatttggacagaagccattttgacatggaaattgttttgagaacatctactccataggatgcactttgatggatacaca

SEQ ID NO: 22726 - DNA, 601 bp, Human
gtataaaagtccacatgtaacttggtgtttcatagcacttgtgctctctttagacacagccaacatctcccttccctcagagcatcgctgggcacattccacgaagcccttgacaatgaggtgtcctgcctacatgagctgaagagacttgaccaccatcggacgaagcccttgcagagtctggggtaggaaaaaaacagtatgactcaagactctggggactctgatgaaacagagtcgtgcaggtgaagggacagcaaataggagacaaaacctgaatccaacccatcgcactctgaayccaagcaaggggggatgcgttctctcatgatatggtcaacactgaggtggaagctacattatgccaagtgtccaaattcaccctcacccaagtacaagcaaatctctatcaagaaatatacccctcaaattcataacaagcgttagtcactagtggacccccttctataatccagatgccaaaaaacttctggcattttctttaaatctttgtcttaagtctgatggaaactatacacaactgtgtagataggtttttaacaatgtcttaagagaagaaaaagaaatttggcactgtaga

SEQ ID NO: 22727 - DNA, 601 bp, Human
aaaatcagagcactgtcatgagaaataaaaaacacatcctgtaaacttaaggtcagtgaatcctaagataaaaatcatttgttaaactgaaaactcaacattcttgctggattggaggtagctaattctgggttcaactgtgagagaaaaggacaaactaaaagatgtctgaaatgacagaagtacatccttgaggagtatgtataaaagtccacatgtaacttggtgtttcatagcacttgtgctctctttagacacagccaacatctcccttccctcagagcatcgctgggcacattcmacgaagcccttgacaatgaggtgtcctgcctacatgagctgaagagacttgaccaccatcggacgaagcccttgcagagtctggggtaggaaaaaaacagtatgactcaagactctggggactctgatgaaacagagtcgtgcaggtgaagggacagcaaataggagacaaaacctgaatccaacccatcgcactctgaatccaagcaaggggggatgcgttctctcatgatatggtcaacactgaggtggaagctacattatgccaagtgtccaaattcaccctcacccaagtacaagc

SEQ ID NO: 22728 - DNA, 601 bp, Human
gtgcacttacaaacccacactcactgacatgccagtaaacttcacctgtatatctttgggacgtgggaggaagtcaaagtaccgagagaaaactcagtgtacaaattccatacggacagtggccctggctgagattttttttttttttctcatcattattgtaacaaaatgatgttgaatgaaacaatgctatttgaagatctgctgtattatttaaaactatgaatgaagttttaaatcaaaactcttagaaattttagggttcctaagcctttgggtctgaattttcattagggatacrtttgatatgttgcaaaactatggtttgcaacattaaagaatagcattaaagatatatgcttctgagcacaacatggtgacataaagtatcacccagtccttttagtctctcccaaggaccccctgcacaaaggttaatgaatgtactgaaaagccacgaagacagctcatggctgagagcaaaacaaggggccaggaagagctggggacttggagatgcgcctccggcagaagactctccccgacagccggaaggtgggacctggccacattgatgtcttggcctttgtcactacggggg

SEQ ID NO: 22729 - DNA, 601 bp, Human
aaataaatgagagcagtacacacatttaaggaagattaataaaaacaagtaagataattatttacttacttactccagtttagggtcatgggtgaccagatcctctcctagaggctcagagcacaagatgggaaccagccctggacaagatgcatatcatcgcagggtgcacttacaaacccacactcactgacatgccagtaaacttcacctgtatatctttgggacgtgggaggaagtcaaagtaccgagagaaaactcagtgtacaaattccatacggacagtggccctggctgagattttttttttttttctcatcattattgtaacaaaatgatgttgaatgaaacaatgctatttgaagatctgctgtattatttaaaactatgaatgaagttttaaatcaaaactcttagaaattttagggttcctaagcctttgggtctgaattttcattagggatacatttgatatgttgcaaaactatggtttgcaacattaaagaatagcattaaagatatatgcttctgagcacaacatggtgacataaagtatcacccagtccttttagtctctcccaaggaccccctgcacaaaggt

SEQ ID NO: 22730 - DNA, 601 bp, Human
cttctaactaaatgtcaaaacacttctaatattgaacattgaaataaatgagagcagtacacacatttaaggaagattaataaaaacaagtaagataattatttacttacttactccagtttagggtcatgggtgaccagatcctctcctagaggctcagagcacaagatgggaaccagccctggacaagatgcatatcatcgcagggtgcacttacaaacccacactcactgacatgccagtaaacttcacctgtatatctttgggacgtgggaggaagtcaaagtaccgagagaaaacycagtgtacaaattccatacggacagtggccctggctgagattttttttttttttctcatcattattgtaacaaaatgatgttgaatgaaacaatgctatttgaagatctgctgtattatttaaaactatgaatgaagttttaaatcaaaactcttagaaattttagggttcctaagcctttgggtctgaattttcattagggatacatttgatatgttgcaaaactatggtttgcaacattaaagaatagcattaaagatatatgcttctgagcacaacatggtgacataaagtatcacc

SEQ ID NO: 22731 - DNA, 601 bp, Human
gaacactggtccataaaactgcagagttctcaaactaaaattagtcctaaatgaatttaaatacatggcataaagcatttttagaagggactagaagtaaaaatcaataggattatagggcataacagtcaaaagtggttaagtggcctaaaatggtaaacacggttaaagtggttaaatggttaagttttaagtggcctaaaatttttacaaagaacaaagaaaaaaagtttgtcattttccagtatagtaagtccttacttaatgtcatctataggttcttgcaaagtgtgactttaaytgatacgatgaataatgaaaccaattttacccaaggctaattcatataaataagagttaagttaccaggacatatttttcgtcacagacacatcacaaaacttctaactaaatgtcaaaacacttctaatattgaacattgaaataaatgagagcagtacacacatttaaggaagattaataaaaacaagtaagataattatttacttacttactccagtttagggtcatgggtgaccagatcctctcctagaggctcagagcacaagatgggaaccagccctggacaagatgcatatca

SEQ ID NO: 22732 - DNA, 601 bp, Human
atggaggcctcctgcatgcctagtgttggagagaaacaactcccgttacacagaaatgagtgaggattctcttctcccttcctccactttcttaagtgagagaaaaatattgtacttgctaaacatttaaggaaaaactataaaggcacaactgctgcttgtatctgctgttgtatctttctttgagggtctctaagacttatcacattgcacattttctattattcacttgataatgatagatatggggtctcgggaaagatcaacaagtatcctactctgaaaactacaataatcatartgtgtcctattacgtgtgctatcacttgccaagtggtatcagatgctaagaacactggtccataaaactgcagagttctcaaactaaaattagtcctaaatgaatttaaatacatggcataaagcatttttagaagggactagaagtaaaaatcaataggattatagggcataacagtcaaaagtggttaagtggcctaaaatggtaaacacggttaaagtggttaaatggttaagttttaagtggcctaaaatttttacaaagaacaaagaaaaaaagtttgtcattttccagtatagt

SEQ ID NO: 22733 - DNA, 601 bp, Human
gtcaggctcatagacttcatgcagcgactctgtgagcttcatggaggcctcctgcatgcctagtgttggagagaaacaactcccgttacacagaaatgagtgaggattctcttctcccttcctccactttcttaagtgagagaaaaatattgtacttgctaaacatttaaggaaaaactataaaggcacaactgctgcttgtatctgctgttgtatctttctttgagggtctctaagacttatcacattgcacattttctattattcacttgataatgatagatatggggtctcgggaaaratcaacaagtatcctactctgaaaactacaataatcatagtgtgtcctattacgtgtgctatcacttgccaagtggtatcagatgctaagaacactggtccataaaactgcagagttctcaaactaaaattagtcctaaatgaatttaaatacatggcataaagcatttttagaagggactagaagtaaaaatcaataggattatagggcataacagtcaaaagtggttaagtggcctaaaatggtaaacacggttaaagtggttaaatggttaagttttaagtggcctaaaatttttac

SEQ ID NO: 22734 - DNA, 601 bp, Human
gatcaaagaactggtccaacgtcacacagcgctactcagtctctggtccattctgctttccagagaacaaaacccacttgctcactcctgtcagccagaagcctgatttcaagtgttaagacatgtctagggccaaagccttcctgaagtcaaattccttttcacagtctgactttgtgcttgtcttcgtgaagtgaagatttgtgaacggactagctggtattaaagtggaatggatgctcttctgaactcctgtccctgcatttggggaggcatagtcaatagggggattgagatgaasgggtgaagttgggacaacacaaatcacaccatgatccatgtctgctagaaatgggctgttaaggcttgtagtgaggacagaaaaatgatattgttattttgcaaaaaggaatcttaaaacactgctctctacccaagtggttttatgatcatcttcacttttcttttattttcttcgagatggagtcttgctctgttgcccaggctggagtacagtggtgcgatcttggctcactgcaacctccacctcctgggtccaagcaattctcctgcctcagcttcctgagtagctgagattaca

SEQ ID NO: 22735 - DNA, 601 bp, Human
agatgcaattacttaataattgcatctgaaagtaatgtgtgcggtctgctttggccaaatctacatcctgaaagtttttgaaagatgtaaaggagccaacaaatgctttcctcataaataaatctctgttagcatctcagttataagaagattatgaagctcaatgtcagggtgtcagaatatccatggagcagcctaggactccactgttaacgcaggttttccaaggctgcacagacattcagtgcatcacctatcagaccttcccctgagctctggctgccacatcaaatttaggtcrtctgtgcctaaatgagctgcaataactcacctggagtagaggacatgacaaacaactgctcttcgttttaacaaagaacttggatgtgagacaatctgtgactggcagttgtctcacatcagtaatcataatatgtaccaaacactgagtaggtagaggacatccacacaaaggcaataagtgtcttattagtagatacattttttttttattttgtagatgaggaaactaaagcctaagaagatcaaagaactggtccaacgtcacacagcgctactcagtctctggtccattctgctt

SEQ ID NO: 22736 - DNA, 601 bp, Human
catagaaggtaacatggtgttctgaaaagttattaacacaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaagtaatgtgtgcggtctgctttggccaaatctacatcctgaaagtttttgaaagatgtaaaggagccaacaaatgctttcctcataaataaatctctgttagyatctcagttataagaagattatgaagctcaatgtcagggtgtcagaatatccatggagcagcctaggactccactgttaacgcaggttttccaaggctgcacagacattcagtgcatcacctatcagaccttcccctgagctctggctgccacatcaaatttaggtcgtctgtgcctaaatgagctgcaataactcacctggagtagaggacatgacaaacaactgctcttcgttttaacaaagaacttggatgtgagacaatctgtgactggcagttgtctcacatcagtaatcataat

SEQ ID NO: 22737 - DNA, 601 bp, Human
aaagaaatggcaatagtgacctttgccacacatagaaggtaacatggtgttctgaaaagttattaacacaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaagtaatgtgtgcggtctgctttggccaaatctacatcctgaaagtttttgaaagatgtaaaggagccaacaartgctttcctcataaataaatctctgttagcatctcagttataagaagattatgaagctcaatgtcagggtgtcagaatatccatggagcagcctaggactccactgttaacgcaggttttccaaggctgcacagacattcagtgcatcacctatcagaccttcccctgagctctggctgccacatcaaatttaggtcgtctgtgcctaaatgagctgcaataactcacctggagtagaggacatgacaaacaactgctcttcgttttaacaaagaacttggatgtgagacaatctgtgac

SEQ ID NO: 22738 - DNA, 601 bp, Human
tttgaaaagtagtcctaatttttacaaatctcaattcaagaatttcatgcaaaccaaaacatttaaatccactgtttagaaaggctcaactgctgacgtgagtagaccctctgaacatgcagtattcagtttcttcatcatcacaagagcctatgtttgcatgtgcaactgaggattccaaaaaaccgggcagctgcaagaaccaaggtaggataacagtcatttcctttaaaaaagaaatggcaatagtgacctttgccacacatagaaggtaacatggtgttctgaaaagttattaacrcaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaagtaatgtgtgcggtctgctttggccaaatctacatcctgaaagtttttgaaagatgtaaaggagccaacaaatgctttcctcataaataaatctctgttagcatctcagttataagaagattatgaagctcaatgtcag

SEQ ID NO: 22739 - DNA, 601 bp, Human
ctttgaaaagtagtcctaatttttacaaatctcaattcaagaatttcatgcaaaccaaaacatttaaatccactgtttagaaaggctcaactgctgacgtgagtagaccctctgaacatgcagtattcagtttcttcatcatcacaagagcctatgtttgcatgtgcaactgaggattccaaaaaaccgggcagctgcaagaaccaaggtaggataacagtcatttcctttaaaaaagaaatggcaatagtgacctttgccacacatagaaggtaacatggtgttctgaaaagttattaayacaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaagtaatgtgtgcggtctgctttggccaaatctacatcctgaaagtttttgaaagatgtaaaggagccaacaaatgctttcctcataaataaatctctgttagcatctcagttataagaagattatgaagctcaatgtca

SEQ ID NO: 22740 - DNA, 601 bp, Human
caacacctggactgccgacctttaaattcctctatgtgacacataagttttcatcttgttaaaacacacacacacacttttaaaatttgcttttgtttctttctcacactttgaaaagtagtcctaatttttacaaatctcaattcaagaatttcatgcaaaccaaaacatttaaatccactgtttagaaaggctcaactgctgacgtgagtagaccctctgaacatgcagtattcagtttcttcatcatcacaagagcctatgtttgcatgtgcaactgaggattccaaaaaaccgggcrgctgcaagaaccaaggtaggataacagtcatttcctttaaaaaagaaatggcaatagtgacctttgccacacatagaaggtaacatggtgttctgaaaagttattaacacaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaagtaatgtgtgcggtctgctttggccaaatc

SEQ ID NO: 22741 - DNA, 601 bp, Human
gggcccctcatacttgtggggccaatatgcaacacctggactgccgacctttaaattcctctatgtgacacataagttttcatcttgttaaaacacacacacacacttttaaaatttgcttttgtttctttctcacactttgaaaagtagtcctaatttttacaaatctcaattcaagaatttcatgcaaaccaaaacatttaaatccactgtttagaaaggctcaactgctgacgtgagtagaccctctgaacatgcagtattcagtttcttcatcatcacaagagcctatgtttgcatstgcaactgaggattccaaaaaaccgggcagctgcaagaaccaaggtaggataacagtcatttcctttaaaaaagaaatggcaatagtgacctttgccacacatagaaggtaacatggtgttctgaaaagttattaacacaagtttctattatttccttaaaaattatttttttgtgatgaatttttagttataccactaattagaaatttacaaagtatttagcaacatgatgttgaaatactgtgttttaattgaagaaatgtgagaagatgcaattacttaataattgcatctgaaag

SEQ ID NO: 22742 - DNA, 601 bp, Human
taaggaaagttaatgtagatgaagtgttgaacagagtgcctggtatccaggaggcctctcatgaagggcatttgttattgtgaactgctcagaaactgatgtgtagttctggctcatggtatgtttatggaagaaggcgaggaggggaaaggagacttgaaagttgatcaggatggacaggtgagttacagccaaattgtgaggatcttttatgctgtactaagaaataaagtattttttgtagaggcaatagaaaccattaaaagacttaagcagttgagaaacatatctcgatgtagamagaccattcaggcagctgtgtgtaggcacataggaaaaggcatgactggaagaagagggtatagttaggaggtgacttcagttagtcggcatctgtaacttgctgacatacatggtgaaagctactaaaaaatgttttctaacagaaaatttgttttatgcaaatccacacatccgtactctcagacaatcaaaagtcacctctgagaatttcagcttggtgtcccatctgcatctgcatttcagcactgagggtggaccacaaccatctaaggaagtgcagacacactactttctttga

SEQ ID NO: 22743 - DNA, 601 bp, Human
tgttaagtttcaagatgaagggcagtcctcctaatgcctctaattgagatttaggtctccacttgagaaatagatcaaggtctaaaattgtgtcatcctatatggcagctactagccacaggtggttatttaaatataaataaattagaacaaaataaattaagtttaaaatttagttcctcctttttaatcctagccatattccaagcaatcaatacccactggtgacaagtagctaccatactggaaagcgcagataaagaacactttcactggacagtgttgaaatgtcacagtaatwataaagacaagataagggatattcactgatcttgaatttctaaaaggaacatgtgcaacccatagagaaacatttttaccttgaccataatgatggtaactcttcttgtaagtcaacgttaaactcttcaaacactttctgtgctttctgaaattcttcttctgcctaggaatgaaacataacatgtgtttacactaagaaagaccatttctatacacaacagcatcatttaatgtaaaataagaatagtcttatggcatcttggaaatattttgagaaggagagtatttggttaaaagc

SEQ ID NO: 22744 - DNA, 601 bp, Human
ctttagaggcaaatccatctagttggaagttaagaaatagaggacctgatttaaaataacgtggcattattttaagcacaactctggctaatttggggtgggagcatgaggatgctgacagagattaaggatcataaggtcctatttcatccaacaacttctttgttctaccactgagtaggaaaaacagaacaactatttcaaaatgcacgtaattccacgagaaatgcagagtaacgtgtaagtaagaatatctggtgcttaaaatacaaatacagttcagatttaaaagtcagggctkaaagtagaggcttaccatctaagccagatgactagatgagctcttggaataaaggaagttcctccaagaactgaaaggatattattgttaagtttcaagatgaagggcagtcctcctaatgcctctaattgagatttaggtctccacttgagaaatagatcaaggtctaaaattgtgtcatcctatatggcagctactagccacaggtggttatttaaatataaataaattagaacaaaataaattaagtttaaaatttagttcctcctttttaatcctagccatattccaagcaatcaa

SEQ ID NO: 22745 - DNA, 601 bp, Human
cagcaagaggtcaaagaaagaaatgtaagggcaagactaccatcataatacacaacaggatgacgagggttagggtggggacagtgggaccagagaaagggagagtgatccagaagcccacaccaaaaaatgatagattgattattttgatggctctttggtttcctgtaggtaacaattgcaaagctttgaggtttcggaacccagaaataatggcaccaaaaaaataaaataaaataaaataaaatgaaataaataaaaagaaaaagaaatgcagatgtagagagaatgagtaaattcmgatgaacaatgacataatttcacatgttggactttgggtgatggctggacactgaggtaaaaactagccaaaatttcatccagatatttcagttcagagagaaacacagagtgccttttattggcaaaaattaaaaacactagcgatgaacacaaaaatgggcaaactttagtatagaccctcaaaatgcttacaattttggtgggtaaatagaagctctagaatttgtatataggaaggctttagaggcaaatccatctagttggaagttaagaaatagaggacctgatttaaaataac

SEQ ID NO: 22746 - DNA, 601 bp, Human
tctcatctgtgaaatggagagatctgtaattgtaatgattagaggttatacatgtaaagtacataaaatgacagctagcaaatagaaagtattccaaaaaatgatctttggtatacagcatacacaatgcacacaattattatggttgagtaatctggatttcattaagaaatatgctacatagaaaggaaggcctaagtcaggttttgatcgaaaggcaggatctggattgaaaaactagttttgactgatgttatttcctaagtgccagagtgagacattagattgatttcaaaagcaytgaaacatttatactgcgtatgaccagaaaaggggaaaggtttctttccaaaattatccctcagatattccctttgtttttaagtccctacaaagtctttcacgctacgagacactccaacaattactttactttgaataaccaaatacaacttaggaagggcacaaaagactgaaataacatcaatgctagttttggatgtagtagagatcactagaaaaaccttagttatatacccaatacatattaaggcaaataataaatatctgtctcttggcaattctggcaatttccccaaag

SEQ ID NO: 22747 - DNA, 601 bp, Human
ccttcacttactatggagatggagtatgaggaagagttttttcctagctctcttctgatcctctaagctcatttacactccatttcaggattaatggcactcatattaaacctcttcaaagcttaatatcaacctctcagcaagactcctcaaccccaaccacaatccacaatggcatgcctcatggtttcccctctctccctcaccaaatcctaacactaacacagtagatctcaacaaccctatgactatccagccaaaacatgagccctctaactagggaccccagcattctatttayacacattctgcattggcctctgacatcttggatcttgccatgactcacaactatttcacctctgaaatggggcagattagtggcccacccactaacctaatttcctgggccatgagctccctcattcattcatttccattccacctgcttctttcaaaacctctgtgagatcaatgcacttttcttccaggccactacccttgatcaggttgaacatcctgctttatcaagcttgggccctgtggtatacccctcaacactctctggtcagtcctatcaacacccttcctccttgtcctg

SEQ ID NO: 22748 - DNA, 601 bp, Human
aaaaaaaaagaacatacagacacagagtaccagcataccaggctcttgattctgatattatctgcttaaaagtttcattttgcacagggactctgagacatcaccatttccccaaatgtggcatcctcaggacacttcttattagctgtcaaaaccaacttaatttctttattaagatgtttctttgttctcagaaataaaggaaaaattaagttgagcttatcacagctacagattgcagacctgagcactctccccttcgcaatgccctaaggaaatctgcctccctggaggggagtgwcagtgcttcctgcagaccctcttgcagtggaggaggcaacccttgctgtccttcacttactatggagatggagtatgaggaagagttttttcctagctctcttctgatcctctaagctcatttacactccatttcaggattaatggcactcatattaaacctcttcaaagcttaatatcaacctctcagcaagactcctcaaccccaaccacaatccacaatggcatgcctcatggtttcccctctctccctcaccaaatcctaacactaacacagtagatctcaacaaccctatgacta

SEQ ID NO: 22749 - DNA, 601 bp, Human
aaaggagaacacttgcacctgtatttgaggaagctaattaaggcagcagcttgacaggcaaggagagaccctacaggctacctatacattatgcagagggaccccactcgcagtgtttgcagagaagtcttctggggtactttgagtggcaactcatgaccccttctccaaggccccaatcaactgggacagtaattcttaacacttttcttccttcaattacttccttcaattactcaacaaaggacctatccaactctgggtacatgcacagtggtaggtgaacatgtctctaggaacrtacaatccagttagagaagcatccagaggggctgctctatttatacttacaatggaaatatgtgtgtgtgtgtgtgtgtgtgtgtgtgtgtgtaagagaaataagcagattttatatatatgtgtatatatatatattagaaataagcagcttataaaaccacatgggaatgttaagttacaacaagaaggcatacatgattacatatcaaaagtgagtggatatgggcagaaacagagaaactgagaagagaggagagcaatgggccctgtgacagctgcaaacatctgcttaagagga

SEQ ID NO: 22750 - DNA, 601 bp, Human
tcataaatacatgtgcatatacctattcatatgcatacaaatacacatgcatatagacatctattcattaataaagaaaatcctccacagtgtgtttgggaaatggtaagcccccaggaagatcagaccagagcctgggagaggaaagcctagtgaggaagcagatggttctctggggcagaggtccttgccagaccacgaagcacaatatttattggcaggcagtgggcaacccctagatgtgtctgagatagggcaaaggagaacacttgcacctgtatttgaggaagctaattaaggyagcagcttgacaggcaaggagagaccctacaggctacctatacattatgcagagggaccccactcgcagtgtttgcagagaagtcttctggggtactttgagtggcaactcatgaccccttctccaaggccccaatcaactgggacagtaattcttaacacttttcttccttcaattacttccttcaattactcaacaaaggacctatccaactctgggtacatgcacagtggtaggtgaacatgtctctaggaacgtacaatccagttagagaagcatccagaggggctgctctattta

SEQ ID NO: 22751 - DNA, 601 bp, Human
tctccggagaaaatattaagtgcataacaaattatatattacaacaagcatatacattatatattaaaatttcacactgttgctatcaggcctcatggaaagcagagagaggcagagaggcagaaagtcaatgctgttgtgacaagaagaagaatcctagttgggtcactgaaggccagacataaatgtaaaagcacaaaaataaaattagtgtcagcttctagggtgaaaaggctcctgtgggacttttgtaggataaataaaatagtacaggctggtccacagattgaagaaattttarcaagcaggacattacaggtgctccaatgagcaggggcctacctgggcgctccttggatggtgaaggccttgtcggcgtgctggtcacccagttttgtcatcacttcatacagtttgtggcaaagctaaggggacagaggccacttgtctattagtcacatgtcattctggtgccaattcaggctattctccccaagaaagaaattgcttattgagaagctataaattttatgatagcttggatggcctcaggataactgaaattctgtatacggttcaaatttaaaatctatgtcaaaac

SEQ ID NO: 22752 - DNA, 601 bp, Human
aatctaagcttaatagagatgccactgagctcactcaccacctcattctgcagaggaatgttgaaaaaaagtgaaaggaacattcattaagtggtcatggccccgctttttcttcactgtatctcatttggcaacattacaattttcagatgaatttgtccctttcatttccatgtaagggaacaaccctaaattttttcatgcacttcatttttaaaacactcaaatatcattctgatattcccattccaattcttccttcgtgcctagccccatactgaaataaccatactgaaaacaktaactctgcctctcttatgtattctttcaggcaatattctttcccttagaaagagaagatatactactgcttacatagtatagaaaccatagcagaacctataagtagggctaatccaaagagcagggaataagaaaattaacaatctctagagggatccaaacattaacatatgtagaagttggttcatgtgtatgactatgtgtgttttcataaatgtatgcaaataagtgtttgtattaaaatggcaaatatagaatgtcaggactgtatattaccttggaaaccatgtagttcaat

SEQ ID NO: 22753 - DNA, 601 bp, Human
gcaaggcgactctccatcaaaccataaccatgatcacaggaggggagcttcttcaatggggaggatgaacacagcatcatcaagttcagaacgatcaacactgaaaacggcttctgctggcccgtgctttcatggtcattgcaaacacactttaacttgcaaagtatgaggaagggaagtagagaaaagagcaagaagagtaaacccaaaaccaaaagaaagagcttcatccagggaaaccataaaatgtatcctgtaaacctgaacagttctgagtgcaacgtgggcactggtaacaatyactctgggggagaaaacaggaatgtatggttatgccagctctatgggtagagaaagctgatggcatgggagtcttagaataactgatatagataaggtcccctttctacccctctttcctattaggaaatatctgtcaaccaaaaataaaaatagatagtagtcatgaaaggtatagggatcattggttaccacactgagcttactgaggtttatgaaatatctccaaacatccaaaaagcacctgatacctgagacatgggtgagtgggtcactccagcagaacctgcaggtgtcacct

SEQ ID NO: 22754 - DNA, 601 bp, Human
aagaaggcttcaaggccagggaatcaagctaggtcttaattcctaggttgaatgttacaatattcttgtactaattcatttgaagcatactctagcaactttggatttgcctaaattcatatgtggggctccaaccatatgcaaagtacttatataaacagtttctgttttgtcaaattttgagttaacttccttctattagcacagacagttgtaaactaactatatttcagaggacctacccacaggtcattatggcacctaccaccagtatcctctgacagagaatgtaatgacagtwactataagaaaggaagaaatatggagtgtgagggagtggtgagcaaaaaggcttggggaagcaaggcgactctccatcaaaccataaccatgatcacaggaggggagcttcttcaatggggaggatgaacacagcatcatcaagttcagaacgatcaacactgaaaacggcttctgctggcccgtgctttcatggtcattgcaaacacactttaacttgcaaagtatgaggaagggaagtagagaaaagagcaagaagagtaaacccaaaaccaaaagaaagagcttcatccagggaaac

SEQ ID NO: 22755 - DNA, 601 bp, Human
tgttcatattgcacaacaggaaagcctttagaagcccaatcacattctagaaaaaagcatggactagacataatccttatttattaaggttcatattgagccatttattccctagcagtttactgtgatataccaagaaggcttcaaggccagggaatcaagctaggtcttaattcctaggttgaatgttacaatattcttgtactaattcatttgaagcatactctagcaactttggatttgcctaaattcatatgtggggctccaaccatatgcaaagtacttatataaacagtttctrttttgtcaaattttgagttaacttccttctattagcacagacagttgtaaactaactatatttcagaggacctacccacaggtcattatggcacctaccaccagtatcctctgacagagaatgtaatgacagttactataagaaaggaagaaatatggagtgtgagggagtggtgagcaaaaaggcttggggaagcaaggcgactctccatcaaaccataaccatgatcacaggaggggagcttcttcaatggggaggatgaacacagcatcatcaagttcagaacgatcaacactgaaa

SEQ ID NO: 22756 - DNA, 601 bp, Human
catttcattgcttcatagccacttaagaatcaaagatcatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatcctgccactgcactccagcctgggcracagagcgagactccgtctcaaaaaaaaaaaaaaaaaaaaaagaatcaaagatcataaaagctagtgcatgtctctgtataatgcacacatcaccagttattttctttaaaaggaaggcaggaaatatgaaatgtcatgtttatcagtcctcaggatcatgaaaggatgcgttagcgtgcacagatactgcagagatcacaagatgaggtgttctgctagcagcaagaacaccacttgaaaacatggggtcaggtgatgggtaaaggaggtcattttgagtgaagaggaaagaaaccagg

SEQ ID NO: 22757 - DNA, 601 bp, Human
tttctgattatctagatgattctcatttcattgcttcatagccacttaagaatcaaagatcatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccgggaggcggagcttgcagtgagccgagatccygccactgcactccagcctgggcaacagagcgagactccgtctcaaaaaaaaaaaaaaaaaaaaaagaatcaaagatcataaaagctagtgcatgtctctgtataatgcacacatcaccagttattttctttaaaaggaaggcaggaaatatgaaatgtcatgtttatcagtcctcaggatcatgaaaggatgcgttagcgtgcacagatactgcagagatcacaagatgaggtgttctgctagcagcaagaacaccacttgaaaacatggggtcaggtgatgggtaaaggaggtcatttt

SEQ ID NO: 22758 - DNA, 601 bp, Human
ggaaagccacagttttttgtacatggatctaatatatgttttctgattatctagatgattctcatttcattgcttcatagccacttaagaatcaaagatcatggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcrtgaacccgggaggcggagcttgcagtgagccgagatcctgccactgcactccagcctgggcaacagagcgagactccgtctcaaaaaaaaaaaaaaaaaaaaaagaatcaaagatcataaaagctagtgcatgtctctgtataatgcacacatcaccagttattttctttaaaaggaaggcaggaaatatgaaatgtcatgtttatcagtcctcaggatcatgaaaggatgcgttagcgtgcacagatactgcagagatcacaagatgaggtgttctgctagcagcaagaacaccacttg

SEQ ID NO: 22759 - DNA, 601 bp, Human
tggcctgccttgcatctccatgcagcctgcctggtctcttgcttagcattttctcgtaggatgactaagacaggagagaacagctccatggaaagccacagttttttgtacatggatctaatatatgttttctgattatctagatgattctcatttcattgcttcatagccacttaagaatcaaagatcatggccgggcgcggtggctcacgcctgtaatcccagcactttgggaggccgaggcgggcggatcacgaggtcaggagatcgagaccatcccggctaaaacggtgaaaccccrtctctactaaaaatacaaaaaattagccgggcgtagtggcgggcgcctgtagtcccagctacttgggaggctgaggcaggagaatggcatgaacccgggaggcggagcttgcagtgagccgagatcctgccactgcactccagcctgggcaacagagcgagactccgtctcaaaaaaaaaaaaaaaaaaaaaagaatcaaagatcataaaagctagtgcatgtctctgtataatgcacacatcaccagttattttctttaaaaggaaggcaggaaatatgaaatgtcatgtttatcagtc

SEQ ID NO: 22760 - DNA, 601 bp, Human
cacacacacacacacacacacacacacacacctcattaaaatgaagtaaacaaggtgtccaaattttagagcttgtcacatctttgaggaaatgcaggccctaatcactgctaatgctatttccttcccatctcattcaagaggatgtaggatgaccagcttaatggtaaatgagccccagaaaaatagttcttcaatatgttaaattagatgataacacactgctcaatgaattggtaatcatacaaattggcagagcaccccctaagacatgaatgaattacacttactactggtattktaattataaagcttatgaatcccggggagtgaggccagatggttcaaatggcttccactatgggtgaggggagcagggaagacttctctttcttatttcctttatgattgagaattgctgctaaagccacatccgattatgcccatgtctttgtgactagaatggatccacgtttatgcacttattttgaactactaaatgtcaacagcaaactagagagcctggcattgccaccttaaaaatatgatggttttcggttgagattgcagaggcctcatttgggctccgtattatagaaag

SEQ ID NO: 22761 - DNA, 601 bp, Human
tctgttgcaaatgaaataaaatataacaaggtttccaaatttctggggatcaagatacatgaaaaaacagagttattagtggcttaccgtccataggtcccagggcaatgtctgaaagcaaataaacaaaaatactgttagttatacaaatctaaaacataaaaaaatgctgaggtgacaaaagttcttgaaatcataagcattttttaagcattttgtacagtactgttcaataaaactttttttggtgaaggaaatgatccatatctgtgcttatccagtatggtagccaccagtcacwtgtggctattgagcacttgaaatgtgctagggtaacaaaaccacattttaaattttacataattgtattatacttaatataagcttaaatggcacttagctttggatagcacaggtctaatcaatctcaactttcactatgtgagtagaaaactatatttgaaacacaaatgaggttattttaatacacacacacacacacacacacacacacacacacacctcattaaaatgaagtaaacaaggtgtccaaattttagagcttgtcacatctttgaggaaatgcaggccctaatcactg

SEQ ID NO: 22762 - DNA, 601 bp, Human
agactttcagtggcctaatgatcattctaggggactatatcatcattaaatgtatgtgtcttctttctgttgcaaatgaaataaaatataacaaggtttccaaatttctggggatcaagatacatgaaaaaacagagttattagtggcttaccgtccataggtcccagggcaatgtctgaaagcaaataaacaaaaatactgttagttatacaaatctaaaacataaaaaaatgctgaggtgacaaaagttcttgaaatcataagcattttttaagcattttgtacagtactgttcaataraactttttttggtgaaggaaatgatccatatctgtgcttatccagtatggtagccaccagtcacatgtggctattgagcacttgaaatgtgctagggtaacaaaaccacattttaaattttacataattgtattatacttaatataagcttaaatggcacttagctttggatagcacaggtctaatcaatctcaactttcactatgtgagtagaaaactatatttgaaacacaaatgaggttattttaatacacacacacacacacacacacacacacacacacacctcattaaaatgaa

SEQ ID NO: 22763 - DNA, 601 bp, Human
ttccgaggtaggcatcattacccttattttataaatgagaaaaaaatgatgcttagagagttttagaaattgctcaggctggccgcagtggctcacacctgtaatcccagcactttgggaggccgaggcgggcagatcacaaggtcagcagatcgagaccatcctggctaacacggtgaaaccccatctctactaaaaatacaaaaattagttgggcgcggtggcgggtgcctgtagtcccagctacttgggaggctgaggcaggagaagggtgtgaacccgggaggcggagctggcagtkagccgagacagtgccattgcactccagcactcaatgaaacagcgagactccgtcttaaaaaaaaaaaaaaaaaaaagtaattgctcaaagtctcaaggttatgagtagtagagtttggactaaaatccagggctatctggctctaaaactcaagttcttattaacccaagcttcattgaatacaatcacttttttttaaaatggtaccatgtgccaagtagcccatctcttccattttctcattcacactttccttgtcttctatttaagtgtgtgtgtccttcactgcaacagctcctt

SEQ ID NO: 22764 - DNA, 601 bp, Human
gaccctgctccaagggatatgaggctgtagaggtgtgtgaccaatcacctaatttcacagcaccaatgagaccaccacaaagctctgtttgtgacactttcccaagtctaaattatggagtagttatccttacacatcagattagctgaaaaaacatcagtaataacatctaccttttattgatacacaccagacaccatgctacatactttacaattatcttatttaaacctcacacaaccttccgaggtaggcatcattacccttattttataaatgagaaaaaaatgatgcttagagwgttttagaaattgctcaggctggccgcagtggctcacacctgtaatcccagcactttgggaggccgaggcgggcagatcacaaggtcagcagatcgagaccatcctggctaacacggtgaaaccccatctctactaaaaatacaaaaattagttgggcgcggtggcgggtgcctgtagtcccagctacttgggaggctgaggcaggagaagggtgtgaacccgggaggcggagctggcagtgagccgagacagtgccattgcactccagcactcaatgaaacagcgagactccgtcttaa

SEQ ID NO: 22765 - DNA, 601 bp, Human
atccatgcatgcctttttgtgaatatatgagtaaaacttttcactagaaaagatataacttagtcattggtggtttcaatagacatttttaatctctcttcttgagcacttcccttgatgctccaaggatcttaaagagtgcagtatgagccctgcaactgcagaaggaagggacagacatctttttgttttgaagggagaaagaaagtggcaatgtcaattcagaagtggcattgcccatgaatagctagatctatcgaactttcctttttctgcctcacaataaaagaagaaaacatasaacttaagttgagttcttaagaccacatcaccagggcttttctaaaacaaagaccctgctccaagggatatgaggctgtagaggtgtgtgaccaatcacctaatttcacagcaccaatgagaccaccacaaagctctgtttgtgacactttcccaagtctaaattatggagtagttatccttacacatcagattagctgaaaaaacatcagtaataacatctaccttttattgatacacaccagacaccatgctacatactttacaattatcttatttaaacctcacacaaccttccgag

SEQ ID NO: 22766 - DNA, 601 bp, Human
atgactagcaatgccatggggaaacagttcattctagaaaatatactatgtatgtaatgcatatcaaataccaaaaaaatccagaatgatctggatatttacctaccggctgtaccaaatcagtgcttgtctgtatgggtaaagaaaatagtaacaataaggcgagagagaaaattcactaacacaataaaatcctatgctgtctagagtcaacattctgctgaaggctatagcttttactggtttaggaacaaattttacaacttgttttgtgataggaatgatttttgttccaaaattktttaagaccaccatagaaaaggcacaaatgaaacacaaagaaagcctctttcactttctagcatcagcaaggatgttttatggctagtatatgacttctgctttagcagactctgaaatgctaagtttcaaacacataagcaagtttgagaacatcggaataagatcaagcactagaggtcaagaaattacacagtagcacacactttgacacagtatcagaagaaaatattccccaaactcatcctatacttggctctgtctttgagatgggtgtttagatggagaatggtctgatatt

SEQ ID NO: 22767 - DNA, 601 bp, Human
ttttgccatatctcctccttccatgtccttttctaataggtcagttttctcaaaataattttcattggtgtttgtactttccttataccctgctcttagatcttttctagtttccacttcattaatttttaaggtcttatggtcttcctttcctatggtattaagaagttctaccactctgtttcctgtcctttcacatgctttctcttcaaattcctctgtaccttctagtgtcttgatatcaatagctccagtgtctaccttttgacacgcctccacacctgcccacagagaatcttcyatcttctgtttctcttcctcttcatctgacttcttcatatcttcatgactttctttgaacaggccagctgtgtccatggctggcatgtctgagtcaagtgggtcatacagctgctccatctccacacaagcagcaatggcaactccagcctccggcgcaggctttgggggcagttgttcatttccacctggaaaggctggccccggggcatgctcactctcttcagctacagtgggccagtcagcagacgaaagcaggctggtggataatcttatgtcttgctctgtttcggagggacat

SEQ ID NO: 22768 - DNA, 601 bp, Human
tattgcatttttctttatgtcttttctagtcaaatcccatccctcagggctgccatcttcaatattagatacagagtaggtctggagagatggattcaagatatctgggtgattggcaggtttggctccaaagccttctatcattccacaattattgattaccttttgaattccatcatgtagaccttggtctctgtcactaagttcttttgccatatctcctccttccatgtccttttctaataggtcagttttctcaaaataattttcattggtgtttgtactttccttataccctgcycttagatcttttctagtttccacttcattaatttttaaggtcttatggtcttcctttcctatggtattaagaagttctaccactctgtttcctgtcctttcacatgctttctcttcaaattcctctgtaccttctagtgtcttgatatcaatagctccagtgtctaccttttgacacgcctccacacctgcccacagagaatcttccatcttctgtttctcttcctcttcatctgacttcttcatatcttcatgactttctttgaacaggccagctgtgtccatggctggcatgtctgag

SEQ ID NO: 22769 - DNA, 601 bp, Human
atatcatatcatggttgggagtgtctattgcatttttctttatgtcttttctagtcaaatcccatccctcagggctgccatcttcaatattagatacagagtaggtctggagagatggattcaagatatctgggtgattggcaggtttggctccaaagccttctatcattccacaattattgattaccttttgaattccatcatgtagaccttggtctctgtcactaagttcttttgccatatctcctccttccatgtccttttctaataggtcagttttctcaaaataattttcattggygtttgtactttccttataccctgctcttagatcttttctagtttccacttcattaatttttaaggtcttatggtcttcctttcctatggtattaagaagttctaccactctgtttcctgtcctttcacatgctttctcttcaaattcctctgtaccttctagtgtcttgatatcaatagctccagtgtctaccttttgacacgcctccacacctgcccacagagaatcttccatcttctgtttctcttcctcttcatctgacttcttcatatcttcatgactttctttgaacaggccagc

SEQ ID NO: 22770 - DNA, 601 bp, Human
gttgggttctttttgttgttgttgttgatgctgctgctttttttttttttttttggtcaacctatttgtgtttggtttgcacagatttcaagaagtacatgacaatctgttagagagatcaggcctcctagaagatagtgatggataatgaagtaggtgacagacatgaggaaaaacagagcctacagaagtctttggctagtctatgctacagaccagggtaagtacctcgtctttgtcagcctctatttcttggtacaacaatccatatctctggttagcaatttcatcttcagataartctgagttgttgatgtcctggtctcgggaactagcagaactctcagtgctagcattccaggaggtccccaaaatcaatggtcttgctatctcctggctttgttcccagcagctagcaatggcttgttccctacaatcacctgctagtaagtccaccttcagttcttccttgtgctcaactacatctgaatgtgtccagctattatctaagccttctgtatctctgataggccagtggttaatagaatccagacaactggcaaatccacttgcttggccatctggtataccagagaatcct

SEQ ID NO: 22771 - DNA, 601 bp, Human
aatgcatcattttgatgaacagcaattatgatattttacagtttcagtgggcctgggttgaaacatttcgtgtgttctttttggagtggaaccacttcaggaacagtaaattagtctgtgctgctcttggtttagcacatttttagtacctgcatagtaaaagtgaaagtagggagaataaactcagaaaatgagatggtaacatagactgtcattaattcccaacacaatcattctgctttgtgtgtatgtgtctatgttgttgggttctttttgttgttgttgttgatgctgctgctttttttttttttttttggtcaacctatttgtgtttggtttgcacagatttcaagaagtacatgacaatctgttagagagatcaggcctcctagaagatagtgatggataatgaagtaggtgacagacatgaggaaaaacagagcctacagaagtctttggctagtctatgctacagaccagggtaagtacctcgtctttgtcagcctctatttcttggtacaacaatccatatctctggttagcaatttcatcttcagataaatctgagttgttgatgtcctggtctcgggaactagcagaa

SEQ ID NO: 22772 - DNA, 601 bp, Human
tttttgctggaatcactgtgcctgtgtgaatagaaataaccaaatgcaaagtcacactgaggttttacagacacattctctcctgttttctagaaaagtacaggatccagaaaccacattctggatattcaaactctagacagcctagaatgatcagctttagaacattcagtgataactaacaacttcctgagagcacaaacccaaatcaacttaccaagttgcagatcatactctggtctgtctgcattgtgaataatgaagtatcctggggctgaaaatcaaggataaaaatagaagwtgttttttaaagatatttaaatcagctaccatcaattgtgtctgcctacgtatctatctatctatctatctatctatctatctatctatctatctatccatctatctatcgacactctatctatctaatttttttttgagaaagggtctcctctgttccccaggctggagtatagtggtatgatcatgctcaccgcattctccacctccctgggctcaggcgatctacctcagcctcctgagtagctagaagtacaggcgcacatcaccacgcctggctaatttttgcatttttttgtat

SEQ ID NO: 22773 - DNA, 601 bp, Human
aaggcgggtcaatacagaggaagaggagatgggttgggacagcaggggcagaagtctagtcacatccaatgtggccttgtatccagtttctccaatcctgagagaactaatttagtgagaactccaaagggctttagaggcaaccctgagccccgagcaagagttactgattcaaaagggtttaaacctgtactcaaaagatgtcctgcggggctgtatgatgcaggctgggagatgtacagctgattaccaacttcaccccctacctcgctcagaatagtcaatgagccaaacactgggrcgttttcttgctcctgggaagatcgtgtacaatcacgactcactgggagacatcagttcactgtgatttcctagatcagagggcaggaccaaggttagcagcatttgcaatgctgaacatgacaaagctaagttccccatggaaagaaggggcaagatgtctgcttcagagaatacatacaaacagaagagaaagacaagcatggaagctcctaggaccagccatggatgacagggaaaggttcactgaaacttaaaaaccactgaattctagacctgaatcttttgcatccgtgtagta

SEQ ID NO: 22774 - DNA, 601 bp, Human
gagaatgatttcctattgtttgcttcagtagcagtcattacacactcagagaagaggtacatcctttacagatattggtggcagcagatgccacaatggtttaactctgaggaccataaaccaattattcctttagaataaaatgaggagtgtagccttgcagcaccttttctggtatcctttgtgataagatgaaaggcgggtcaatacagaggaagaggagatgggttgggacagcaggggcagaagtctagtcacatccaatgtggccttgtatccagtttctccaatcctgagagarctaatttagtgagaactccaaagggctttagaggcaaccctgagccccgagcaagagttactgattcaaaagggtttaaacctgtactcaaaagatgtcctgcggggctgtatgatgcaggctgggagatgtacagctgattaccaacttcaccccctacctcgctcagaatagtcaatgagccaaacactggggcgttttcttgctcctgggaagatcgtgtacaatcacgactcactgggagacatcagttcactgtgatttcctagatcagagggcaggaccaaggttagcagcatt

SEQ ID NO: 22775 - DNA, 601 bp, Human
gaaatttgacagtgcagctgtggtctagtataaagagaacataggattgcttatgttccccacaagtcacaagatgtttcacatacgacaataacacatgaaattttacaatatggcattacaacttaacctaaattccaggaggatagtatagctcactaaatgatgagtaacaatgaagcatggttatatataaaatcagctacccaaatttagaaatagaggccacctttctattccaagataatgtaaaattgtaagtattttgtcaagaaagagggaaaagcaaagataaaatgtsagcaaccgcttgtggagagatttaatatagtcctgtgggaattgtgccctaccttcactgtttttcctacaagatgcctcccttgaaagacattgcaaatgggttgatcccatgccacacctattttggagtgctgagaatgatttcctattgtttgcttcagtagcagtcattacacactcagagaagaggtacatcctttacagatattggtggcagcagatgccacaatggtttaactctgaggaccataaaccaattattcctttagaataaaatgaggagtgtagccttgcagca

SEQ ID NO: 22776 - DNA, 601 bp, Human
tttaaaagtgatttcccagtggagtaagaagtctctaattaatgctgtgattggagaaatcagtaacttctatccaactcaccataagcaatcaaaacgcacctctatttgtcctgtacatttatctgagtcagtgcacatggcaagttccacagagaagtgctggaaaagttatgctgagataatacaaaatgaatatgaatagcctagtgttggacaaatacacaaagtatttgtcttatgtttcccaccaaatcattccatttttatgcatgccaggatcacacgactattcttttcaaaaggacataataaattcaagggactggtagacaagtgtgcagacatttgatttttatgggcttttttcagctttaagaggtggcctgacataatttttaaggaagaatgagataaaattcacactaatatgctctcaagagtcctttatggaaaaatacttcacttttattgtttgaaaagaattatcttcatagtggaacaagttttcataacagcaaatagatactgtaagtgctcagggaatgatcttaccatttgggaagtcaaggtgatttgctatgacagcctggtatcaaat

SEQ ID NO: 22777 - DNA, 601 bp, Human
tagcaatataaactaacagcaagccattaaaagcaccacagccaatgcatgttactacaaatactgaaaatattccttctttttccattcttattaatataaataaacatatttatctagtatgattctttcactaaatgaatggccattagagggctcataagatccttttctatcaccagaacacttaaactaaaaaaagtttaaaagtgatttcccagtggagtaagaagtctctaattaatgctgtgattggagaaatcagtaacttctatccaactcaccataagcaatcaaaacrcacctctatttgtcctgtacatttatctgagtcagtgcacatggcaagttccacagagaagtgctggaaaagttatgctgagataatacaaaatgaatatgaatagcctagtgttggacaaatacacaaagtatttgtcttatgtttcccaccaaatcattccatttttatgcatgccaggatcacacgactattcttttcaaaaggacataataaattcaagggactggtagacaagtgtgcagacatttgatttttatgggcttttttcagctttaagaggtggcctgacataatttt

SEQ ID NO: 22778 - DNA, 601 bp, Human
tgtttaaagaaccacagggcagtattctccatggtttcaattataccccctgaattgtgtaggcagggtgaggtctttttgtcccaacaagacatataaacatcatcctgatttcaattacatatatgctgaatcaggcttctggcatctcttagatcaaggcctttttagttttaaaattagcaatataaactaacagcaagccattaaaagcaccacagccaatgcatgttactacaaatactgaaaatattccttctttttccattcttattaatataaataaacatatttatctagyatgattctttcactaaatgaatggccattagagggctcataagatccttttctatcaccagaacacttaaactaaaaaaagtttaaaagtgatttcccagtggagtaagaagtctctaattaatgctgtgattggagaaatcagtaacttctatccaactcaccataagcaatcaaaacgcacctctatttgtcctgtacatttatctgagtcagtgcacatggcaagttccacagagaagtgctggaaaagttatgctgagataatacaaaatgaatatgaatagcctagtgttggaca

SEQ ID NO: 22779 - DNA, 601 bp, Human
gagagggtctatatggggtgccttaggttattctacagttagtgaggaggccagaatgggcccagcaagctccagccgtgcttggcacaaggcttcttggactgcttgtgctccagttaaaacggaacctggcaggaaacaaccccttatctagaggtttagcttttcctccaaattaatttattcataaatccattatagccacccctgtccccacaagaggtagcaaggtagcagttactttctaatggagagagacaaagacagagagagagagagagagagagagagagagagaggaaatgatacaacattttacactttagaagaaaaagagctgatttttaaatgtaaaatcaaatttaaaaacttaaaattccttttcagattctatcaggaaacatctgagacaggaaacacttaggttaagccagtgtttttaggtatttactaagtttttttggtaagaaccctttggtttatgaaggctctaagtagcctgtctgagcaaaaccttcttcccattaacttagccgccttttttttctgccttttggtgcaagttcattcatacatgaatccattaatttaccaaatattt

SEQ ID NO: 22780 - DNA, 601 bp, Human
agagagggtctatatggggtgccttaggttattctacagttagtgaggaggccagaatgggcccagcaagctccagccgtgcttggcacaaggcttcttggactgcttgtgctccagttaaaacggaacctggcaggaaacaaccccttatctagaggtttagcttttcctccaaattaatttattcataaatccattatagccacccctgtccccacaagaggtagcaaggtagcagttactttctaatggagagagacaaagacagagagagagagagagagagagagagagagagagagaatgatacaacattttacactttagaagaaaaagagctgatttttaaatgtaaaatcaaatttaaaaacttaaaattccttttcagattctatcaggaaacatctgagacaggaaacacttaggttaagccagtgtttttaggtatttactaagtttttttggtaagaaccctttggtttatgaaggctctaagtagcctgtctgagcaaaaccttcttcccattaacttagccgccttttttttctgccttttggtgcaagttcattcatacatgaatccattaatttaccaaatatt

SEQ ID NO: 22781 - DNA, 601 bp, Human
ttaatgatctatgctgtcacaagcccttaagcccttttcagatggcttgtagcatctcagaaaatagaaacatctttaggaagtgattgtgtccaacagaccctcagaaaaaaatcaacgtagcccaaagcatcttcctatcttttcttttacctgatcagcttctgaatctgaggggaccaccagcaccacatcacccctttgtaaggtaagttcatcagaatttgctgcctcaaaatcatgcagtgtttccacctgcagaagataagaatacataaaaatcaatttcccagccagattwcaagcagacactcttacaagtcactctccaacctggatgaaaagaggaagatatttgccatatcccaaggaggaagaaggcctctaaagccagaagggaagtcctattctctgatatgaggccattcatatgtatatttattaatagtaatgcaatgccctctacaacagggaaaagcactatattaatcaaattttaattcatcttatttttgttagagatttgcattttattatcgctgatgctttattactgtttgttgtttaactggaacccaaaatgtctaaagctcctctaacc

SEQ ID NO: 22782 - DNA, 601 bp, Human
cagaggcaaccacttttgaaggggtcttttagttcacattcatagtgtctgcatttcctgaagacaggtgttacagagataacattcccagaaagtggttacgtgataagaaacagtcaactgtttgtattatataaaaaaagaatgcaacagcatcccaaaagggtgtcctagaaacctcgttaatgatctatgctgtcacaagcccttaagcccttttcagatggcttgtagcatctcagaaaatagaaacatctttaggaagtgattgtgtccaacagaccctcagaaaaaaatcaaygtagcccaaagcatcttcctatcttttcttttacctgatcagcttctgaatctgaggggaccaccagcaccacatcacccctttgtaaggtaagttcatcagaatttgctgcctcaaaatcatgcagtgtttccacctgcagaagataagaatacataaaaatcaatttcccagccagatttcaagcagacactcttacaagtcactctccaacctggatgaaaagaggaagatatttgccatatcccaaggaggaagaaggcctctaaagccagaagggaagtcctattctctgatatg

SEQ ID NO: 22783 - DNA, 601 bp, Human
aatctctttaagttgaggtataacttaaatactgtgtaatgcagagatgattaggtatatatagttcaatgagttttgacaaatacatgcagacatccctctcaagatacaaagcatttccatcactccagagggttccccaggttctttcctcatcaatatccacacacccagaggcaaccacttttgaaggggtcttttagttcacattcatagtgtctgcatttcctgaagacaggtgttacagagataacattcccagaaagtggttacgtgataagaaacagtcaactgtttgtaytatataaaaaaagaatgcaacagcatcccaaaagggtgtcctagaaacctcgttaatgatctatgctgtcacaagcccttaagcccttttcagatggcttgtagcatctcagaaaatagaaacatctttaggaagtgattgtgtccaacagaccctcagaaaaaaatcaacgtagcccaaagcatcttcctatcttttcttttacctgatcagcttctgaatctgaggggaccaccagcaccacatcacccctttgtaaggtaagttcatcagaatttgctgcctcaaaatcatgcagtg

SEQ ID NO: 22784 - DNA, 601 bp, Human
agtgatatttttaaagaatctctttaagttgaggtataacttaaatactgtgtaatgcagagatgattaggtatatatagttcaatgagttttgacaaatacatgcagacatccctctcaagatacaaagcatttccatcactccagagggttccccaggttctttcctcatcaatatccacacacccagaggcaaccacttttgaaggggtcttttagttcacattcatagtgtctgcatttcctgaagacaggtgttacagagataacattcccagaaagtggttacgtgataagaaamagtcaactgtttgtattatataaaaaaagaatgcaacagcatcccaaaagggtgtcctagaaacctcgttaatgatctatgctgtcacaagcccttaagcccttttcagatggcttgtagcatctcagaaaatagaaacatctttaggaagtgattgtgtccaacagaccctcagaaaaaaatcaacgtagcccaaagcatcttcctatcttttcttttacctgatcagcttctgaatctgaggggaccaccagcaccacatcacccctttgtaaggtaagttcatcagaatttgctgcc

SEQ ID NO: 22785 - DNA, 601 bp, Human
ggattacaggcatgagccaccctgcccagcagattattgttatataaatttccaatctattttattgtggtagagactgcttgacccagcacctgatgtatcttggtaagtgtgttgtcaaaagaaagaacaaaatgttgaacatattaagtcttaacctcaaaggcagtgatgcttgaatttattttttaaggggagagctcataaatctctttgagaatagtatggaagttagagtttttctctccagaaaaatatgtttacagatgcatttacttgctctgcataccatttcaagggytcacatattttatgaatgagaacaagatgggagttctcagtaccttacatcagaccactcttttaggaagtgatatttttaaagaatctctttaagttgaggtataacttaaatactgtgtaatgcagagatgattaggtatatatagttcaatgagttttgacaaatacatgcagacatccctctcaagatacaaagcatttccatcactccagagggttccccaggttctttcctcatcaatatccacacacccagaggcaaccacttttgaaggggtcttttagttcacattcatag

SEQ ID NO: 22786 - DNA, 601 bp, Human
gtgatcatggctcactgcagccttgaattcctgggctcaagtgatcctcccatgtcagctttttgagtagctaggactacaggtgcacactgctgcacccagctaattaaaaaaaaatttttttgtagagatgaggtcttgctatgttgaccaggctggtctggaactcctggcctcaagtgatcctcctgccttggcctcccaaagtcctgggattacaggcatgagccaccctgcccagcagattattgttatataaatttccaatctattttattgtggtagagactgcttgacccarcacctgatgtatcttggtaagtgtgttgtcaaaagaaagaacaaaatgttgaacatattaagtcttaacctcaaaggcagtgatgcttgaatttattttttaaggggagagctcataaatctctttgagaatagtatggaagttagagtttttctctccagaaaaatatgtttacagatgcatttacttgctctgcataccatttcaagggttcacatattttatgaatgagaacaagatgggagttctcagtaccttacatcagaccactcttttaggaagtgatatttttaaagaatc

SEQ ID NO: 22787 - DNA, 601 bp, Human
atttaatgatcattatgaaatttttttttaactcacactatgatttatttgacccatgggttatttagaagtgtattttaaaatttttaaatctttgggggcttttaaagatatattattgttattaattttttgttttttgagacggggtcttgctctgttacccaggctggagtgcagtggtgtgatcatggctcactgcagccttgaattcctgggctcaagtgatcctcccatgtcagctttttgagtagctaggactacaggtgcacactgctgcacccagctaattaaaaaaaawtttttttgtagagatgaggtcttgctatgttgaccaggctggtctggaactcctggcctcaagtgatcctcctgccttggcctcccaaagtcctgggattacaggcatgagccaccctgcccagcagattattgttatataaatttccaatctattttattgtggtagagactgcttgacccagcacctgatgtatcttggtaagtgtgttgtcaaaagaaagaacaaaatgttgaacatattaagtcttaacctcaaaggcagtgatgcttgaatttattttttaaggggagagctcat

SEQ ID NO: 22788 - DNA, 601 bp, Human
ggtctctgtactgaagccagtctgattccttcactcccaccagccagcctgcatcctgaaaaacaatgacagaactttcagggtccagcaaactactggaaaatccacactgccacaattaattaataatgtgttacattagtgttgtggttctgaaccaggatgtcacattacaggtaaagtgctgtgccgtgatcaatgggaaggcctatcccaaataagttgttagttaaaaaaaaaaagaaaaagaaaaagaaggaataaacatttgcaatgacttattgactgtataaagtatagytaatgctttgtacattgtgactgtacaaagcatagttaattgatattaactggattataatatgagttcttaaagaggagaaaaggattacaattacaaccagtgcaaagacaggaataccatgtgaaagcatttcatgcacaagagcatgacctgttctggggtcacagtgtaaaaaaggtttgaggttgcttgggttagaatggaatactgatgaggccatggaatatcttatatttcatcccaagccacttgctcataagaaagaactctgacccccagctcatatcctataacccc

SEQ ID NO: 22789 - DNA, 601 bp, Human
tgcagtacttgttgccctaatctaagcgtcgggtgaagttctctggaaagaggcctttgtaggtggcaaggtctctgtactgaagccagtctgattccttcactcccaccagccagcctgcatcctgaaaaacaatgacagaactttcagggtccagcaaactactggaaaatccacactgccacaattaattaataatgtgttacattagtgttgtggttctgaaccaggatgtcacattacaggtaaagtgctgtgccgtgatcaatgggaaggcctatcccaaataagttgttagttaaaaaaaaaaagaaaaagaaaaagaaggaataaacatttgcaatgacttattgactgtataaagtatagctaatgctttgtacattgtgactgtacaaagcatagttaattgatattaactggattataatatgagttcttaaagaggagaaaaggattacaattacaaccagtgcaaagacaggaataccatgtgaaagcatttcatgcacaagagcatgacctgttctggggtcacagtgtaaaaaaggtttgaggttgcttgggttagaatggaatactgatgaggccatggaatatc

SEQ ID NO: 22790 - DNA, 601 bp, Human
tagaacaatctgtgaagatgagttgcataaatagaaagaggtggaaatatagaggagctgtttttatagtgttcttttgggggtagatgaatatgccccatctttctacccaatctcataaaggcagaagagaagactgcttagctgcccatcccaactagcctacctccagccacagcggctggacagctagataaatcaggccctgccttctctgagggtgcctcagtgtagtcgtgctatctgtcatctcatcctgaaaactgcacagtacaaacacagatactgttgactcttttgscaatgggatggctggttttgccattaggcaaaactgcaattgtaatgccagacagaataagagcaatgcatgtatcaatgacaattgagaggcaaagagctacaatggaaaggaaagaagcaactatgtatatgtagccttctgcatacacatagatccaggagtcatgggaactagcttgcgtgactgtgtgtccatatatatatagatgtgttggaaaagaacattgagaacttttgcagcagtttagttttaaacatagtaaacctgaaagggagcgagagcacgtgctcacacctg

SEQ ID NO: 22791 - DNA, 601 bp, Human
gatggctaatgcctgtaatcccaacactttgggaggccgaggtgggcagatcacttgaggttaggagtttgagaccagcctggccaacatggcgaaaccccgtctctactaaaaatacaaaaaattagccaggtgtggtggcaagtacctgtaatcacagctactcgggaggctgatgcaggataattgcttgaacatgggaggcagaggttgcagtaagccaagatcacaccattgcactctagcttgggcaacagagcaaaaactccatctcaaaaaaacaaaacaaaaacaaacaaacaaaaaatacaaaaattagctgggcatggtggtgcagtcctgtaatcccagctacttgggaggctgaggcacaagaatggcttgaacctgggaggcggaggctgtagtgagccgagatcgcgccactgcactccagcctgggtgacagagtgagactccgtctcaaaaaaaaaaaaaaagaaatatgatttttaacagaatatgaggtaattaaaaagcaatccaactaaggtgacagtgcatccaccttgggcctggcactagctggaaatcactgctccacttgcattaagcttacccg

SEQ ID NO: 22792 - DNA, 601 bp, Human
agattgttcttatgaggagtttaaatactttacaaaataagtataatttaaatattatttttggccgggcatgatggctaatgcctgtaatcccaacactttgggaggccgaggtgggcagatcacttgaggttaggagtttgagaccagcctggccaacatggcgaaaccccgtctctactaaaaatacaaaaaattagccaggtgtggtggcaagtacctgtaatcacagctactcgggaggctgatgcaggataattgcttgaacatgggaggcagaggttgcagtaagccaagatcrcaccattgcactctagcttgggcaacagagcaaaaactccatctcaaaaaaacaaaacaaaaacaaacaaacaaaaaatacaaaaattagctgggcatggtggtgcagtcctgtaatcccagctacttgggaggctgaggcacaagaatggcttgaacctgggaggcggaggctgtagtgagccgagatcgcgccactgcactccagcctgggtgacagagtgagactccgtctcaaaaaaaaaaaaaaagaaatatgatttttaacagaatatgaggtaattaaaaagcaatccaacta

SEQ ID NO: 22793 - DNA, 601 bp, Human
atagttttcaatgtcctttcattctaatttactcattacttattgagcatgttattaatgtgtacttaagactttgggtaacatatggattatatacgacatatatttttgcatcttcttctgatatcaataggaagattgttcttatgaggagtttaaatactttacaaaataagtataatttaaatattatttttggccgggcatgatggctaatgcctgtaatcccaacactttgggaggccgaggtgggcagatcacttgaggttaggagtttgagaccagcctggccaacatggcraaaccccgtctctactaaaaatacaaaaaattagccaggtgtggtggcaagtacctgtaatcacagctactcgggaggctgatgcaggataattgcttgaacatgggaggcagaggttgcagtaagccaagatcacaccattgcactctagcttgggcaacagagcaaaaactccatctcaaaaaaacaaaacaaaaacaaacaaacaaaaaatacaaaaattagctgggcatggtggtgcagtcctgtaatcccagctacttgggaggctgaggcacaagaatggcttgaacctgggag

SEQ ID NO: 22794 - DNA, 601 bp, Human
ggttacattagttttattcctgtggttaaaactccttgtgatgccaggtgcggtggctcaagcctgtaatcccatgggaggccgaggcaggtggagcacctgaggttgggagttcaagaccagcctgaccaacatggagaaaccctatctctactaaaaataaaaaaattagctgggcatggtggtgcatgcctgtaatcccatgctgcctgtaattacatgcatgcctgtaatcgggaggctgaggcaggagaattgcttgaacccgggaggtggaggttgtggtgagctgagattgcaycattgcactccagcctgggcaacaagagcaaaactccgtctcaaaacaagcaaacaaacaacaacaacaaaaaaactccttgtgagagaaagggcggacagcatccattatagttttcaatgtcctttcattctaatttactcattacttattgagcatgttattaatgtgtacttaagactttgggtaacatatggattatatacgacatatatttttgcatcttcttctgatatcaataggaagattgttcttatgaggagtttaaatactttacaaaataagtataatttaaatatt

SEQ ID NO: 22795 - DNA, 601 bp, Human
tttccctggtctctgaggttccgtttctcatcggctccaccactgtataaacaaaacctgtcttttaaccttttgggggatgatgaatttatagaaatgcagcctaaacccacacaaatttgcatccattttaaagagatcttgaattctacttagtaggcccaagctgaaagcctggcccagaggatcaaacctcaaagactggccacacactatgcacattccacaaggtccccacactggataggaccttagaggtcatctttctagctctacttccaaggtgtacagatggggaagmtggggcctggaaggggcagagagctgggactcgagctccatctccccctctcctgtctgcagcaccccgaatctgcttcttctgtgcaccgccatagggcctttcaataaccccccacctctgtgacctgatgagtctcaccaccacatgacactgcaacaaaagtcagttctacatcttactctgacaaaatgctctcttgtgagctgaaacagattctttacctcagtaggaggatttcagaacaacccctttgactgaccctcttccaaagatgcctcttggttacattagttttat

SEQ ID NO: 22796 - DNA, 601 bp, Human
ctttccctggtctctgaggttccgtttctcatcggctccaccactgtataaacaaaacctgtcttttaaccttttgggggatgatgaatttatagaaatgcagcctaaacccacacaaatttgcatccattttaaagagatcttgaattctacttagtaggcccaagctgaaagcctggcccagaggatcaaacctcaaagactggccacacactatgcacattccacaaggtccccacactggataggaccttagaggtcatctttctagctctacttccaaggtgtacagatggggaarctggggcctggaaggggcagagagctgggactcgagctccatctccccctctcctgtctgcagcaccccgaatctgcttcttctgtgcaccgccatagggcctttcaataaccccccacctctgtgacctgatgagtctcaccaccacatgacactgcaacaaaagtcagttctacatcttactctgacaaaatgctctcttgtgagctgaaacagattctttacctcagtaggaggatttcagaacaacccctttgactgaccctcttccaaagatgcctcttggttacattagtttta

SEQ ID NO: 22797 - DNA, 601 bp, Human
ctgaggcccctttgagcaagtctgccacagggccactttccctggtctctgaggttccgtttctcatcggctccaccactgtataaacaaaacctgtcttttaaccttttgggggatgatgaatttatagaaatgcagcctaaacccacacaaatttgcatccattttaaagagatcttgaattctacttagtaggcccaagctgaaagcctggcccagaggatcaaacctcaaagactggccacacactatgcacattccacaaggtccccacactggataggaccttagaggtcatctytctagctctacttccaaggtgtacagatggggaagctggggcctggaaggggcagagagctgggactcgagctccatctccccctctcctgtctgcagcaccccgaatctgcttcttctgtgcaccgccatagggcctttcaataaccccccacctctgtgacctgatgagtctcaccaccacatgacactgcaacaaaagtcagttctacatcttactctgacaaaatgctctcttgtgagctgaaacagattctttacctcagtaggaggatttcagaacaacccctttgactgaccc

SEQ ID NO: 22798 - DNA, 601 bp, Human
gatgatgactgatgcaatgcaagcaaaatgttctcagatctgagcatttcgaaggatgtgtcattacaggaataattataactgctttattgtgagtctctaaacctctaaataccctttaataatcaatagctttttttcccctggaggttttgttgcctggttttccaaagaacagttatgtaaggagtggcagcttgccagctggggttgctgcagggggagatggttgctgaggcccctttgagcaagtctgccacagggccactttccctggtctctgaggttccgtttctcatcrgctccaccactgtataaacaaaacctgtcttttaaccttttgggggatgatgaatttatagaaatgcagcctaaacccacacaaatttgcatccattttaaagagatcttgaattctacttagtaggcccaagctgaaagcctggcccagaggatcaaacctcaaagactggccacacactatgcacattccacaaggtccccacactggataggaccttagaggtcatctttctagctctacttccaaggtgtacagatggggaagctggggcctggaaggggcagagagctgggactc

SEQ ID NO: 22799 - DNA, 601 bp, Human
tgcacacgagctatttccagctctctgcatttctccctgtaatgatgatgactgatgcaatgcaagcaaaatgttctcagatctgagcatttcgaaggatgtgtcattacaggaataattataactgctttattgtgagtctctaaacctctaaataccctttaataatcaatagctttttttcccctggaggttttgttgcctggttttccaaagaacagttatgtaaggagtggcagcttgccagctggggttgctgcagggggagatggttgctgaggcccctttgagcaagtctgcsacagggccactttccctggtctctgaggttccgtttctcatcggctccaccactgtataaacaaaacctgtcttttaaccttttgggggatgatgaatttatagaaatgcagcctaaacccacacaaatttgcatccattttaaagagatcttgaattctacttagtaggcccaagctgaaagcctggcccagaggatcaaacctcaaagactggccacacactatgcacattccacaaggtccccacactggataggaccttagaggtcatctttctagctctacttccaaggtgtaca

SEQ ID NO: 22800 - DNA, 601 bp, Human
tcaaactcctgacctcaggggatccacccgccttggcctcccaaagtgctgggattacaggcctgagccaccgcacccggcctgttgagggtatttttcatagatgaagttcattaaatcagagaaggactgtcagctgatgtgtaactgtgcaacaagcatttcaaccccaagagtcctttggcagcagaagctggctttgaagcggggcagcaaggcagggagacagaggctgcaggactgtgtgcaggttctgggcattggaagctcccctgtttccttcactgactcgctgtcaatytgctcctttccttgtgactccttgcctgtagcttgcacacgagctatttccagctctctgcatttctccctgtaatgatgatgactgatgcaatgcaagcaaaatgttctcagatctgagcatttcgaaggatgtgtcattacaggaataattataactgctttattgtgagtctctaaacctctaaataccctttaataatcaatagctttttttcccctggaggttttgttgcctggttttccaaagaacagttatgtaaggagtggcagcttgccagctggggttgctgcaggggga

SEQ ID NO: 22801 - DNA, 601 bp, Human
ttcgccttttaccttattcacgtcaaaattctcctgcaccggaggattggggcacttcccaagatgaaatgcttgtccctctgccgcaccgaagaggccagccagtgcggaaagcagcagcagcagcatcaccatcttggggctgggtggctggagaagggacctggagctgcgggaacgcaaagcagctggggttgtcattctgagccttctaaggccacacaatcatgaagtaagagtgctgtgcccatggtcccctctgtgggcggtccctcctcttctctccccagcccatgtgaamcctcatcctgcaggggaacacctgcctgtccttgttgctgtgaggccttcctcagagcctctgcacctccacgagggcgctctctgcctggtattctggtttgttggattgattttcacccctgtcccacctaattatgcatctcccaggatgggcactgtgtctagttctcctcagaatcacccacggacctcaaagtgtcggctcagtagatacttgtcaaatgaacagaaacagcgtggagagggctatgtaaagtgggggattaaagcctccaagtgaaccacgaaagacacgaaa

SEQ ID NO: 22802 - DNA, 601 bp, Human
agaccgtgccctcctctctcatctggatctcagacagctggggaagatggtctgtttctatctgcatacgttaacttagcaacaaaccagtctcctcccagcagattctgcccttttcaccgtcaattgcattttgctctagaacggttttcaggacaccagtctctgaccatgaagtcacaacatgttcatggaaaaactgcatttgtattttcaagagtggaaggtgggtaggaaggagctcttcctggggctctttttaagtttatagttgctttccaaagcgtagctttttggattwattattgtgttagaagccctcagtaatagaaatgtacacttctaaaggatatcctgtttacataacctagagtgtgaatgttgtgtatgtgattcttgcttagtaagaaaaggagctttctgatagattaagctgcccagagatgggatgaactgtcctggaaggcgatgagctcccagttcctggaagtgtttgaacaaagctggatgcttctgtcagcagatggtgtcgaagcggcttctctcccagactggaggtcagaagagatggtcttgatgttctttgctaccagagtatcta

SEQ ID NO: 22803 - DNA, 601 bp, Human
atgaggtcttgctatgttgcccagactggtcttgaactcccggcctcaggtgatcctcctgcctcagcctcccaaagtgctgggattacaggcatgaggcaccacgaccagcctgtttaaggatttctaagcataagcttataatgaaaaacccacaataattaatccaacttggaatctactgcgagcacagcaggtcagcaacaagtttattttgcagctagcaaggtaacagggtagggcatggttacatgtttaggtcaacttcctttgtcgtggttgattggtttgtctttatggsggggggtggggtaggggaaagcgaagcagaagtaacatggagtgggtgcagcctccctgtagaacctggttacgagagcttggggcagttcacctggtctgtgaccgtcattttcttgacatcaatgttattagaagtcaggatattttttagagagtccactgtttctggagggagattagggtttcttgccaagatccaagcaaaatccacgtgaaaaagttggatgatgcaggtacaggaatacacgagggcatagttctcatagtcggtggccaggatccagtacggtgccgatgg

SEQ ID NO: 22804 - DNA, 601 bp, Human
acacgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagaggtaaacggaccctgcagaccgtgctgaggcggtcccggtgccgggccgctggagctggggtcggccatcggaggagggcgggcgggcaggagagtgtcgcggggcggtggggcgagggtcgcggagtaaggaagggcaccgtgtcaacggcttggggctkcggagggcgggtgggagccggactcaatctccggtctcagcgtctgcaccctagctcttagtttgggggcactgtcgacttcccccgtccctcggggatcttgcctgggggatggcgccataagctctgagaagaggctctagaagcccactgtccatggatcgagccctcaccccccacttgagtggcccaggacctgggagtctctctaggtcccatcgcccccctcacgacccccccagggagtgggggaacacctctgttatgccttaaaaaaaaaaaaaaaaaggaaaggaattt

SEQ ID NO: 22805 - DNA, 601 bp, Human
gcgggcaggagagtgtcgcggggcggtggggcgagggtcgcggagtaaggaagggcaccgtgtcaacggcttggggctgcggagggcgggtgggagccggactcaatctccggtctcagcgtctgcaccctagctcttagtttgggggcactgtcgacttcccccgtccctcggggatcttgcctgggggatggcgccataagctctgagaagaggctctagaagcccactgtccatggatcgagccctcaccccccacttgagtggcccaggacctgggagtctctctaggtcccatcgyccccctcacgacccccccagggagtgggggaacacctctgttatgccttaaaaaaaaaaaaaaaaaggaaaggaattttaaaaatgaaggatgggagggtgatttaggaagggatcaagaagttgcaaatcttgtgtgtattattaaacgtctcctttttctcccatgaccttttcttggttcagataacccagctgtgctccctggaaccttcaatttcaaggcctccctgcctctactaggcgccttagctcactatggggaaccacttgactgagatggcgcccactgcctcctcct

SEQ ID NO: 22806 - DNA, 601 bp, Human
gcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccragccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaat

SEQ ID NO: 22807 - DNA, 601 bp, Human
attgcttttactctgggtaaaaagccagggctggaggggctggagtcggggttctctctggtacagcagtatactcccagggcctgggacagcacagatgtataggaaacatctggcaaaaggagagctggaatccatgtctgcctgaattacagagctgggccccgggccccaccagcacttcctgtgagcaaggcatttggtctcacttctgctgacaagcaaaacagaagaaaagatggtctccaaaaccaccgctatgctgacctttgagaatttagggtgtcaagacagtgaccccactttgtagaatggtaggaagcttttccagggtgtgggatgcagacccagagcaagtgaggaacccttagacagtcgtgctcgaaaccccaacttttcagtgtgaaatcactgacccatatttgctgactgaagttttccaagtctttcagcttcatggcattttggggaagcaggatggagatcattacctccatctgagcaagatgatggcgaggcttggaaagctggctcaccctgtgtagtcacctcaagctggctctggacacaggctgccttttccaaaggaggactggagcat

SEQ ID NO: 22808 - DNA, 601 bp, Human
caagaaaggtgttagacaactgctcgcctcactggccctctggagcctgccctgccctgcttcccccagaggaatacaatccctggggacttatgacaactgaacagtgcagaaggaaccagcagagggaaccgctgcctttcttcatcactgccggcagcaaaagctgactggaagccatgtcctagtccagatccgggcatgcacaccggctggtgttgagcaggcaacttgtgaattgcaagtcgattgcattggtggctttcctggcagagctttcggatctcagttcagacaaackcgtcagcacaccctgtcctgacctccccctaaactagggctggccctcttccgaccccttcttggcaccgtgcactttccttccctttgtagtgcttattatcataatgcaaagtctatgtctcccccactagacccgtgagccatgtgagggcggggtggccactgacgccatttgaaatcaggggagtcctcattgaatcattgcttttactctgggtaaaaagccagggctggaggggctggagtcggggttctctctggtacagcagtatactcccagggcctgggacagcacaga

SEQ ID NO: 22809 - DNA, 601 bp, Human
accacgcctggcccagtttaacattttttgataaaagtaaatttcatttcattccaagaaaggtgttagacaactgctcgcctcactggccctctggagcctgccctgccctgcttcccccagaggaatacaatccctggggacttatgacaactgaacagtgcagaaggaaccagcagagggaaccgctgcctttcttcatcactgccggcagcaaaagctgactggaagccatgtcctagtccagatccgggcatgcacaccggctggtgttgagcaggcaacttgtgaattgcaagtygattgcattggtggctttcctggcagagctttcggatctcagttcagacaaactcgtcagcacaccctgtcctgacctccccctaaactagggctggccctcttccgaccccttcttggcaccgtgcactttccttccctttgtagtgcttattatcataatgcaaagtctatgtctcccccactagacccgtgagccatgtgagggcggggtggccactgacgccatttgaaatcaggggagtcctcattgaatcattgcttttactctgggtaaaaagccagggctggaggggctgga

SEQ ID NO: 22810 - DNA, 601 bp, Human
caccaagccccgccgtacaggactgcatgaaggcgcaagtcacagagtagaaagtaaggccattttgagatgggctccaacatggctgacccttgaggacatgggactcagtgaaaggagccagtcacagaaaggcccgcactgtaggattccactcctgtgaggggcctcaaaggagagccgtgaactctgtagagacggacagtggaagggtgggtgccaggggctggggggtggggagttggggttgaacggggccagagcttcagtttgggaagatgaacaagttctgcggctggayggtggtgatggctgcacagcaccgtgaatgtgcttctgcccctgggccgcacacttacaaatggtgaacgtggtatgttttatgctatgtgtattctgccacacctttttttaaaagtccatctaggctggactggctcacacctgcaatcccagcactttgggaggccgaggcgggtggatcacttgagcccaggagtttgagaccagccttggcaatatggtaaaaccctgactctaccaaaaatacaaaaattaccctgtctcataacctggtctcaaaataaataaataaataagt

SEQ ID NO: 22811 - DNA, 601 bp, Human
gggagaagctctcaatatctcgcccctaaaaatgccgctgccccaggttttctatacgttcccattactagttaaggatgctcccttcaatcagcggaggctataggggagcccaacagtggcctggaagaggcccacccagaaaaggacagttgatgactgattgagagtggaggaccctgggatcaggcagctgctccggccactgaggtgacccagagctgaagaaagatcagcatgtacaggtgggctggcatgtggggcaaagctagtacctggataaacttctccatgtctcccycaaagagtctctggttatactgggagctggggcggggctggcggctcttctggaattttctctgtgtgtactgggtcctgcagtgaatgggagctggctctgagggggccaggtgtggagaatagggtgccccaccccccaggccagccaagccggcctctaattctctgaagttattccacaatccagtgcgaaaactggggaagtgaggcccaggggattgggcagctgagctgggccccaggaagagaagagatggcggaccgtcgcagggccccagccctcagggaggactcacca

SEQ ID NO: 22812 - DNA, 601 bp, Human
tgtcatccaggagccagtcgatgcccggcagcaggttctccccggtgacggcgctgcagccctggatgcaccagtggtggctgcggatggagtccagctccaggacctgggaggacaaaggtgctgatggtggtggccagtgactgcagaccctgcctgccgtcagccccttccctccccagcccagaggaactccacgccttcctcaaggccctgctccatgtcatcccatccaggaagccccgccggtcccagggagagtttgtcagaccccaggggcacctgggctctctgtccagtwccatgccagtgctgccccttagtgatgtaaatgcagcatgggctcctgagcatccaccaggatccgggcatcgtgctaggagccccacacaccctctctcactcattctcctcaagccctcatgagccagggattgtgtcgaccatttcaccaaggaggaaaccaaagttcagagaggttaagcaacctgcctaggggaacatagctcataagtggcagagccaagattttaaccctgctctttctcactgtggtgcttgagcactagaatcatggttaaaatgtgggctctggggtcag

SEQ ID NO: 22813 - DNA, 601 bp, Human
ggtgaaggttgagggacctggactgctaggtggggggcatctggagtggttcagtcagctgtgaaaatgcggctggaaatgtcatccaggagccagtcgatgcccggcagcaggttctccccggtgacggcgctgcagccctggatgcaccagtggtggctgcggatggagtccagctccaggacctgggaggacaaaggtgctgatggtggtggccagtgactgcagaccctgcctgccgtcagccccttccctccccagcccagaggaactccacgccttcctcaaggccctgctccakgtcatcccatccaggaagccccgccggtcccagggagagtttgtcagaccccaggggcacctgggctctctgtccagttccatgccagtgctgccccttagtgatgtaaatgcagcatgggctcctgagcatccaccaggatccgggcatcgtgctaggagccccacacaccctctctcactcattctcctcaagccctcatgagccagggattgtgtcgaccatttcaccaaggaggaaaccaaagttcagagaggttaagcaacctgcctaggggaacatagctcataagtggcagag

SEQ ID NO: 22814 - DNA, 601 bp, Human
aactactcgcgctttactcccagctttaatgtgacctcctttaggaagcctgcagatggaatcagttgcaccgtgtcccatgcttctataactttttctgcatccctttgacatagccacagttcaccatcgactccaatgatccattcctttctgtcccctgctagattgagggtcccaggtggtctctaacgctgttgaatcaacaaatgactcagccaggaatcggggcaaggagcggtttatttcacaactgagtgaaggatgaggcccacagcctcggtagcagcagtagcagctyctccccgcccagccctctcttcttggtatggtagccaaaggccaggtcaggagccagagagacagccagggcacagccctcccgccatgggagccgggtggccacagagcagcagcgggcagcagtagcagcagcaggctggggtggaggagggggagtgttagtttggccggctgactcccaaccccccatgggtagtgtttggtgaaggttgagggacctggactgctaggtggggggcatctggagtggttcagtcagctgtgaaaatgcggctggaaatgtcatccaggagccagt

SEQ ID NO: 22815 - DNA, 601 bp, Human
tttcccaagagccattgctttttttttttgagacagagtctcgctctgtcacccaggctggagtgcagtggcgcaatctcggctcactgccagctccgtcttcccgggttcacgccattctcctgcctcagcctcccgagtagctgggactacaggcgcccgccaccacgcccggataattttttgtatttttagtagagacggggtttcaccgtgttagccaggatggtcttgatctcctgacttcatgatccgcccatcttggcctcccaaagtgctgggattacaggtgagccaccgygcccagccggagcccttgctcatcatgcctgtcctgtgatcccctctgcctgaatctgtgctggccttgtacagctgttcaggttgtccactgcacatgggttcctggctgcaacagagaattgggagctgaatttcagcccatgttccatgcaaaaagttggagccctggtctgcagctgtgtctgtttttctaattcatacctatgagagttggatttcccctggtgaactgtcttccccttcctctacctagaaaactactcgcgctttactcccagctttaatgtgacctccttta

SEQ ID NO: 22816 - DNA, 601 bp, Human
tgtaactttgccccagccactttgccccaacccctttgccccaaccttgagctcacaaaaacatgtgttgtatggaatgaaggtgttttttttttttttttttgagatggagtctcgctctgtcgcccaggctggagtgcagtggcgccatctcggctcactgcaagctccgcctcctgggttcatgccattctcctgcctcagcctcccgagtagctgggactataggcgcccaccaccacacctggctaattttttgtatttttagtagagacggggtttcaccgtgttagccaggatkgtctcaatctcctgacctcatgattcgcctgcctcggcctcccaaagtgctgagattacaggcgtgagccaccacgcccggccttggaatcaaggtttaaggtctagggctgtgcaggacgtgccttgttaacaaaatgtttacaggcagtatgcttggtaaaagtcatcgccattctctagtctcaataaaccaggggcacaatgcactgtggaaagctgcagggacctctgtcctggaaagccggatattgtccaaggtttctccccatgtgagagtctgaaatatggcctcgtggga

SEQ ID NO: 22817 - DNA, 601 bp, Human
atcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaayggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccattta

SEQ ID NO: 22818 - DNA, 601 bp, Human
acgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccrtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggt

SEQ ID NO: 22819 - DNA, 601 bp, Human
tggacctgggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatyatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaatggaatagactgagtagatgttctttcctctctcagtagtttgcaaactactgtgtagattgagtcttgtttttgagtacacatagtgatgcatgatgtgagccattaaaatttcatttcattctggatttcagcgagatgaagat

SEQ ID NO: 22820 - DNA, 601 bp, Human
atacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaartggagattgatttctcaacaagaaaatgagaggcaagtagtaaactttggagataatatcactagacagatcatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaatggaatagactgagtagatgttctttcctctctcagtagtttgcaaactactgtgtagattgagtcttgttttt

SEQ ID NO: 22821 - DNA, 601 bp, Human
gagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaaytaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatcatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaa

SEQ ID NO: 22822 - DNA, 601 bp, Human
ccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctrggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatcatttact

SEQ ID NO: 22823 - DNA, 601 bp, Human
cccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggaccygggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatcatttac

SEQ ID NO: 22824 - DNA, 601 bp, Human
ctggcccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttgracctgggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatcat

SEQ ID NO: 22825 - DNA, 601 bp, Human
agatgaattgtagctatactaggtaaaactttttaaaagaacagaaagatgtaatcagaataagactgatgtcagtttctccactggcataagaaactcaaatatctgaatttaatacattgggatatttgcttatcagaactgagaggtgaattagcccacagaagtacttctttctggcccacagcatgtattaaaaatttggggccaacattaaaaaaaaattaatgtcacataaaaattagtggtttgggcttctcttttaaaaatattgaaatatcgcctggtgcagtggctcackcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaattgaaagactaaggtaacaatt

SEQ ID NO: 22826 - DNA, 601 bp, Human
ttttatttttcagaaacttaagaaatcatttacaatctactgatcataatgggttttatttttagcctcccaagaatgagtccttggagacttacccagtgatgaagtataacccaaatgtccttcccgttcagtgcactggcaaggtaaagacaaatttagggttactggggtggtggaagggtaggcagaggaagaggggagaatgaagaagactgtttaagtgacaggtagaattttaatagaagaaataagaaacattgctttcaagtataagtctcagtgagatgaattgtagctrtactaggtaaaactttttaaaagaacagaaagatgtaatcagaataagactgatgtcagtttctccactggcataagaaactcaaatatctgaatttaatacattgggatatttgcttatcagaactgagaggtgaattagcccacagaagtacttctttctggcccacagcatgtattaaaaatttggggccaacattaaaaaaaaattaatgtcacataaaaattagtggtttgggcttctcttttaaaaatattgaaatatcgcctggtgcagtggctcacgcctgtaatcctagca

SEQ ID NO: 22827 - DNA, 601 bp, Human
tccttaaatggcagtctccccgactggagattaaaacaacaaaaaaggaaagcctacttgaagtcatgcttgagggaaaaggatgacattatttattcatgactcaggaggaaagcccacgctttataaaaacagaaatgtcaatcatctttctcatgtaatctaatcttagcaaataacgagcattatattttgggttgacttagttttcagtgtctttaagcaaagcttataatgggctactattaaaagttccatttagtactggtttgcatcacagcttaattgtagtcgttataamcttgggcacttattttcatttcaacaaaatcacaaacatgaccttaaattggttaggggagtcattcattctgctgtcctgatgtcttttgttattttggttgacttactgtgaccagtgtgtacttgtttggactacggagtagttttatttttcagaaacttaagaaatcatttacaatctactgatcataatgggttttatttttagcctcccaagaatgagtccttggagacttacccagtgatgaagtataacccaaatgtccttcccgttcagtgcactggcaaggtaaagaca

SEQ ID NO: 22828 - DNA, 601 bp, Human
ctgactttgattagactatgtatgtgttacatctcacatcaagactcacttgctgtgctgatctgagtaagcaagtgactgtcttccagcgaagtatgttcatcacacttctgagatagatttgagccatgggtgtagaagaggaggctctggatatttcatgacagcagtaattttcagactgtcctctgggtcccttcagtggattcaccccttcaagaccacccttcctcttagggcagtgacacctctgccttttttacatattggactttcctaagaaaattgcaaagaaacgctycttaaatggcagtctccccgactggagattaaaacaacaaaaaaggaaagcctacttgaagtcatgcttgagggaaaaggatgacattatttattcatgactcaggaggaaagcccacgctttataaaaacagaaatgtcaatcatctttctcatgtaatctaatcttagcaaataacgagcattatattttgggttgacttagttttcagtgtctttaagcaaagcttataatgggctactattaaaagttccatttagtactggtttgcatcacagcttaattgtagtcgttataaac

SEQ ID NO: 22829 - DNA, 601 bp, Human
gtaccttgcttttgacattactcatcgtagacactgaatgacatttggaccccacagaggcagtctagtctattgtgattgatttcttcccacatctttagagttacttggttcagtgataaattcagctactctttcttttcagtcctttttttcttttttctttggtctctacttggttatccattgccactgcctaattcatcacctccacccaaatctccaactattttggagttatttttgtcagagatcagagtatcccagcatctcactatcctcaccattggaggatagattytggcaacttcttagtgagcattttctctacatatttttaaagacaaatacattgctggcagaaacgtcccaaagagtcaaatctagacgatcattttcttgcatccaaaacagagtagtagcaaaatagtagttccttcctgatgtggaactaatattttatctgactttgattagactatgtatgtgttacatctcacatcaagactcacttgctgtgctgatctgagtaagcaagtgactgtcttccagcgaagtatgttcatcacacttctgagatagatttgagccatgggtgtag

SEQ ID NO: 22830 - DNA, 601 bp, Human
atggataaacattactctggatcactgaaaaatgagcaaattgccattgctcaccatttggtgagattatattctccataagaatggaaaatttatcgttgttgtctgcttttgtaaagctggtcatttcatcctctcctccagatcatgaattaatgctgtcctttccccttaagcctggcttcttctggcaggtttccccctaatcacccgtatatgagcgttggcattatgagtgttgtttctaattttgatagaaattgactgcagtatattgagttatgtgaacaaactcatttcrtttctgaaatctggcacttttgttcattaattttctattgaatgctattaatttatttctacaatgcttgttacccatgaataatattttcaaaagaaaatcaacacagagataaaaagttttgttaactgaaggatgcatcaaagttcctttattgccatcagaggcaaaaatgagtaggtggggatggatggttgcctggctggctagtttgatggactgctggcagaaattaatgtacctctcaaaaggattttaagcttctttccacatagacaggatataatggaagaaaaacgg

SEQ ID NO: 22831 - DNA, 601 bp, Human
agctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaaattttaacccacttgcatgtatagtccagttttggtcctctggaagccacaggaacatttcaaaaaaattgataatctgaaaaaatattttttctgaattttattgcgraagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgtaaagctggtcatttcatcctctcctccagatcatgaattaatgctgtcctttccccttaagcctggcttcttctggcaggtttccccctaatcacccgtatatgagcgtt

SEQ ID NO: 22832 - DNA, 601 bp, Human
gagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaaattttaacccacttgcatgtatagtccagttttggtcctctggaagccacaggaacatttcaaaaaaattgataatctgaaaaaatattttttctgaatyttattgcggaagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgtaaagctggtcatttcatcctctcctccagatcatgaattaatgctgtcctttccccttaagcctggcttcttctggcaggtttccccctaatcacccgtat

SEQ ID NO: 22833 - DNA, 601 bp, Human
gaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaawttttaacccacttgcatgtatagtccagttttggtcctctggaagccacaggaacatttcaaaaaaattgataatctgaaaaaatattttttctgaattttattgcggaagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgtaa

SEQ ID NO: 22834 - DNA, 601 bp, Human
tgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaawattttaacccacttgcatgtatagtccagttttggtcctctggaagccacaggaacatttcaaaaaaattgataatctgaaaaaatattttttctgaattttattgcggaagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgta

SEQ ID NO: 22835 - DNA, 601 bp, Human
cacgcctgtagtcccagctactcaggatgctgaggtgggaggatctttagagcccaggaggttgaggctgcagtgggccatgatcatgctgccgcactccaacctaggccacggagtgagaccctgtctcaaaaaaacccttaagtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcaygcagtgtgatccgtctcctttcagtcttctaaatagctgagtaatccattatttaaaagaagggaaatattgccagagactaaatattacgtgctgatcaagtactatgaagctttggtgtggggccatataccagctattccttttggtaaaatatcttttaatatgagtgaagaggtgagagatggttttcctggagatcttgcttaattcagatcatgcattaaatgcagaatagcgtactctcagaataggtaactatgacaaggaagacagtttctttttcttagaactgctaag

SEQ ID NO: 22836 - DNA, 601 bp, Human
acacgcctgtagtcccagctactcaggatgctgaggtgggaggatctttagagcccaggaggttgaggctgcagtgggccatgatcatgctgccgcactccaacctaggccacggagtgagaccctgtctcaaaaaaacccttaagtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcrcgcagtgtgatccgtctcctttcagtcttctaaatagctgagtaatccattatttaaaagaagggaaatattgccagagactaaatattacgtgctgatcaagtactatgaagctttggtgtggggccatataccagctattccttttggtaaaatatcttttaatatgagtgaagaggtgagagatggttttcctggagatcttgcttaattcagatcatgcattaaatgcagaatagcgtactctcagaataggtaactatgacaaggaagacagtttctttttcttagaactgctaa

SEQ ID NO: 22837 - DNA, 601 bp, Human
cgttttggataaggaaatgacttatgaagggtaaagagaggctcttagtttcattaagtcattgacatgaatacatgtcctcactcttactacctggactgtgaattttccagtccatgttctcattctttccacaaaaaaatactctcgctgggtgcagtggctcatgcctgtaatccttgcactttgggaggctgaggagggaggattgcttgagcctaggagttcgagaccaacctgggcaacacagtgagaccccatctctacaaaaaataagacaagttagctgggtgtggtgttrtgtgcccgtggtcccagctacttgggaggctgaagtgggaggatcacttgagcctgggaggtcgaggctgcaataagccatgatcacgccacagcactccagcctgggcaccagtgtgagaccctgtctcaaaaacgttaaaacaaacaaacaaacataaaacatctctctgagttttactaggtaatatcatcccttctgattcaattcaagcatttaccaactccagttctttataaggcaggctgtggcttggtcagagtatggggcgaattgccattttaagttattttggaaata

SEQ ID NO: 22838 - DNA, 601 bp, Human
ttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcctgaaataatgaaagattgaactctggccatatttagacactttttttaaaaaaagcaggaagacacaatgaaaaacagtacagcytcaagtatgactgttttctgcattggaaaggtgtcttactttaaaacactcctaggtactattttttactattcagagccaagacagcaattccggttttctttctcttacatccgttgaaaagtacagctacttatttccttatcttcccccaaaaagttctccctatagaagagtgcacagggccttctctcatcagaaagaccttttggtgtgattagctatcactgcactggcattcatgaaggaggatgtatggtcagggtatacttttattgatcctggttgggatagataatg

SEQ ID NO: 22839 - DNA, 601 bp, Human
ggagaaacagcagagcttggattgtagtatttaaatgtcaagggatatgcaagcaaagaaaacataggtctctaagggagtatactgtcatattttaaattcattgcataagcatccaaacatagctctagattttattggtgatcttcatgattttttttataattttgagaataaaaaatatggatactttttttaaaatttagggaataaaaaaatataaggatcctagttctagctgaacattcctcctacccttaaccacctcccatacacactgcaagtggagggctgcccagcytctcgattttcaccctgtgtcagtggggtgaggtgcactcttgacgttggacaaggaagaaatcatgggaccgggggaaccaggaaggaagcttgttcatccgtgggaagattaaactttcattctgagcatatgactgcatcacagctttttgtttctgttcttcttgcagttaagatccttctattctacgtaatattttatggctgcctggctggcatcttcatcggaaccatccaagtgatgctgctcaccatcagtgaatttaagcccacatatcaggaccgagtggccccgcca

SEQ ID NO: 22840 - DNA, 601 bp, Human
aggtctacacagacagttgtggatcagtcagtaggttgggttgattatggtgaagggaatataaacgcagagcagctgatcttaaaatattttgtgcagcctgttgcttggttggatagacttttttccatcgaaaattagatttcttgttttcagcctctccggaaaggtgactttttttttttttaaaaaaaggtcattttgaagggcagagttgtaggcgaatctatgagtcgtgactgcgtgagggaaggagggagggaactccccctgctgcatcactgccccctcctcctccaaaatcattcatcatcatcatcatcatcatgaccatcaccaccaacaccactggcaccaccactgcagtcattcagggagtcctgaacagaggccgattggtgttcctgcttgggaggatctgtgggaatcggcaggagaatgagtcagggaaatagtgcttagctgacattttgaaatggaagaagctggaatatatgaatttttgtaaagaaaaaaaaatgcagcctgtgagtctctcttgattgaaaattaaagggttaataatgcatcacacttcaaggttagtcaaggtgaagcgtct

SEQ ID NO: 22841 - DNA, 601 bp, Human
ccctccatgacctcccctggagtcatcaccacccagaaatggttcaataagctccatttcaggactccgattcttagctttggcccgaaacctggcaaagtctggttgttttcaaggtctacacagacagttgtggatcagtcagtaggttgggttgattatggtgaagggaatataaacgcagagcagctgatcttaaaatattttgtgcagcctgttgcttggttggatagacttttttccatcgaaaattagatttcttgttttcagcctctccggaaaggtgacttttttttttttwaaaaaaaggtcattttgaagggcagagttgtaggcgaatctatgagtcgtgactgcgtgagggaaggagggagggaactccccctgctgcatcactgccccctcctcctccaacatcattcatcatcatcatcatcatcatgaccatcaccaccaacaccactggcaccaccactgcagtcattcagggagtcctgaacagaggccgattggtgttcctgcttgggaggatctgtgggaatcggcaggagaatgagtcagggaaatagtgcttagctgacattttgaaatggaagaagct

SEQ ID NO: 22842 - DNA, 601 bp, Human
atcccaccaagggaaggctgtgggagattctgcctttcctccctgcctctgcccagggtgctgggtgtgaactgagggtggggtgactgttgaaggttctaacaagccgtctctgagagatttgtagctaggctagtgttaggtctttcatttcaggaactgtgttcaaagtttggcttctgaagggcaccaggagagagatgttgctattcaaatctgagggtccagtctctgcggggtggtatgagggtttgcttgtgaatggtggccagtacccgctttaaaaggcaccatgctagcwcagctttaagcatgagtacgaatgcagaggtaacagatgtgtgccttgtcaggactatgcatggttgagaagttggaaatgtaattggaggcaaaataacagacctccacaaggtcgggcttcactgtgccctaggaccaggagggggctgggagtcatggctagaagccagacacaactgcctgtttccagtttgtctcattttgcctccagaggaaggctctaagacatccctgtggctctgtgatcagtcccagtgcagaacttcagagtgggtagaggggtgtgtggggatagttg

SEQ ID NO: 22843 - DNA, 601 bp, Human
tcttatagatacccccaacttctgcctttgttggctgtaggcttgatgattcgccccaagactgagaaccttgatgtcattgtcaatgtcagtgacactgaaagctgggaccagcatgttcagaagctcaacaagttcttggagcgtgagtgtgggcctggttatgtgtcagttcaagacttcgggcaggggactggggaccttggaagtggaacatctggcccctgagtctctccctcccacctctttagcttacaacgactctatccaagcccaaaagaatgatgtctgccgccctggrcgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtatctatgaccttggtccccagggtgaatggaggaaggatctggggacaccacctgcagacaattgcatcctttcactggggctaatgggcatgagaaagacttggatgtttgtgtagctgagagaaaaagagaggtgggact

SEQ ID NO: 22844 - DNA, 601 bp, Human
gaacatctggcccctgagtctctccctcccacctctttagcttacaacgactctatccaagcccaaaagaatgatgtctgccgccctgggcgctattacgaacagccagataatggagtcctcaactaccccaaacgtgcctgccaattcaaccggacccagctgggcaactgctccggcattggggactccacccactatggttacagcactgggcagccctgtgtcttcatcaagatgaaccgggtatctatgaccttggtccccagggtgaatggaggaaggatctggggacaccacytgcagacaattgcatcctttcactggggctaatgggcatgagaaagacttggatgtttgtgtagctgagagaaaaagagaggtgggactcttggaggctaagctctgcagttagaaggctggatgccttttgttttttttttagacagggtcttgctatgttgcccaggctggccttgaactcctggaattaagctatcctcccgcctcaacctccctagtagttgggactacagtccccggcttagcttggtctggatgcccatcttcgacaacttcttcctctgactctcttcacctt

SEQ ID NO: 22845 - DNA, 601 bp, Human
gaataattggggcgaaggaagaacaaaagaacaaatggaagtctggtgagctcctgggtgcctgccatccctaactggctcaccccctatcttcctgcacccccacagcgagatgaagatgctgagaatctcggcaacttcgtcatgttccccgccaacggcaacatcgacctcatgtacttcccctactatggcaaaaagttccacgtaagtcccaggggaggcccaggctgatggcgggtgcgggtggtgagctagggaaggaggccgcgttgccccaggcctagaccctgcactgctyctccggcccaggtgaactacacacagcccctggtggctgtgaagttcctgaatgtgacccccaacgtggaggtgaatgtagaatgtcgcatcaacgccgccaacatcgccacagacgatgagcgagacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcc

SEQ ID NO: 22846 - DNA, 601 bp, Human
agacaagttcgccggccgcgtggccttcaaactccgcatcaacaaaacctgaggccccttcctcccaccccatctctctcctgtggatgctcctggaatgtccctgaccctgcctgatccctccctcacccaccccaaaggtatttttgataacagagctatgacttgtctgagcctcacatccttttccttgacttctcaacccagcctgaagtccattgcggttccgtcactcgcctttcccaccaacttctcccaacctcagatcagtcagacagggagctgggctaagatggccacrgaggagttaggagcctttctagttctggtttagctgtgagagctatccactctcctgcctgcatatcccctgagagttataggaagtgcccactgacccacccacccacctacaccccccgccacacacacacacaaacgtgcacacgcgtctcatttgacccctttgcttccagagatgaatgtggcactccctccttccattcctaagctctagccaccgtcccttgatctctcatactttctccctgtctacacagtcgccatcttggtgactttgaatttatctggctcctgggca

SEQ ID NO: 22847 - DNA, 601 bp, Human
ttgctggcacgttctgcttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttcttttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagc

SEQ ID NO: 22848 - DNA, 601 bp, Human
cttctcaccctctggtgactctgtgagctgggaaatgagggactggaagtgaggcctgtgttgacccttcctgaaaatcctctagcagcccccgacttcagcagtttctttctttgtttttttgagatggagtttcgctcttgttgcccaggctggagtgcaatggtgcaatctcagctcactgcaacttccgcatcccaggttcaagcgattctcccgcctcaggttcccgagtagctgggactacaggcatgtgccaccatgcccggctaatttctttctttcttttttttttttttttgcattttttagtagagatgggggtttctccttgttggtcaggctggtctcgaactcccgacctcaggtgatccacctgcctcggcctcccaaagtgttgggattacaggcgtgagccaccgcgcccggccttcagtttcttcctaggccgttctgtcacccaaatagctgctacccagaggggcggggttgacctaggctgaatatccactttgtttttatggatggctcccttcccccattcgccttcccagaatatccttcaagttccacttcccagggagctctgggggaggggcgg

SEQ ID NO: 22849 - DNA, 601 bp, Human
cacccaagcagtatatactgaacccagggtttcctcatctttaaaatgggcattaccatggcagctacctcagggggttgtcagggcgacatctcagcccagggcttagcacactgtaagtgctcaaaaatgctcactaaagtgattactgtcaccagtccaacccttgtgcatttcacacagggaaaacggggctgaggcctggctcggccaccctttggctgtgttggctatgggtggggccctgccccttggacctcggtttcttcccctgggaggagaggattatttgtgtgagccrtgagtgccccccagcgtggatgcggtggccaggtgtgcggggcggttcgtgggtctgaggcccatcttaccttcgttgccctcgccgggcgggtggtagaaggacagccccagggagatgatggcggcaatctccaggatgatgagcgtcacgtcctgcagcgcctcccacacgagctgcaggaaggtttttggcttctttggaggtataaagttttgcccaaaaatttgctttctcttttccaggtctggagcggtgcccggcaaacctgtggacagagaacagagaggttggctgggg

SEQ ID NO: 22850 - DNA, 601 bp, Human
atatcctactgactgaaaaagcagattataaaacagatcagcctgcacagatgtcagggtcgccctcacctgtgtgcttattaaaatccagccatccctggactctggagagaaagaaccaggctctcttaggatggggcctgacaacgatgttttcaaaaggctccacagcaaaatctgaggactctttattagctggtgacctcgagcagattaacccccttttctgtgccttggtttcctcatcttttttttatattttttatttccataggtttttggggaacaggtggtacttagytacatgagtaagttctttagtggtgatttgtgggaatttggtacacccatcacccaagcagtatatactgaacccagggtttcctcatctttaaaatgggcattaccatggcagctacctcagggggttgtcagggcgacatctcagcccagggcttagcacactgtaagtgctcaaaaatgctcactaaagtgattactgtcaccagtccaacccttgtgcatttcacacagggaaaacggggctgaggcctggctcggccaccctttggctgtgttggctatgggtggggccctgccc

SEQ ID NO: 22851 - DNA, 601 bp, Human
gctttctgtttgaccgcatcctgtgagatgtatctcttgtatctttaaaccctctatgggaagaggtcatgtaagaaatcaacttattatgtgtaaaattgaggtagttggcctaatagacttggttattcagtttcttgggcaactttggcttgggagggggcaggacaacagatattcaagggacctcagagaccaccttcttatttagggaaaatgaggcccataatgttatttcttatgtgctattaacttttaatttgcttgtctgaaggtgtagtagggttatctatttatgcarcacattcattaggaaatgttgaatcacaatgaatcacaaaaaagtatttacaatatcctactgactgaaaaagcagattataaaacagatcagcctgcacagatgtcagggtcgccctcacctgtgtgcttattaaaatccagccatccctggactctggagagaaagaaccaggctctcttaggatggggcctgacaacgatgttttcaaaaggctccacagcaaaatctgaggactctttattagctggtgacctcgagcagattaacccccttttctgtgccttggtttcctcatct

SEQ ID NO: 22852 - DNA, 601 bp, Human
tgtcatcttcctaaatatttttcctccttgttgataatttgagctatgcaaatctaccttttagtttttaattttatttttcattttaaaatttttgttttattattattattttttaaattcagtactctttagtatattccagcaaatcaccctaattccctttctgtcttggctgccaggaacctcaagtcagatttaaatctcaatcatggcagcaattacagctggtttctttgcttccattccttttctggctggctttctgtttgaccgcatcctgtgagatgtatctcttgtrtctttaaaccctctatgggaagaggtcatgtaagaaatcaacttattatgtgtaaaattgaggtagttggcctaatagacttggttattcagtttcttgggcaactttggcttgggagggggcaggacaacagatattcaagggacctcagagaccaccttcttatttagggaaaatgaggcccataatgttatttcttatgtgctattaacttttaatttgcttgtctgaaggtgtagtagggttatctatttatgcagcacattcattaggaaatgttgaatcacaatgaatcacaaa

SEQ ID NO: 22853 - DNA, 601 bp, Human
ccttctgtagaacttcctgagtctgttctgtgcacagggctgcccgccctctcagaagcaaggctctctgcctggctcaggccttaactcctggatctttagacctggggcggaggcgggcagtggacctctgaggactcaacatggcaggggctggaggcaagagtgacaggtgctggggctttggaacctgtggctctaatatgctcacactgtccacccctgcgttgctgtagaggatactagaattgtggggtgttgaacgtggccacttttccagaaaccaggagcgatcggccaygtggggagtgacacctgcttcctgaggtttgctcagggctccatgataagcgctttgcattatttccttcaatcatcacaagatctccacagggcaagtgctatcattcacccccttttatggatgaagacactgaagctgagcacatggagggccggcctgggtccagggccagacaggcagatccaggccctgtgcctaggctctgatcactggactctggtgccttccaagatgtggcagctgttgtcaaaaagaaattgggtgcatttcatgatttcaaacaaaactcactagcac

SEQ ID NO: 22854 - DNA, 601 bp, Human
atggtgaacctgcctcccagatggctaccagggcctggtatccaacaaagatcctcaaaactggttgagccataaacattttctaaacacctactatgtgcctatcactcttttggcactctggcactgggggagctgtcaccagcagggggttaggggcactgagtgtgccaatcctagccctgccatgaacatgctgtgtgacctaggacaagtgcctagaggtctctgagccaggtaatccttcatgtacaaaatgatgttggtagaggactaacaggctgcagagttctgcagcacycatagccctgccccaactgctttctcagtgatgagtatgagataagaccttcccaaggttacacaccaggaagtgatatagccaggactcaaacgagggctcctggctttaagtttggggatgcttttataccccctcactcctgttcatcagggggcatccagcccaggctggcccagcttggcccagtggttttagggaaaagaatgagatgaagtgtggggcagagccccaggagttaggcattaggtaaaactagacactgtgtacagatagcaacagtgtcacggctggacaagg

SEQ ID NO: 22855 - DNA, 601 bp, Human
agcaattagggagaagagaataggaaggggagggaagaggggagtgggtgggtcctgctgaggtctcctctggggctcccttggactggggcagggacaggatctggagacagtggccatagggtccagggaactgcaactgctcttcctggacctgcggctatagagggtgtggcctctccctgtctgtgtaagcttggggaatccgcttggcctcttcgggcctgtctgcatgttcaccagtacaatggtgaacctgcctcccagatggctaccagggcctggtatccaacaaagatcytcaaaactggttgagccataaacattttctaaacacctactatgtgcctatcactcttttggcactctggcactgggggagctgtcaccagcagggggttaggggcactgagtgtgccaatcctagccctgccatgaacatgctgtgtgacctaggacaagtgcctagaggtctctgagccaggtaatccttcatgtacaaaatgatgttggtagaggactaacaggctgcagagttctgcagcacccatagccctgccccaactgctttctcagtgatgagtatgagataagaccttcc

SEQ ID NO: 22856 - DNA, 601 bp, Human
ctggcacatgatagatacatggtaaaagttagacctctccccttttcatgagcttttttccttggactggcctctgaaagccaagggcacagtgactgagtgggatatgcaccctattccaactcccagccctacctgctgcccttgctgactcaataccaaggaaccctctgggccttggagggcactcactctgccagcaaaagccgattagctattgtctccagagaactgtctgctcgtcacgcggtgccaagggatgactagaaagtgggagtgcagatcgctggggtagggattyggccacctggaagctgtccgaccctaggaacaactcctgctgcccctggagcaattagggagaagagaataggaaggggagggaagaggggagtgggtgggtcctgctgaggtctcctctggggctcccttggactggggcagggacaggatctggagacagtggccatagggtccagggaactgcaactgctcttcctggacctgcggctatagagggtgtggcctctccctgtctgtgtaagcttggggaatccgcttggcctcttcgggcctgtctgcatgttcaccagtacaatgg

SEQ ID NO: 22857 - DNA, 601 bp, Human
attagagcagttactggagcatttggacacttagagcaatgacaagctttcgggttctggaatcggaaagacctagttcaagtccaacctctgctgtgtgactttaggtaagtgacttggcctctctgagcctcagattagacagctgtgaagtgggataacccaacggatttgtgagctaagggcctggcacatgatagatacatggtaaaagttagacctctccccttttcatgagcttttttccttggactggcctctgaaagccaagggcacagtgactgagtgggatatgcacccyattccaactcccagccctacctgctgcccttgctgactcaataccaaggaaccctctgggccttggagggcactcactctgccagcaaaagccgattagctattgtctccagagaactgtctgctcgtcacgcggtgccaagggatgactagaaagtgggagtgcagatcgctggggtagggattcggccacctggaagctgtccgaccctaggaacaactcctgctgcccctggagcaattagggagaagagaataggaaggggagggaagaggggagtgggtgggtcctgctgaggtc

SEQ ID NO: 22858 - DNA, 601 bp, Human
gggggaaggagtgggattacagagccccatgctgcattttacaagacttttgttatcccctgccccttgctatgtgctctggaaatgggaaggctgttatttcccctgctgtgtgcttcctcaatggggcccccattagagcagttactggagcatttggacacttagagcaatgacaagctttcgggttctggaatcggaaagacctagttcaagtccaacctctgctgtgtgactttaggtaagtgacttggcctctctgagcctcagattagacagctgtgaagtgggataacccaayggatttgtgagctaagggcctggcacatgatagatacatggtaaaagttagacctctccccttttcatgagcttttttccttggactggcctctgaaagccaagggcacagtgactgagtgggatatgcaccctattccaactcccagccctacctgctgcccttgctgactcaataccaaggaaccctctgggccttggagggcactcactctgccagcaaaagccgattagctattgtctccagagaactgtctgctcgtcacgcggtgccaagggatgactagaaagtgggagtgca

SEQ ID NO: 22859 - DNA, 601 bp, Human
tagctgtgagatcttgggcaaatgactccctttctgaaactcattttttctcatctgggtaagaatattctctatctcggggacctattgtcagagttgaaatttaatgtggtaaagttcacagactctacagcacagacaaggcacagaggagagaaaagagaattttctctaattgatgagaaaagacaaggaattttctctaattcatgagaaaagagagtaagtgaggtatttttctttttttccagaacaaaggcagccaatattacacttgctttagggtctgaaaaggcagtttgccgctgtcctcttcttctgttggagtctcattacattgcccaggcaggttgggaagatgagctggttctaatcctgctgctgcctctgcatgattttgggtaagtcattgcccttccccggcttcagtggcctcatctgcaaaatagggatcactgagaccaccttccaggactcagggagaggaaggtggaagctcctggccagagctcagcacacaggaggttctctaactccgtccttgtcagacgtcagctgaggagtgagccgccctccacagtgaggacactgaggcttgagc

SEQ ID NO: 22860 - DNA, 601 bp, Human
acccaggcagtctggcttcagagcccaccatcttagccccttcagttttctgccttggttctagctgtgagatcttgggcaaatgactccctttctgaaactcattttttctcatctgggtaagaatattctctatctcggggacctattgtcagagttgaaatttaatgtggtaaagttcacagactctacagcacagacaaggcacagaggagagaaaagagaattttctctaattgatgagaaaagacaaggaattttctctaattcatgagaaaagagagtaagtgaggtatttttytttttttccagaacaaaggcagccaatattacacttgctttagggtctgaaaaggcagtttgccgctgtcctcttcttctgttggagtctcattacattgcccaggcaggttgggaagatgagctggttctaatcctgctgctgcctctgcatgattttgggtaagtcattgcccttccccggcttcagtggcctcatctgcaaaatagggatcactgagaccaccttccaggactcagggagaggaaggtggaagctcctggccagagctcagcacacaggaggttctctaactccgtc

SEQ ID NO: 22861 - DNA, 601 bp, Human
ggaagtttggagagtggtagcacatgtgccatgtacttgtcatttctgatttaaatggattctgggattgtaccccctccaggaagtacccttccacctcctaaaggatctcagaagacatcttggtttgggatcagccttcaggaatgcatccccttccttgagccaatctctttgcatcagcctggcctgtcccacctctgccggaatccagctttagaacctggctctgtggctgggacacttaccatatttgacctgggctatgtccccaaccacgatctcagccacagggatctgsaccacctggccagcccggaccacggtaaatttctgttcctgctcgatgcggctctgcaggccccggaactgtttctctttgctccagtcattgaaggccgtgaccaggaccacacagataactgagaggagaatggcggccccctcgatccaacctgcctctgcctctccttcatcctctgccccaccctgggccgtcgcacatcctgaaagaccagatagaagcaggcagagtgaggtcaaccagacaggagaggcctcatgggcctggatttacagctcagctctgcaaagtaacaag

SEQ ID NO: 22862 - DNA, 601 bp, Human
gcaggctctcaggtgactagagggctggaacattcccttaaaggtgcgattaccagggaaggtttgccatcagggacagaatgcctagagctcccagggtgtaggaaccaagatggtgcccatagaaggcccatgtacagctcaacactggagctaaggtacacagcacaaggcctggagggctgaggttggggccctgcaaccctcgctcaagtgggcatgtactttacaaagtgtttctcttgacctcgcctgaacttggagtgcaggtctcccaacaattcgttcttctgtagtctcmgttatggtttaggggaaatattttggaaggaaccagtctctcttggctaggtttagaagaccgcaaccaagtcacatcgtcaaggggatgtgtgccttttagggcagagtgaggaggggcactccaatctctcccctaccttctgcctcaccttacctaggacatatctggctcaaactccctttggtgccagcctgcccgttttctccatggcagtagcacaggcccagaatattcacttatccacctacacactttctaacatctcctctagcccaacaagcatccattaacagtcaa

SEQ ID NO: 22863 - DNA, 601 bp, Human
agctttcatcaatcttgaggtcattgccctggatgaagaggccgtcggcagggaggaggtcacctggcaagaggaagggcaggggagtcagcaggctctcaggtgactagagggctggaacattcccttaaaggtgcgattaccagggaaggtttgccatcagggacagaatgcctagagctcccagggtgtaggaaccaagatggtgcccatagaaggcccatgtacagctcaacactggagctaaggtacacagcacaaggcctggagggctgaggttggggccctgcaaccctcgctyaagtgggcatgtactttacaaagtgtttctcttgacctcgcctgaacttggagtgcaggtctcccaacaattcgttcttctgtagtctcagttatggtttaggggaaatattttggaaggaaccagtctctcttggctaggtttagaagaccgcaaccaagtcacatcgtcaaggggatgtgtgccttttagggcagagtgaggaggggcactccaatctctcccctaccttctgcctcaccttacctaggacatatctggctcaaactccctttggtgccagcctgcccgttttctcca

SEQ ID NO: 22864 - DNA, 601 bp, Human
ggcccaacatcaggctgaagctcacctgacagcagcatggggtccttgtccacggacttgcgcacctggtcagactctccagttagggagctttcatcaatcttgaggtcattgccctggatgaagaggccgtcggcagggaggaggtcacctggcaagaggaagggcaggggagtcagcaggctctcaggtgactagagggctggaacattcccttaaaggtgcgattaccagggaaggtttgccatcagggacagaatgcctagagctcccagggtgtaggaaccaagatggtgcccawagaaggcccatgtacagctcaacactggagctaaggtacacagcacaaggcctggagggctgaggttggggccctgcaaccctcgctcaagtgggcatgtactttacaaagtgtttctcttgacctcgcctgaacttggagtgcaggtctcccaacaattcgttcttctgtagtctcagttatggtttaggggaaatattttggaaggaaccagtctctcttggctaggtttagaagaccgcaaccaagtcacatcgtcaaggggatgtgtgccttttagggcagagtgaggaggggcac

SEQ ID NO: 22865 - DNA, 601 bp, Human
atctgtcctctcatttcccttctggggttctagaagttctgaatgtcacagatcctccctttgtgcttgaggaaggagacaaaagactgaaaatgtgaaaggggggctatctttgagatcaagtgtggggacaggtaaggagtcagctgtgctgggaccagaagcctgggcctttggatttgggcctggcctgaagagacttgagctttttgtttgagcatctttccctctgttctgagagacagttttagcctgggtggtcagctcgctgcattgaggagagcccagtgaataaggaatyttattttcaaggaggaggaagaatcagaactcagacaagatggtaggtctgggagcactggagagtaaactcataatggttgatttggagccatgcatctggctacctttcccagaatctcctctgcccatgtcttggatgaatctatgctgggtggattttcatttctgctcagtggagttgacaatattggaaggaatatgcttccaatgggtggggatttctactcaatactggagtgatgatgggaccaattgatgctggctgtttccaccacttgaggctggagactcaacaaca

SEQ ID NO: 22866 - DNA, 601 bp, Human
ggggagagcagggcctgaggggagggtcctatgatggtgagcaagctttgcatgctggtacgcagggctaagggtggtgtagagatgggggtggtaccacttggcattggctggtagggtgaggcactgtaagggcaagagggtggagtggggtgttggcttgtcccacagggctggcatcacaggagggcacaaaggagggtctggggggtggagccacccacaggcatgtggcctcctccagctgtgtgctggtggtctaggggcagggcccaatgaccaaagcctgctgctatttctraaagcccatctaccctgagggtgtcttactgtacctggtagctgaaggccatcccccttcttcacacctgtgtgatgatttttgagacatgttaatgaaggagaagcacacagcctcatctgcccatgcgcacgcgcacacacacaaacacacatgtgcatacacacatggccatacacctagggtcatcctgaaatggggacatgtggcgggctctaagcaatgttcctagtggaggtgatgggatgggagggcagagggggcccagctgaggccatgctgctcatggtggcctgagat

SEQ ID NO: 22867 - DNA, 601 bp, Human
ttggggtgggggtgagagacgcccatccaaccatgaccaggagctcgccgtgggagacataccattgactaggctggcattcgcactatctgcagcatttgaagctgccgcaccgtctgctgctgcaggggggtgggagggatggaaaatgcagtgtcacaatggagaaaagcaacaacgacaaagacatgaaccaacttgtggggagataacatgactctattcttaaaaaaaaaaattatcctttggaaaccaagaaactcaaatttggggtgggggtgaaatgttccatagagatgcygcagaggttgaggggagaaactcagacatggagggtctttcaaataaagcatggtggatgaccagggtggttagctgggatggtgctggtctgtgctgaggtctggaccctgctggtccaaccagtcaagagagtcccctggaagagagggctccatgaaatgaggagatctggctgcccattgggggccaggagtggaaaaatattcactaggcagtgcagcgtgggcacggaccactcagaatgagtattctccatgaccaccatctctgtgcatcagggtgttctggaagaacattt

SEQ ID NO: 22868 - DNA, 601 bp, Human
gcaggaatgaataacaacaattatttttattttctaaaataattttactgactgggctcaggggcaccaggggactccacttcaatagttggttttagaaggctcaaaggggcctttatttgcattgcatattatcagatgcaatagccggtgtgtgcactcattaagcccagctagcactttcctcttttatttccagagtgaacacgtgatcagaaaaataatcaccaatgcatatgctggaggaagggaaggatgttctgggagtgctgaggcacagatggcctggtttctcagaagygagggacttatttggggctctcctggccaaactggtgctcgcctggccctgaactatggtggaacagccagctttggccccatgtgggatctggagatgggctgtatttcaggagagctaggaatggggtccaagactgagccctcaggtggggtctcagaggcccttctctgtatctggagtcagatgcaccttttccaaatgggtctattctctctgtgcatcacaaagggcatgggtgtgaagtgcatggattgggaggattcctggtaagctgacctgatacacaagctctgggga

SEQ ID NO: 22869 - DNA, 601 bp, Human
ctgaatttaggagcatcctcggaatagccccatggctgcaggattagttcatcactgtcactgtgcccactttctgggtgactcagaggggagaagtggcttccccgaacctcgcccagcactgtctgttcaagggtaagtgcagagctgtccccatggcctcccatggcaaaggatcagttgcccatcctgggctttaaagtgaaagaccccctgtgtctctactgtaaaattctttctactggattaaaaaacacaagagaaaaaagctttttagagtaagcaggaatgaataacaacrattatttttattttctaaaataattttactgactgggctcaggggcaccaggggactccacttcaatagttggttttagaaggctcaaaggggcctttatttgcattgcatattatcagatgcaatagccggtgtgtgcactcattaagcccagctagcactttcctcttttatttccagagtgaacacgtgatcagaaaaataatcaccaatgcatatgctggaggaagggaaggatgttctgggagtgctgaggcacagatggcctggtttctcagaagcgagggacttatttggggc

SEQ ID NO: 22870 - DNA, 601 bp, Human
ctgcaaggtggggcaggagggattttcatcactctcattttatagatggggaaactgaggccaagggaagttcagaggcagcctgaatttaggagcatcctcggaatagccccatggctgcaggattagttcatcactgtcactgtgcccactttctgggtgactcagaggggagaagtggcttccccgaacctcgcccagcactgtctgttcaagggtaagtgcagagctgtccccatggcctcccatggcaaaggatcagttgcccatcctgggctttaaagtgaaagaccccctgtgkctctactgtaaaattctttctactggattaaaaaacacaagagaaaaaagctttttagagtaagcaggaatgaataacaacaattatttttattttctaaaataattttactgactgggctcaggggcaccaggggactccacttcaatagttggttttagaaggctcaaaggggcctttatttgcattgcatattatcagatgcaatagccggtgtgtgcactcattaagcccagctagcactttcctcttttatttccagagtgaacacgtgatcagaaaaataatcaccaatgcata

SEQ ID NO: 22871 - DNA, 601 bp, Human
aacaggatgagacattcacctcccagagtgtcccagttaccttcatcataatcacttgcacggttcagccttttgcagtttcaaagggcttttgcaagtgtcatctcttgtcagtcttcccagtatccctgcaaggtggggcaggagggattttcatcactctcattttatagatggggaaactgaggccaagggaagttcagaggcagcctgaatttaggagcatcctcggaatagccccatggctgcaggattagttcatcactgtcactgtgcccactttctgggtgactcagagggragaagtggcttccccgaacctcgcccagcactgtctgttcaagggtaagtgcagagctgtccccatggcctcccatggcaaaggatcagttgcccatcctgggctttaaagtgaaagaccccctgtgtctctactgtaaaattctttctactggattaaaaaacacaagagaaaaaagctttttagagtaagcaggaatgaataacaacaattatttttattttctaaaataattttactgactgggctcaggggcaccaggggactccacttcaatagttggttttagaaggctcaaag

SEQ ID NO: 22872 - DNA, 601 bp, Human
tccaggacagtccaccaccatgtgctgggcacacacataagctctgagattccatctaatcctcgccacagcctcacctatgaagggtgtgcttgtattatacccatttatggatgagaaactgaggctcagagagggagatgagctgcttgggtctcaatgggtaaatggagagctggccccaaagtgcgtgcctacttccgtcctgccattgcttctccagaagctgccgtcagggagaccatggacacccctcagcccctctgagcccaggggagggaagttgaggtggcactgctgsgacagggttcctgaagtcttcatttcaccaccaactagctgctggctttctatctcccaatctcatcaagcttccactttcataaaacaggatgagacattcacctcccagagtgtcccagttaccttcatcataatcacttgcacggttcagccttttgcagtttcaaagggcttttgcaagtgtcatctcttgtcagtcttcccagtatccctgcaaggtggggcaggagggattttcatcactctcattttatagatggggaaactgaggccaagggaagttcagaggcagcctgaa

SEQ ID NO: 22873 - DNA, 601 bp, Human
tctccaggggactcaggagggaggtttctgctggaatacttttggccttgagcgtgttacagatcaaagggaagtatcagagggtgcaggggattagagtctgctggaggaggcagcagagaagcactcaggcccccacaccaagctttttgtgaccgatttggtgttttctgggttgagagaaggcaaagggaagcttgttcagttacgtccttttcattttcccacaaaagaaaacatgcagtagagagaggggagagggggagagagagagaaagagagacagagagagaggagagaatgtttctagaatggagaggagtttggacaaggcactgaggtcaatgtgttccttagttttggccttcaagagggatgatctttctccttcacactctgaagagtgtgaagccacccaaggatgaccccttgcccaatgcccctgagagtgaccagaacaaagagtgatcaggggtccccatggtggtatacgagggacctcaagtgtggccgggttcttgatgaagtgctctggtccccaatgggggtgctgaccccttggtaggggtatggctcaggctacagcagcaggctaagtagt

SEQ ID NO: 22874 - DNA, 601 bp, Human
tgattctccaggggactcaggagggaggtttctgctggaatacttttggccttgagcgtgttacagatcaaagggaagtatcagagggtgcaggggattagagtctgctggaggaggcagcagagaagcactcaggcccccacaccaagctttttgtgaccgatttggtgttttctgggttgagagaaggcaaagggaagcttgttcagttacgtccttttcattttcccacaaaagaaaacatgcagtagagagaggggagagggggagagagagagaaagagagacagagagagaggagagagtgtttctagaatggagaggagtttggacaaggcactgaggtcaatgtgttccttagttttggccttcaagagggatgatctttctccttcacactctgaagagtgtgaagccacccaaggatgaccccttgcccaatgcccctgagagtgaccagaacaaagagtgatcaggggtccccatggtggtatacgagggacctcaagtgtggccgggttcttgatgaagtgctctggtccccaatgggggtgctgaccccttggtaggggtatggctcaggctacagcagcaggctaag

SEQ ID NO: 22875 - DNA, 601 bp, Human
tcttgattctccaggggactcaggagggaggtttctgctggaatacttttggccttgagcgtgttacagatcaaagggaagtatcagagggtgcaggggattagagtctgctggaggaggcagcagagaagcactcaggcccccacaccaagctttttgtgaccgatttggtgttttctgggttgagagaaggcaaagggaagcttgttcagttacgtccttttcattttcccacaaaagaaaacatgcagtagagagaggggagagggggagagagagagaaagagagacagagagagaagagagagtgtttctagaatggagaggagtttggacaaggcactgaggtcaatgtgttccttagttttggccttcaagagggatgatctttctccttcacactctgaagagtgtgaagccacccaaggatgaccccttgcccaatgcccctgagagtgaccagaacaaagagtgatcaggggtccccatggtggtatacgagggacctcaagtgtggccgggttcttgatgaagtgctctggtccccaatgggggtgctgaccccttggtaggggtatggctcaggctacagcagcaggct

SEQ ID NO: 22876 - DNA, 601 bp, Human
ggcgtccacattgccatcctgcattttacctacacgacaaagaattttaacagacaacagagaacagacaacacatggtcggtcatcacgaagacgcaacaggccacagacattaatgtcacagatgaagggcgggccgtgctgactgcatccctctgtgtggggatacgggttggggagggccctgaagcaggagcaggcctggccgcaccttagctgtggggcctgccagccgggcaactcttgattctccaggggactcaggagggaggtttctgctggaatacttttggccttgagygtgttacagatcaaagggaagtatcagagggtgcaggggattagagtctgctggaggaggcagcagagaagcactcaggcccccacaccaagctttttgtgaccgatttggtgttttctgggttgagagaaggcaaagggaagcttgttcagttacgtccttttcattttcccacaaaagaaaacatgcagtagagagaggggagagggggagagagagagaaagagagacagagagagaggagagagtgtttctagaatggagaggagtttggacaaggcactgaggtcaatgtgttcc

SEQ ID NO: 22877 - DNA, 601 bp, Human
cctgtaggagtggatgtgtctgcctctggcccttgccagtctctgtctctggtgtgactgtcagagccggtggggaggggcctcagggacgacaaacgccggttaaaacaaaagggttacctttgctctggctggcgtccacattgccatcctgcattttacctacacgacaaagaattttaacagacaacagagaacagacaacacatggtcggtcatcacgaagacgcaacaggccacagacattaatgtcacagatgaagggcgggccgtgctgactgcatccctctgtgtggggatrcgggttggggagggccctgaagcaggagcaggcctggccgcaccttagctgtggggcctgccagccgggcaactcttgattctccaggggactcaggagggaggtttctgctggaatacttttggccttgagcgtgttacagatcaaagggaagtatcagagggtgcaggggattagagtctgctggaggaggcagcagagaagcactcaggcccccacaccaagctttttgtgaccgatttggtgttttctgggttgagagaaggcaaagggaagcttgttcagttacgtccttttcat

SEQ ID NO: 22878 - DNA, 601 bp, Human
gcctcttcatgcaggatggactggagggcccgtgacccttttggacagagactgagccaaactccctacccctcaacctctaaggatctcaaagtcttcagctgaatggggcgcagagttcaaaggctagggagatgctggcccatgggtatccccctcctcaccggtggacacctctttatttggcctggcaccatgcaaatcacagctacacccccaaggtcgtcagacacctgtaggagtggatgtgtctgcctctggcccttgccagtctctgtctctggtgtgactgtcagagccrgtggggaggggcctcagggacgacaaacgccggttaaaacaaaagggttacctttgctctggctggcgtccacattgccatcctgcattttacctacacgacaaagaattttaacagacaacagagaacagacaacacatggtcggtcatcacgaagacgcaacaggccacagacattaatgtcacagatgaagggcgggccgtgctgactgcatccctctgtgtggggatacgggttggggagggccctgaagcaggagcaggcctggccgcaccttagctgtggggcctgccagccgg

SEQ ID NO: 22879 - DNA, 601 bp, Human
tgggtgctgtggtagagaaaggtgggcttcaggcactcattcaagccccccactttgcagatgaggtaactgaggccgagcatggggcagggctctgcctggggtccccctgtgagccctgtcccctgcctcccacctgctgcactcacccgccttcccgatctgcacagccagcttggtgagcttgccctgcagcacggacttctccttcttgtgcatgctggccttcttcctgtcgtcagcgtcgccgccctcggcactcttgaggggctgcatctccatggcggctgccccgtcctgytgtttggctgcagggggcagatcacgcacgtgcatacacacagacacatagacacacatgcaggtcagcccacagggtggagacgctggcacccacccctgcctgcccagggtaggtgctgactgcctggactgagccccgcatggctggtgcagaagtcctgtgatgggggcctgcctcttccagccggagctatggatcccagtggtactcgctgcctcagacctggaatctgggacacagcagggactgatgctgttaccctggatccccctctcggcctgaacaagcctgtgagtc

SEQ ID NO: 22880 - DNA, 601 bp, Human
cagagtctcctttaactcccacagcagtctgtgaagtggggacaactattatcctcattttacagatgaggatacagaggctcagagctagaagttactttcccaagttctcacagccattgccggacaagaaggcaggccgtctgctaccagagccttggatttgctcgagcttcactcttctgtatcactgagtgctaatggagtgccttctgtacacaggactcagactgggtgctgtggtagagaaaggtgggcttcaggcactcattcaagccccccactttgcagatgaggtaastgaggccgagcatggggcagggctctgcctggggtccccctgtgagccctgtcccctgcctcccacctgctgcactcacccgccttcccgatctgcacagccagcttggtgagcttgccctgcagcacggacttctccttcttgtgcatgctggccttcttcctgtcgtcagcgtcgccgccctcggcactcttgaggggctgcatctccatggcggctgccccgtcctgttgtttggctgcagggggcagatcacgcacgtgcatacacacagacacatagacacacatgcaggtcagc

SEQ ID NO: 22881 - DNA, 601 bp, Human
ccatagagtcttctgcctgtggcggtggcgatggcggtatagaggatagaggaaatccctgggcccatagctctccacccccacctccagctgcggagcctcagagccggctccatccctgtctgacagtcggaggggctggaagccaagctcccagctagccgggagctgtcaccaggcccccaagtttaaatttagacagccaagcctgtaatctgcttcccttccccatgctgtggtgtctataattagagctggggagacagccacaaaggatcgagcagccaggtgggaaggcctyggcatttgctacctccttacccgggaggggaagcctaggccgtgccagagggtcgggggctcactttgcagctgggccagcggggctgtcaccagccatcacctgcagttaccactttagttgggatgcccagtttgttgtgcgggggctcagaccatgggtttctccctgggctcttggcaatgtccttcaacctcttcagtttttcctctgcactgtggccagggtggtcatgataaagcccaaacccattcttgtcttcctctgctcaagtctcttccatggctcccactgtcctca

SEQ ID NO: 22882 - DNA, 601 bp, Human
atggatttgggttgctccagagctcccatgggatcgggagaggctgggagttctctggaaatctcagctgcccccggcttcttccctagcgtggacctgtgccccttgcaggtctcacctgagagcaccctgtcaatagatcccctgcctacccatctcagggaattcagccaaagagagaggcagagatgggctgtgaacccaggagtgcttgactgtgaactccattcttggcagggccgaggtgcaggagggagaggagtgaggactttgaaggccatggggttgttctcatcgcttmgttcccggccctgtcagtgccatgtttccatagagtcttctgcctgtggcggtggcgatggcggtatagaggatagaggaaatccctgggcccatagctctccacccccacctccagctgcggagcctcagagccggctccatccctgtctgacagtcggaggggctggaagccaagctcccagctagccgggagctgtcaccaggcccccaagtttaaatttagacagccaagcctgtaatctgcttcccttccccatgctgtggtgtctataattagagctggggagacagccacaaa

SEQ ID NO: 22883 - DNA, 601 bp, Human
cagtaaagaagacaagagttcctgcccttgaggagcagacattctagaggaggaggaagacaagaaacaaaaaaacgaatacatgaacaagacagtttcagatatggtgacacattgtgaagaaaaaggccaggatgatgtgatagaaagtgacatgggggacaggggtagggagtggttactttagctagggtggccagggaaggcttcttggaggaggtggtatttgagcagacaccagtcgcatggtgacctagggaagaacattccatgtagaggaaacagcaggtggcttttttttggatgaggaaactgaggctcagataggggaagtgacttgcttgcagccacaggcaagagaaatgctgtaacggtaggaacgcagctggggacccatcctgatcccctggggcttcctcttcagtttagcatgcccatcccccatctgctacaggtgctactgcaggtgctgcggagactgctcacacccgcagactctgacagaggaggagcctgctcaggtgactgggtccccttgttgggaagtgcctgggaatgcactcccatcttaacctgatggccaacatccagtggctgacgt

SEQ ID NO: 22884 - DNA, 601 bp, Human
cacatagtaggtgctcaagagatgtgtgccgagtgactgtgtgaataaaggaggaatggtttgcattgagctttcacacaataatgacgtgaagttggtatcatttatttattcatttattcgacaaataccttttgagcacctatgacacgccaggcacatcttagttcctagtttgggaactaggacacagcagtaaagaagacaagagttcctgcccttgaggagcagacattctagaggaggaggaagacaagaaacaaaaaaacgaatacatgaacaagacagtttcagatatggygacacattgtgaagaaaaaggccaggatgatgtgatagaaagtgacatgggggacaggggtagggagtggttactttagctagggtggccagggaaggcttcttggaggaggtggtatttgagcagacaccagtcgcatggtgacctagggaagaacattccatgtagaggaaacagcaggtggcttttttttggatgaggaaactgaggctcagataggggaagtgacttgcttgcagccacaggcaagagaaatgctgtaacggtaggaacgcagctggggacccatcctgatcccct

SEQ ID NO: 22885 - DNA, 601 bp, Human
agtgaatgcctcgtttataaacatggccacgcctccacccttgcagggacattctggcatggggcactgggaaacagaagccctacgcccggcccttcgaggtggagaaaacatggggcaaagggaagaaaatgagacccgggtgtgagaacctgggggtgacccagtagggtcagactcgcagtgactgggcactgcagacagtcatggcctgggtgcaggtggaggtgcagctctgccatcagggtagcgcttagaaaggtcccagaccaagcttccccggaaaacattcatgaccccwgctcttcatttaactgctttaaaatttcttatatttttagcctctttcccaaggggaggaggcttctatgaaatcagacttcctttttgtttttggcttacccctcacacttcagggagccacctctgtgatgagttttacaagcgctacagttgcccgcggggcctacgactgagaccgccagacttctacgtaaatttggtggggtaaggatgaattctggcttgcacggtgatgtctttattatttttttaaaatttttgagttgattatcaatgtctaaaaatcacgagagtctac

SEQ ID NO: 22886 - DNA, 601 bp, Human
aacagtcaccctctgctggccctgggtcccaaagtagcctcttgttgtggcctgtttgggctttggtttgtggggatggagtttcctcaagaaccttaaaacaggaagacgataagggccgtatttgttacacagaactgccactttctggcgtctgtctagagatctcttttctgtatgaaattacatcggagagcccagcccaaattccagcttggaaactgatgctcaccatgccctctggaggctctgccaatttctcagagtgaatgcctcgtttataaacatggccacgcctccrcccttgcagggacattctggcatggggcactgggaaacagaagccctacgcccggcccttcgaggtggagaaaacatggggcaaagggaagaaaatgagacccgggtgtgagaacctgggggtgacccagtagggtcagactcgcagtgactgggcactgcagacagtcatggcctgggtgcaggtggaggtgcagctctgccatcagggtagcgcttagaaaggtcccagaccaagcttccccggaaaacattcatgaccccagctcttcatttaactgctttaaaatttcttatattt

SEQ ID NO: 22887 - DNA, 601 bp, Human
ttccgggctcaagcgatcctcttgcctcggcctctgaaagtgctggggattacaggcatgagtcaccacgtctggctgctactaggaaacttaaaattgcacacgtggctcacattctgtctctttttgggcagtgctgatctaagtggtcagtcatctctgtgctcttgatggtggctcccaggtccaggctcagagagggcacagtctgcctctcctgtgttggggtgctctcctaagtttatcaagtgactgtaaaagtacctaactttaacactacctaagatgagcgaaggtagcrggtgccagagatacgaactgcagaaggcgcagaggcctaaaagcatctgtatatgattctcccaaaccagctctgtgcaactttcaaggacatccccgggctcagtgaagtggctgtggaggccccctactcgtggctctataacagtcaccctctgctggccctgggtcccaaagtagcctcttgttgtggcctgtttgggctttggtttgtggggatggagtttcctcaagaaccttaaaacaggaagacgataagggccgtatttgttacacagaactgccactttctggcgtctgt

SEQ ID NO: 22888 - DNA, 601 bp, Human
tctggtaatccattttggcaactgaagaaatctaggcaaagtgacctgaccaggatcacacacccggaggggtttaaagctgggatttgaacctacctccgtttaacctcacagcctggacctttctattgggcctcagcccacctgtactctttgaagagggtttgtctgttgggctcaagaatctttaagtccttactatccaatacggtagtcacatgtattgtgactacacctatagggtactgagcacttgaaatgtggctattctgaagtgaaatgtgctgtgagtgcaaaatayacatcagatttagaggatattttgaaaaaatgtaaaagtagtagttcatttataatttttatagtgatcacacattggattgataataagttggataatagtgttggatttgacatactgggttaagtatattattaaaattaacttcactggtttctttttccttttttaaaataatgtagctactaggaattttttcttcttttttaaaaaattattttattttgtagagatggggtctcactatttgcccaagctgatcttgaacttccgggctcaagcgatcctcttgcctcggcc

SEQ ID NO: 22889 - DNA, 601 bp, Human
gatggagttctaggctgtgcctaggaatttgatttcctttatttttgctcctcattataactctttataaccagggtaaaaaagaataataattttaatagagctttatgttactaaaaatgagtattagtaggattatattctctggcagtttctcctactataacttgtgataatagtaataataaacgcacgttgaatgatcaacagcaacttgaatttgcaacatgttacagtttgcaaagccttgttgtgaattacttcttgtccgatgttttaagaattctgtggcacaggaaargattctggtaatccattttggcaactgaagaaatctaggcaaagtgacctgaccaggatcacacacccggaggggtttaaagctgggatttgaacctacctccgtttaacctcacagcctggacctttctattgggcctcagcccacctgtactctttgaagagggtttgtctgttgggctcaagaatctttaagtccttactatccaatacggtagtcacatgtattgtgactacacctatagggtactgagcacttgaaatgtggctattctgaagtgaaatgtgctgtgagtgcaaa

SEQ ID NO: 22890 - DNA, 601 bp, Human
tttctttaaaaaaatacacaaaagggaaaaagaaaacatatcaactattagctaccatccagaactaggtacatcttgtatatcaacatcctttttttttgaaatttataacaaaaatggaatattcctatacacaatattttcttctatctgccttcttttctctctggcccaactccacactcataccttcttctaggctctcaaacaagtaatgcaaatgaagtaattctcaaggaaatactgttcttcatgcaggccctcctgacatagtagctgaatcagatggagttctaggctgtgcctaggaatttgatttcctttatttttgctcctcattataactctttataaccagggtaaaaaagaataataattttaatagagctttatgttactaaaaatgagtattagtaggattatattctctggcagtttctcctactataacttgtgataatagtaataataaacgcacgttgaatgatcaacagcaacttgaatttgcaacatgttacagtttgcaaagccttgttgtgaattacttcttgtccgatgttttaagaattctgtggcacaggaaaggattctggtaatccat

SEQ ID NO: 22891 - DNA, 601 bp, Human
tgaatccaggaatcaatgtttttttaaacactcctcagagtgattccaatgtgtacccagggctgagaaccactgggggctagactaattgcctcaatgtacaagtggggaaactgaggccagagaggggaagggatttgcttagttcaccaggcttatttccagcactcctctggagtcagaggagtgtggctaataatgaaaatagctaccatcaaccaactctacgctaaaggaaatgaaataagagagatctaagtgtgacaatgagtagaacttcctgatgaaccagcggcttagrgaggagaagggggaggactctggctatagaaatgtttaagaggatatagtggaaaacacagtggccaaggggcatgcaagtgaagatgagtcttgctgggtgaccttgggcagggccctctgtggctctgggtgctagacggccactccagccgggcaggctgctgagcctggcctggatggcggccagtgctatatgaccctgacatccccagctccctgcaccagggcacagccctcagccccggtgccctgcccagcgcttacttcttgagcacgatctcagaagcccccttgctgt

SEQ ID NO: 22892 - DNA, 601 bp, Human
aaaggcttagagaccacctccccaccctcgtgatgcccagctagctgtggctggtcatccagtgcccatctagttcatcccccaggcagggtgaaatcaagcattcgtcctgcaatttttgcccaggccactcagcaagcggagccccactttgatgtattatatactcacaagattcatctgaaataacactcccacagctgaaatggtttacaaagcacataaaactcaggctagtagttcttgaccctgcctgcacattagaattgcttggaggagcctttaataaatacccacgtgygagccttgccccagaggttccagttcaatttgtctggggtgaatccaggaatcaatgtttttttaaacactcctcagagtgattccaatgtgtacccagggctgagaaccactgggggctagactaattgcctcaatgtacaagtggggaaactgaggccagagaggggaagggatttgcttagttcaccaggcttatttccagcactcctctggagtcagaggagtgtggctaataatgaaaatagctaccatcaaccaactctacgctaaaggaaatgaaataagagagatctaagtg

SEQ ID NO: 22893 - DNA, 601 bp, Human
ctttccctgagctcgctggccctggggcctacctctggccgcaccgggtcctcgatgcccaccacgcagatgcaggtgagttcgttgaggatgtcattctcattgtcccagtccggctccgggctgctggggaagtcgcggtaggccacgcagatagtgcggagcccatcgcaagccatgggctcaatcaccttctttaccatctcgtcccggtcgcggggccggaagacacgaggctctcccgccccattgaggattttgcagcacctaggggaggatggaagggagatggggagcccarggaatgctccttctgaaaggcttagagaccacctccccaccctcgtgatgcccagctagctgtggctggtcatccagtgcccatctagttcatcccccaggcagggtgaaatcaagcattcgtcctgcaatttttgcccaggccactcagcaagcggagccccactttgatgtattatatactcacaagattcatctgaaataacactcccacagctgaaatggtttacaaagcacataaaactcaggctagtagttcttgaccctgcctgcacattagaattgcttggaggagccttta

SEQ ID NO: 22894 - DNA, 601 bp, Human
gtcctttgtagggaccctggaatccatgtttgtggatttgttacaggagatcctggctcctgcagggcaagaggtttctaaggcagggcagcccctacacctgtcccttgggggaccagagggaagagctcatggtggctggctggacagctcgaggactgcccccatggcagagcaatacctgctggcaacctgtgggttctgtgtccttctgggccgacccatgccacatgtggtctacactgtttctcatgggcaatcctcttatgaggatcaaggaaggaaatccccatgggcattrtgtggaaactgagactcaaagaggtgaagtgacttactccaggtcaccctggtggctggcctcccagcctcatcccctttccctgagctcgctggccctggggcctacctctggccgcaccgggtcctcgatgcccaccacgcagatgcaggtgagttcgttgaggatgtcattctcattgtcccagtccggctccgggctgctggggaagtcgcggtaggccacgcagatagtgcggagcccatcgcaagccatgggctcaatcaccttctttaccatctcgtcccggtcgcggggccg

SEQ ID NO: 22895 - DNA, 601 bp, Human
gtgtcctttgtagggaccctggaatccatgtttgtggatttgttacaggagatcctggctcctgcagggcaagaggtttctaaggcagggcagcccctacacctgtcccttgggggaccagagggaagagctcatggtggctggctggacagctcgaggactgcccccatggcagagcaatacctgctggcaacctgtgggttctgtgtccttctgggccgacccatgccacatgtggtctacactgtttctcatgggcaatcctcttatgaggatcaaggaaggaaatccccatgggcaytatgtggaaactgagactcaaagaggtgaagtgacttactccaggtcaccctggtggctggcctcccagcctcatcccctttccctgagctcgctggccctggggcctacctctggccgcaccgggtcctcgatgcccaccacgcagatgcaggtgagttcgttgaggatgtcattctcattgtcccagtccggctccgggctgctggggaagtcgcggtaggccacgcagatagtgcggagcccatcgcaagccatgggctcaatcaccttctttaccatctcgtcccggtcgcggggc

SEQ ID NO: 22896 - DNA, 601 bp, Human
tgctattgggtgtgtcctttgtagggaccctggaatccatgtttgtggatttgttacaggagatcctggctcctgcagggcaagaggtttctaaggcagggcagcccctacacctgtcccttgggggaccagagggaagagctcatggtggctggctggacagctcgaggactgcccccatggcagagcaatacctgctggcaacctgtgggttctgtgtccttctgggccgacccatgccacatgtggtctacactgtttctcatgggcaatcctcttatgaggatcaaggaaggaaatycccatgggcattatgtggaaactgagactcaaagaggtgaagtgacttactccaggtcaccctggtggctggcctcccagcctcatcccctttccctgagctcgctggccctggggcctacctctggccgcaccgggtcctcgatgcccaccacgcagatgcaggtgagttcgttgaggatgtcattctcattgtcccagtccggctccgggctgctggggaagtcgcggtaggccacgcagatagtgcggagcccatcgcaagccatgggctcaatcaccttctttaccatctcgtccc

SEQ ID NO: 22897 - DNA, 601 bp, Human
taggccagcttgctggggtaaactggctggtaaactgcatctgcactgggagaactataaatactgacagggacaccacacttcgggttctcctgagtgcaatgcccttgctattgggtgtgtcctttgtagggaccctggaatccatgtttgtggatttgttacaggagatcctggctcctgcagggcaagaggtttctaaggcagggcagcccctacacctgtcccttgggggaccagagggaagagctcatggtggctggctggacagctcgaggactgcccccatggcagagcaatrcctgctggcaacctgtgggttctgtgtccttctgggccgacccatgccacatgtggtctacactgtttctcatgggcaatcctcttatgaggatcaaggaaggaaatccccatgggcattatgtggaaactgagactcaaagaggtgaagtgacttactccaggtcaccctggtggctggcctcccagcctcatcccctttccctgagctcgctggccctggggcctacctctggccgcaccgggtcctcgatgcccaccacgcagatgcaggtgagttcgttgaggatgtcattctcat

SEQ ID NO: 22898 - DNA, 601 bp, Human
agagagagagagagagaggagcactaggcatggtgtggaagattggggttccagtcccattcattcttattcattcattccgcaaacactcattgaacacctttggcaggctaggctgtatgtctagggctgttacgtgtccctggatctagggtaatgaaatctactgaagagggcatgaaggaaggggacccacgtatgtaggccgcctatcttgtaccagatactctgcttgttgctcgtagatgcatgatctgagccttcatgatatcccagagggggtgtgtgtgatactattatyatccccagtatgcagatgaggctcagagaggttatgtaactggttcaacgtcacacagccagctgtgccggcactcaggatcacagatctgtctgatgtctgagctcacactttgaaccctctccctgctgcctaaaatgtgaaatgcctgtgacctcctagtttcatttttctttggaatgcagaatcttataacatcagggccaggaacttggaggtcatcttgtctatcccttttaccttaaagagagggaaactgaggctcagagaggagtagcaaatggccagagacccccagag

SEQ ID NO: 22899 - DNA, 601 bp, Human
gtgaggaagccacaatgacacccccaaggagggtgtgtgtgtatgagagagagagagagagagagagagagagagaggagcactaggcatggtgtggaagattggggttccagtcccattcattcttattcattcattccgcaaacactcattgaacacctttggcaggctaggctgtatgtctagggctgttacgtgtccctggatctagggtaatgaaatctactgaagagggcatgaaggaaggggacccacgtatgtaggccgcctatcttgtaccagatactctgcttgttgctcrtagatgcatgatctgagccttcatgatatcccagagggggtgtgtgtgatactattatcatccccagtatgcagatgaggctcagagaggttatgtaactggttcaacgtcacacagccagctgtgccggcactcaggatcacagatctgtctgatgtctgagctcacactttgaaccctctccctgctgcctaaaatgtgaaatgcctgtgacctcctagtttcatttttctttggaatgcagaatcttataacatcagggccaggaacttggaggtcatcttgtctatcccttttacc

SEQ ID NO: 22900 - DNA, 601 bp, Human
cctcaagtgctgtgcaaggatgaagagttttcagtaacgagataacacatcacagtgaggcctgaacccattagtggctggtaatgagcaggtgtcccacagggaggctgataaacggcctgtctgtccatggagagagaggtttgcaggaaagcacgtgtgggctccactgccaagctccaggggcattaattgtctttgctgttttaggatcttgataggagtgaggaagccacaatgacacccccaaggagggtgtgtgtgtatgagagagagagagagagagagagagagagagaggagcactaggcatggtgtggaagattggggttccagtcccattcattcttattcattcattccgcaaacactcattgaacacctttggcaggctaggctgtatgtctagggctgttacgtgtccctggatctagggtaatgaaatctactgaagagggcatgaaggaaggggacccacgtatgtaggccgcctatcttgtaccagatactctgcttgttgctcgtagatgcatgatctgagccttcatgatatcccagagggggtgtgtgtgatactattatcatccccagtatgcagatg

SEQ ID NO: 22901 - DNA, 601 bp, Human
agcctcaagtgctgtgcaaggatgaagagttttcagtaacgagataacacatcacagtgaggcctgaacccattagtggctggtaatgagcaggtgtcccacagggaggctgataaacggcctgtctgtccatggagagagaggtttgcaggaaagcacgtgtgggctccactgccaagctccaggggcattaattgtctttgctgttttaggatcttgataggagtgaggaagccacaatgacacccccaaggagggtgtgtgtgtatgagagagagagagagagagagagagagagagaggagcactaggcatggtgtggaagattggggttccagtcccattcattcttattcattcattccgcaaacactcattgaacacctttggcaggctaggctgtatgtctagggctgttacgtgtccctggatctagggtaatgaaatctactgaagagggcatgaaggaaggggacccacgtatgtaggccgcctatcttgtaccagatactctgcttgttgctcgtagatgcatgatctgagccttcatgatatcccagagggggtgtgtgtgatactattatcatccccagtatgcaga

SEQ ID NO: 22902 - DNA, 601 bp, Human
tgcagttgcaaaatgaatcttaatgtgtctgcaggaccctagagatggcccgggctgaggttttccctctggctgagcctcctaggctggaggcaccaggaagggagttcacctgtgagatttacagagggtgacaaataattctgcataaagggacgagtccaggaggacagagctctggggtgcttgacaaaaacacggccaccataagcacacacgttccctgaaggtcgcccctaaaatctggggatagtggttacctctgaggtgggaaccagggggctagagggggcaggaatgrcctacctaaaaaacaaacaaataaacaaagccatacccacccgtctccttgggtcctgcatccatcccgccccactcggaggtgctgaatcaacacgtctgagctcttatgcttgcacgtggtgtcacctgtaaccctgctgtgtccctcactgtgaatgctggacagtctgattctctcagttttcaagtggggaaactgaggccatctgtgagggagtggcaggggcagaattagaacccatgtcccttgagtctgctgtgtcacttgagtaagttgctgctgtgagacagtttatga

SEQ ID NO: 22903 - DNA, 601 bp, Human
agcctgtggggctgctctctttcaggggttccaccctgatgccttcaagaggaaacccgcagttctgagcgtggctgtcttgtggcgtgaggaacggatgctctagaggggcagggtcccagtaaggaggcctctctagctactggagttgtctaagagaccggctctgtggtggcaggtagtgatctccccgttgttgaagggttagagcagggccagctgaccaccagcctcctctggggcttacttccagggcctggggagaagccttccagtgcccactcggggtttgggggccacrtgagcaaggcccctgcctcgtgccacagcggctaatcacataagcaaacgtgacctcattcttacagggctggagggagtgggaatgtggaatgtccaagatcttgtttatataacttactaacatcctcatgatggctgtaaactgggctgtggccccctgctgtctcctgcccctgagaacagcaaagagctgctgtttcctgggaacgcacaccttatctggctcctgcctccaaaaggaggaatttaggttcttggtttcaaagacgctggaggacttggagttggaaagggtttt

SEQ ID NO: 22904 - DNA, 601 bp, Human
cagcctgtggggctgctctctttcaggggttccaccctgatgccttcaagaggaaacccgcagttctgagcgtggctgtcttgtggcgtgaggaacggatgctctagaggggcagggtcccagtaaggaggcctctctagctactggagttgtctaagagaccggctctgtggtggcaggtagtgatctccccgttgttgaagggttagagcagggccagctgaccaccagcctcctctggggcttacttccagggcctggggagaagccttccagtgcccactcggggtttgggggccamgtgagcaaggcccctgcctcgtgccacagcggctaatcacataagcaaacgtgacctcattcttacagggctggagggagtgggaatgtggaatgtccaagatcttgtttatataacttactaacatcctcatgatggctgtaaactgggctgtggccccctgctgtctcctgcccctgagaacagcaaagagctgctgtttcctgggaacgcacaccttatctggctcctgcctccaaaaggaggaatttaggttcttggtttcaaagacgctggaggacttggagttggaaagggttt

SEQ ID NO: 22905 - DNA, 601 bp, Human
gtcagcctgtggggctgctctctttcaggggttccaccctgatgccttcaagaggaaacccgcagttctgagcgtggctgtcttgtggcgtgaggaacggatgctctagaggggcagggtcccagtaaggaggcctctctagctactggagttgtctaagagaccggctctgtggtggcaggtagtgatctccccgttgttgaagggttagagcagggccagctgaccaccagcctcctctggggcttacttccagggcctggggagaagccttccagtgcccactcggggtttgggggcyacgtgagcaaggcccctgcctcgtgccacagcggctaatcacataagcaaacgtgacctcattcttacagggctggagggagtgggaatgtggaatgtccaagatcttgtttatataacttactaacatcctcatgatggctgtaaactgggctgtggccccctgctgtctcctgcccctgagaacagcaaagagctgctgtttcctgggaacgcacaccttatctggctcctgcctccaaaaggaggaatttaggttcttggtttcaaagacgctggaggacttggagttggaaagggt

SEQ ID NO: 22906 - DNA, 601 bp, Human
gctgatgacgcacatggcatatgggccacagcctcccttcctgtgccaacggcaggcattgttaatcaatcacacatcctttgattaaaccctgatgtggttctcatcacagagtcccaggtcgctaccacctattgaccatgacggtccatcctgagacagaaccattggctgtctcgacctgggcgaagactttggaaagacttccatgaacgcctcctcagatctggccccaggtaagcttggccaggtgaacttctctttgcctcatccacatacatagttcctgcaaacttgacaratctatttgtgtattttcagtttcttggggggacatttgcatttgggggcattttacttacagaatgtgacacggatttagaatatgtataaaggattatgcttcaggtaaaatacgccatttctctgcaataataaggataggttctgtcctctctgactgtaatgacagacggatatctgggacaatcaggccggatcagagccagccaatcagaaggcacaaggcttcccagccccgccccaccctaccccagcagctggccctgagcagagctgagggtttccccgaggaaaccag

SEQ ID NO: 22907 - DNA, 601 bp, Human
tgccttgcctcaagcacaggccctaccaaccctggagcccatcccaccttccatggcctgtgacctaaagcctccctagtccaagttagaggcagtgttgggtccagagcaccccatgccagcagtgcagccttttgctctatgcagggaccacttattcaatgcctgctgcgtgcagcctggcccatgaattccacgtgggcaggaccaggcctgtcctgagcagggctggcacctggcaggacctcagtaaacagttatggagagaatgagtgaatgaataagaataaggatgggctgrgcgccttctgctcccttgtggttctggggttctgggtttctctccccaggccagatctgcttccattaatgtccttgggcagcacctttgaaagaggaatccaagatgttctagggctgatctccagtggagccctgctcccatagccattttacaaatgaggaaactgagtcccagagtgggatttgcccaaggccacagagcaggtcagtggcaaagccaggaccacgtgactctaaaaatacccagttggctgggcacagtggctcctacctgtaatcccagcactttgggatgcca

SEQ ID NO: 22908 - DNA, 601 bp, Human
cctgctctccctcctcgctcgatgtccaatgctcttctccaacaggtatagactgatgggatcccagaccctcctgctcctcatccctccatgacatgcaaaccaccacccagcccagacccctccactacccaaactttctcagacccgcacctggcagctccacttgaggtgtcaccactgtgggcaggtgacaactcttaagcaggacaatcctacaggtccctccactgccaggccgtgctctgcactgcagggtaagttttctaaaatgatgcttctaccctctaaaccctcccaygttcctgtgcctggtgacacggtgcaggccatgacggggtgctcgtggtgggcattggcggccctgcaggatctgctgccctcccacctgctccagtctcctgtagcttccctctcccaccccgaggtcctggcccagatccttgaaggcatctggggatcttctgcctctagccctttgcagagcagttccctgccttgcctcaagcacaggccctaccaaccctggagcccatcccaccttccatggcctgtgacctaaagcctccctagtccaagttagaggcagtgttgggtccag

SEQ ID NO: 22909 - DNA, 601 bp, Human
gtgcccccaacctgctcccttgcagctctaccctctttcaggcccagctgcagtgccgtgtgttctgggaatcgttctgggctgctcccacccagctgtcggtgacccctcagttccaccgtcctggactcagcctccccaagcttgtccccttgggacattaggcctgagtttccatagttccctcagtcagcctgggggctcctccaaggcagggacgggtcaaatttctgccctgtggctcccaggtggtgcggaccgttgcgtagctcaagctgtgcggaaagctgggaggaaacckctccctagacgcctccctgcctccagtcctggggtggcctgactgtgtgcagtcaccaggggcctccctgtggctgcttcctatggtcacatttctgttctgtccccgcagacctctcagcaactatttccaccatggaccacaccttcctcctccacaggcctccttccttgtcttcccggcaccactccccactgaccatcctcctgcccctctagcctcctccccttggcctcctctgtaggttctcagcctgcaccatcactcgggcagctcttggcttctgcagctcctctctcc

SEQ ID NO: 22910 - DNA, 601 bp, Human
ccttccttttctctgtctccaccctctgccaccagcatcactttgtttcctctcactgactctggactccccctccaacttgcttccccacagcaacctcaggatctctctaacacccatgtctgaaccagttccgtcccccagccatccccggaatgtcgttttcctgcttccccccttggtctcaggataacatccatgttcttagctccacttatgaagtcctctgtgaccaggcctcactcacatcctgacctcttctcttctctcatcccctggccacccccaatctgtgcttacrgtcccacagagctagctctcactggccctgtgtctgggcaggctgttcccttggctggaggtactcctgtcacccacctgtactgtatttttggctcagaggctgcttttcccaggaagcctttctgaccctctgaggatccctgcctgcccttaatcagatccatgtaactctatgtgctgctccatccttgcgcatctctctgctctgtgcctagcagacggcagcagcctgtggaatgaggcgctgagttccataacctggggcactgtgcccccaacctgctcccttgcagctcta

SEQ ID NO: 22911 - DNA, 601 bp, Human
gcagggatgtccatgggcacgacaggaatttgggtatcagcatccatgggtctctcattctgcacattgaatgtatcaccaaggcctgccaattctggctccaaaatcccactgaaacccttccttttctctgtctccaccctctgccaccagcatcactttgtttcctctcactgactctggactccccctccaacttgcttccccacagcaacctcaggatctctctaacacccatgtctgaaccagttccgtcccccagccatccccggaatgtcgttttcctgcttccccccttggyctcaggataacatccatgttcttagctccacttatgaagtcctctgtgaccaggcctcactcacatcctgacctcttctcttctctcatcccctggccacccccaatctgtgcttacggtcccacagagctagctctcactggccctgtgtctgggcaggctgttcccttggctggaggtactcctgtcacccacctgtactgtatttttggctcagaggctgcttttcccaggaagcctttctgaccctctgaggatccctgcctgcccttaatcagatccatgtaactctatgtgctg

SEQ ID NO: 22912 - DNA, 601 bp, Human
atgtgggactgcgggccagacccttcccctctctgggcctctgtttccccatctgtgacctggggataggctttgttgggattgcctccgaagcatctgtggaaaccaggccagtcttggccccagccagacctggttctgtgcccagactcttcctcagactggctgtgtgcccttgggcaagtcacctcacctctctgagccttggtgccctcgtttgtaatgtggggtggaggcaaatgtgcttgcctcactgagtggaagacccaaccaggcagcccaagtggaagcattgtgagartcggtggtggtgtgagcgtgtatgccctgccccaggaagccttgctgagggtcccttccacggggccaggataaggtgctggaatgggtcagagaaggggtgagtcactcccctcccagcctcaggtgcctctggggctgccatgcagtgcttcagcacccggtcagggccttgcacggtctgtacttgttgccaggagctgtcaccagtggagaaagccactgatggctttagggttagccagagctgggacagggccaggccctgttcaagacttgctggtgtgaccttgggcaactt

SEQ ID NO: 22913 - DNA, 601 bp, Human
tcaagtgatccacccgcctcggcctcccaaagtgctgggattacaggcatgagccactgcacctggccaagtcctgtgtccttttgcacagctgagtaaagtggtgccaggaggcttgtggagttttctgggtgtgagatgtcccaagactacccagggtaggtgctgctcaagtggtcaagccagcaagccgaccaggacccccgctctcctctcctctccaacccctccacctcctctgagtctcttctagttctgcatataagtggcttcctctaagctttttcatgataagttttayaacagtaaaatgtgtcctgacaacacactactttcaaaatttataaaaggcaactaactgcctttgaggaatggatccatgcccacctccatcacactctgggctttgaggacaagtgaaaggccagctccgggaggctcctgtaaggagagaactggccctgattccatgtgggactgcgggccagacccttcccctctctgggcctctgtttccccatctgtgacctggggataggctttgttgggattgcctccgaagcatctgtggaaaccaggccagtcttggccccagccagac

SEQ ID NO: 22914 - DNA, 601 bp, Human
cgaattcctgacctcaagtgatccacccgcctcggcctcccaaagtgctgggattacaggcatgagccactgcacctggccaagtcctgtgtccttttgcacagctgagtaaagtggtgccaggaggcttgtggagttttctgggtgtgagatgtcccaagactacccagggtaggtgctgctcaagtggtcaagccagcaagccgaccaggacccccgctctcctctcctctccaacccctccacctcctctgagtctcttctagttctgcatataagtggcttcctctaagctttttcrtgataagttttacaacagtaaaatgtgtcctgacaacacactactttcaaaatttataaaaggcaactaactgcctttgaggaatggatccatgcccacctccatcacactctgggctttgaggacaagtgaaaggccagctccgggaggctcctgtaaggagagaactggccctgattccatgtgggactgcgggccagacccttcccctctctgggcctctgtttccccatctgtgacctggggataggctttgttgggattgcctccgaagcatctgtggaaaccaggccagtcttg

SEQ ID NO: 22915 - DNA, 601 bp, Human
tttgcgctgccccgagagtgctgcttcttgttcctgagcatgtcccttgctgagacctctacaagctcatggggctgttactagagatgccaattcctatatggagcccaggacttctgggctaggctggctctggaccctcccatgtggcttcattctaacacctgagctgtcacatggcagggcactgctgtgtagacgctgctgatagggtgtctgatgcagtcctgtatcctttttgttttgttttgttttgtttttgagatggagtctcgttgttgcccaggctggaggacagtgrcgtgatctcagctcactgcaacacccgcctcctgggttcaagtgattctcctgctttagcctctcaagtagctgggattacaggtgcgcaccatcacgcccggctaatttttgtatttttagtagagatggggtttctccatgttggccatgctggtctcgaattcctgacctcaagtgatccacccgcctcggcctcccaaagtgctgggattacaggcatgagccactgcacctggccaagtcctgtgtccttttgcacagctgagtaaagtggtgccaggaggcttgtggagttttc

SEQ ID NO: 22916 - DNA, 601 bp, Human
tggcttctaaaaagtgacctcagactggaaaactcattctggactgcgaggacaggatacctgcgggaggttttgcgctgccccgagagtgctgcttcttgttcctgagcatgtcccttgctgagacctctacaagctcatggggctgttactagagatgccaattcctatatggagcccaggacttctgggctaggctggctctggaccctcccatgtggcttcattctaacacctgagctgtcacatggcagggcactgctgtgtagacgctgctgatagggtgtctgatgcagtcctstatcctttttgttttgttttgttttgtttttgagatggagtctcgttgttgcccaggctggaggacagtggcgtgatctcagctcactgcaacacccgcctcctgggttcaagtgattctcctgctttagcctctcaagtagctgggattacaggtgcgcaccatcacgcccggctaatttttgtatttttagtagagatggggtttctccatgttggccatgctggtctcgaattcctgacctcaagtgatccacccgcctcggcctcccaaagtgctgggattacaggcatgagccac

SEQ ID NO: 22917 - DNA, 601 bp, Human
gcgaatgcaggggcgcgttcctcccgctgtcgatctggaacatcttctcgcctgccaagtgagagagtggggctgggctgaaggcagtggtgggggaatcagaggggagatgcctggcctttcgtgggggcctcttctgagcagtgacgtgaatccccaagacatcaaggcatgcttggacagtggggggccagggctgtgctgtcagctggtcagagactaggactgaagggtcagcaaagccctttctcctctggggaagaaaggccttgggcaactgtcttccactttttctgtggaracccgataaaggtggacggccggctgtgttaaaggtgggcgacatggcttctaaaaagtgacctcagactggaaaactcattctggactgcgaggacaggatacctgcgggaggttttgcgctgccccgagagtgctgcttcttgttcctgagcatgtcccttgctgagacctctacaagctcatggggctgttactagagatgccaattcctatatggagcccaggacttctgggctaggctggctctggaccctcccatgtggcttcattctaacacctgagctgtcacatggcaggg

SEQ ID NO: 22918 - DNA, 601 bp, Human
aaagacattgcgctcgccgtggatcttgcgggcgttgatctcgttgaagagctgcatcatgacgaaggtgttgaagatgatggtgtaatgttctgagggtggcgaatgcaggggcgcgttcctcccgctgtcgatctggaacatcttctcgcctgccaagtgagagagtggggctgggctgaaggcagtggtgggggaatcagaggggagatgcctggcctttcgtgggggcctcttctgagcagtgacgtgaatccccaagacatcaaggcatgcttggacagtggggggccagggctgkgctgtcagctggtcagagactaggactgaagggtcagcaaagccctttctcctctggggaagaaaggccttgggcaactgtcttccactttttctgtggaaacccgataaaggtggacggccggctgtgttaaaggtgggcgacatggcttctaaaaagtgacctcagactggaaaactcattctggactgcgaggacaggatacctgcgggaggttttgcgctgccccgagagtgctgcttcttgttcctgagcatgtcccttgctgagacctctacaagctcatggggctgttactag

SEQ ID NO: 22919 - DNA, 601 bp, Human
ggggtcctggattctccatccagtgctgtctcccttgccctgctaacaggcacctcctgcgacctaccaggaacttacctggccccaaacgagctctcctaacccaatgaatatgcaccacatccactggtccagctgcagtggagagcagctgaatggcttccctccaaactgcacgatcactatctggaggtcacaggggagcagagaaagagagagagagaggccatcagggaccagcacagagggctgggctctcagggccctgcccaggggctccagccgcttgctgcccaccccrggcctggttagggtgggggcctcactacctggatggcaaaggtgcccagcacgatggtgcagaagatggggttccggaagatgccgtcaaagacattgcgctcgccgtggatcttgcgggcgttgatctcgttgaagagctgcatcatgacgaaggtgttgaagatgatggtgtaatgttctgagggtggcgaatgcaggggcgcgttcctcccgctgtcgatctggaacatcttctcgcctgccaagtgagagagtggggctgggctgaaggcagtggtgggggaatcagaggggagat

SEQ ID NO: 22920 - DNA, 601 bp, Human
gggaggagcttgcctggggtctggcagcccattcctgggggtcctggattctccatccagtgctgtctcccttgccctgctaacaggcacctcctgcgacctaccaggaacttacctggccccaaacgagctctcctaacccaatgaatatgcaccacatccactggtccagctgcagtggagagcagctgaatggcttccctccaaactgcacgatcactatctggaggtcacaggggagcagagaaagagagagagagaggccatcagggaccagcacagagggctgggctctcagggycctgcccaggggctccagccgcttgctgcccaccccaggcctggttagggtgggggcctcactacctggatggcaaaggtgcccagcacgatggtgcagaagatggggttccggaagatgccgtcaaagacattgcgctcgccgtggatcttgcgggcgttgatctcgttgaagagctgcatcatgacgaaggtgttgaagatgatggtgtaatgttctgagggtggcgaatgcaggggcgcgttcctcccgctgtcgatctggaacatcttctcgcctgccaagtgagagagtggggct

SEQ ID NO: 22921 - DNA, 601 bp, Human
atctcccttcctaacaagctgctccagccttgaatccctggcaggccatggcttctagctggagtttaataatgtcattctcattacattaatgtttttgttagcttccatttatgacaagtgatactgatttttcagttgtcttagtaacaggacgttgcctttaaaaacaaatttaagttaaaaaagctgacgtgattgagagaaaatattacataaacaacaggagcagtggtagatagatataaggcaaaaatcagagcagtagtacccagacgaccagtataggacctgggacaarcccccttgctcagatgtccagagatagggaggagcttgcctggggtctggcagcccattcctgggggtcctggattctccatccagtgctgtctcccttgccctgctaacaggcacctcctgcgacctaccaggaacttacctggccccaaacgagctctcctaacccaatgaatatgcaccacatccactggtccagctgcagtggagagcagctgaatggcttccctccaaactgcacgatcactatctggaggtcacaggggagcagagaaagagagagagagaggccatcagggac

SEQ ID NO: 22922 - DNA, 601 bp, Human
aaggcaagaaaaatgcctcccacccatggggtcccactgcctggatgtgtgagcaccttgggaatcaggccccttaggccctgagttggttctgggccctcctcccaagccctgtgtcctgggtcaggagcctttgggctgcatgctctcagagctgtgacagggtctggaacttgggcaaacgtagaaaaacgaattggtgggagaatattctgggacaaagctggaagggcccctaaagagcatccagcccaaggagccccagagctggggcaggcacagcactgaggccacagatggycacaggcacagcactgagtaacaccgcaatgtggcagagtgtgtcctgcttgcgttccctctgagtgctctaaaggatcctgattgacgccagccggccaccagcgcccgcagaccactgattcatctcccttcctaacaagctgctccagccttgaatccctggcaggccatggcttctagctggagtttaataatgtcattctcattacattaatgtttttgttagcttccatttatgacaagtgatactgatttttcagttgtcttagtaacaggacgttgcctttaaaaacaaatt

SEQ ID NO: 22923 - DNA, 601 bp, Human
tgggataaagatggcctggcccccagggtgcccaggggtttatcactctccaaagcagccccaaaggttacaggaagtccttttggatgaaactaaactttcttatttatcttttagttaatttttgcccccgtagcttctcactctagcctgcagacagcttgaaggcaagaaaaatgcctcccacccatggggtcccactgcctggatgtgtgagcaccttgggaatcaggccccttaggccctgagttggttctgggccctcctcccaagccctgtgtcctgggtcaggagcctttgrgctgcatgctctcagagctgtgacagggtctggaacttgggcaaacgtagaaaaacgaattggtgggagaatattctgggacaaagctggaagggcccctaaagagcatccagcccaaggagccccagagctggggcaggcacagcactgaggccacagatggccacaggcacagcactgagtaacaccgcaatgtggcagagtgtgtcctgcttgcgttccctctgagtgctctaaaggatcctgattgacgccagccggccaccagcgcccgcagaccactgattcatctcccttcct

SEQ ID NO: 22924 - DNA, 601 bp, Human
ccctcagttactgggcccagcccccaagagcctcctgtagggggtgggccccagtgggataaagatggcctggcccccagggtgcccaggggtttatcactctccaaagcagccccaaaggttacaggaagtccttttggatgaaactaaactttcttatttatcttttagttaatttttgcccccgtagcttctcactctagcctgcagacagcttgaaggcaagaaaaatgcctcccacccatggggtcccactgcctggatgtgtgagcaccttgggaatcaggccccttaggccctkagttggttctgggccctcctcccaagccctgtgtcctgggtcaggagcctttgggctgcatgctctcagagctgtgacagggtctggaacttgggcaaacgtagaaaaacgaattggtgggagaatattctgggacaaagctggaagggcccctaaagagcatccagcccaaggagccccagagctggggcaggcacagcactgaggccacagatggccacaggcacagcactgagtaacaccgcaatgtggcagagtgtgtcctgcttgcgttccctctgagtgctctaaaggatcctg

SEQ ID NO: 22925 - DNA, 601 bp, Human
cctcagggggctccctgggagtgtaaagtcagcactgcccgctggcattaacctttgtcctctgaatccttccctcagttactgggcccagcccccaagagcctcctgtagggggtgggccccagtgggataaagatggcctggcccccagggtgcccaggggtttatcactctccaaagcagccccaaaggttacaggaagtccttttggatgaaactaaactttcttatttatcttttagttaatttttgcccccgtagcttctcactctagcctgcagacagcttgaaggcaagaaawatgcctcccacccatggggtcccactgcctggatgtgtgagcaccttgggaatcaggccccttaggccctgagttggttctgggccctcctcccaagccctgtgtcctgggtcaggagcctttgggctgcatgctctcagagctgtgacagggtctggaacttgggcaaacgtagaaaaacgaattggtgggagaatattctgggacaaagctggaagggcccctaaagagcatccagcccaaggagccccagagctggggcaggcacagcactgaggccacagatggccacaggcacag

SEQ ID NO: 22926 - DNA, 601 bp, Human
acttccccgtgctgccctgagagggcacaatgggacctctctgaggaggccgtgctgttccttagcagccacaggagtgggtgtgcaagtggctggtgagagctggccgggacccctctgtagccaccctccctcagcaccagagctgggccctggggggcagcacaagcacactcacctccatcccctggcccgccccggccaggcctgggcccagcccccaagagcctcctgtacctgtgtctggatccgattcaggcctcggaaccacaggatctggccccgccgcagctcccgctcygcgtggtcgatctcctccacgtcctcgttgagctcctcctccgggatctcctccttctgtgtgagcctgcctgcctccttgaggaacttgagtctgctggtcgggatggtggcgatgacctgcaagggaccctgtctgtcaggacggtggggctgtccttcccagtggccttctctccctgacacccgctcctctacctccctcctcctacccgctcacccaggcatgtgatcaatctactccttcacccacctcacctgttcctcagcccagtctttgacaatgccttttttttttttt

SEQ ID NO: 22927 - DNA, 601 bp, Human
tgggacctcttgtccaactccaacccttgccttggtggtccgggcttttcctgaccacatatgaccctaggccagtgggacactctgtgtcccctccatgtctgtccccctctggctgccgggaccctgtggtggattgggaccatttggtcactgatgtcctcttgaccaagggtgaccccttgactgaaccagactttttggccacttgggaccctaatgaccctctgactgaccctggtccactgagtgactgccaccgcatgactggctacgctctcctgaccaacgggaccctcttcggtggctgggacccttcatccccctgggcctgattgtgaccggctgccccccatgtcctctggtgccccagcccctgcccgcctgggagctggcgtgggcagtgccagccggaggcagtaaggagtcacactcacgcccggctgcagcaggaggaaggctggtcggagaggaaagagcattggacaacgacacgcgactagggctagagagattggctacatcctggctctggctggtgaccgaggactgtctccgcagggccccctgaaaggaggccccgctcttgaaagtattgact

SEQ ID NO: 22928 - DNA, 601 bp, Human
ccccttgaccatgaccctcattactgtgggtgccccctgaccaactgggaaagtctggttgacgtgaccctctcctgggtggatcccaatgtgactgactgtgaccctaaggggcttgctccccttgacccacagtgacccttctgctgactttgactgcaagactgggacctcttgtccaactccaacccttgccttggtggtccgggcttttcctgaccacatatgaccctaggccagtgggacactctgtgtcccctccatgtctgtccccctctggctgccgggaccctgtggtggrttgggaccatttggtcactgatgtcctcttgaccaagggtgaccccttgactgaaccagactttttggccacttgggaccctaatgaccctctgactgaccctggtccactgagtgactgccaccgcatgactggctacgctctcctgaccaacgggaccctcttcggtggctgggacccttcatccccctgggcctgattgtgaccggctgccccccatgtcctctggtgccccagcccctgcccgcctgggagctggcgtgggcagtgccagccggaggcagtaaggagtcacactca

SEQ ID NO: 22929 - DNA, 601 bp, Human
caagttccaagctcagccacagggaaaggtgtctgcagggcagctgatgcagtcaaaagtgcaaggggaggagtgacaggaagcgggcagagactctgaactgctggggtgcagcgtctaggctgtgagctcctaggtggcctgggatccctggctgactatgacctctgacctgcagtgacctcttggctcaactgtcccccttgaccatgaccctcattactgtgggtgccccctgaccaactgggaaagtctggttgacgtgaccctctcctgggtggatcccaatgtgactgactgkgaccctaaggggcttgctccccttgacccacagtgacccttctgctgactttgactgcaagactgggacctcttgtccaactccaacccttgccttggtggtccgggcttttcctgaccacatatgaccctaggccagtgggacactctgtgtcccctccatgtctgtccccctctggctgccgggaccctgtggtggattgggaccatttggtcactgatgtcctcttgaccaagggtgaccccttgactgaaccagactttttggccacttgggaccctaatgaccctctgactgacc

SEQ ID NO: 22930 - DNA, 601 bp, Human
gctccctgtggcccgcgcctcctactggaggcactgagggaggcgctcccaccagcacaccgggttacctgcttggctgcagggggttgtgttgtgggtgttctggttttggatgggggtagaggccctttataaagtttcaaggggtgagctggagtctacttctcatcaaagaagctggaggctaagactgacactatgccaattggagaagaccagaaccaggggctcccctgcagatcagaagcgcctgactggaaacatagcagggcgatgggaggaaagacagacttgttccccrtggggcccgaagccatgggtccgggaaagagctagacaaagccagcaatgagtgatctagatcagaagtggtggcatgaggagatgagcttggcaggagggagatgaaggaggggccacagtcccaggctatctctcagataaaggagggcaggatgctgaagggcatatcaggtccctctgggcctgctggcacccaggcaagatgtgaggctcgacccaccattttctaccaggggtcaagctgaatgggccagggaccttgtcctttccaggaagggcttagaacttcagcaagttc

SEQ ID NO: 22931 - DNA, 601 bp, Human
ggctccctgtggcccgcgcctcctactggaggcactgagggaggcgctcccaccagcacaccgggttacctgcttggctgcagggggttgtgttgtgggtgttctggttttggatgggggtagaggccctttataaagtttcaaggggtgagctggagtctacttctcatcaaagaagctggaggctaagactgacactatgccaattggagaagaccagaaccaggggctcccctgcagatcagaagcgcctgactggaaacatagcagggcgatgggaggaaagacagacttgttcccyatggggcccgaagccatgggtccgggaaagagctagacaaagccagcaatgagtgatctagatcagaagtggtggcatgaggagatgagcttggcaggagggagatgaaggaggggccacagtcccaggctatctctcagataaaggagggcaggatgctgaagggcatatcaggtccctctgggcctgctggcacccaggcaagatgtgaggctcgacccaccattttctaccaggggtcaagctgaatgggccagggaccttgtcctttccaggaagggcttagaacttcagcaagtt

SEQ ID NO: 22932 - DNA, 601 bp, Human
ttcaagaaagaggctcaactgggatggacaaagaactgggccttcacccagaagccagactgctagcaggcagccccagccggagggccgcaggagtcatcgggaggggtggcagaacagaagtggattcttccccatgtagctctccctgccgggacacttggttaccgcacctcaggataggtgggggtgctgagcaaggccagagctgagttggtgcagaaaggagctgggaggtcagctggctaggctgctgctaaggtgagagctctctggtctaaaggggaggaggatgggaccrgtgttgccttccccgagaaatcctggcagtgactgcctagtgacggtatctcatggaaatgtgactcagccaccatctgctgaaatgcatctccatttcatcttggctccccggtcctccccagcactgcgtttctgtgctgacgaatgagcactgagaggctccttccctgctttctgcttctgtcctgccgctatgggtcgtggacatttgccatcaacaggctccctgtggcccgcgcctcctactggaggcactgagggaggcgctcccaccagcacaccgggttacctgcttggc

SEQ ID NO: 22933 - DNA, 601 bp, Human
cgtcgtggccagggtgaagtgctgcccttcaagaaagaggctcaactgggatggacaaagaactgggccttcacccagaagccagactgctagcaggcagccccagccggagggccgcaggagtcatcgggaggggtggcagaacagaagtggattcttccccatgtagctctccctgccgggacacttggttaccgcacctcaggataggtgggggtgctgagcaaggccagagctgagttggtgcagaaaggagctgggaggtcagctggctaggctgctgctaaggtgagagctctcyggtctaaaggggaggaggatgggaccggtgttgccttccccgagaaatcctggcagtgactgcctagtgacggtatctcatggaaatgtgactcagccaccatctgctgaaatgcatctccatttcatcttggctccccggtcctccccagcactgcgtttctgtgctgacgaatgagcactgagaggctccttccctgctttctgcttctgtcctgccgctatgggtcgtggacatttgccatcaacaggctccctgtggcccgcgcctcctactggaggcactgagggaggcgctccc

SEQ ID NO: 22934 - DNA, 601 bp, Human
gggcttcttttccaagactgttccaaagttggggtaaccacgggctacaggggactgatctggcctcgaaggaggtcagtgtagacacattcctgtctaagcatttctgcagaaatgaagaaaagggcatttctgcaaagaagtgttgttcccggacgggccctattgaatggctttgcaaatgaggcagaagaaaagctgagaaagaagtggctgaggtttgagcggacagctctagcttccaggctgtgaaagctaagatgaggggctgactcgaggacgacttccaaaggcagtgggsctgcccagcgatgtcaggtgtgctccgtcgtggccagggtgaagtgctgcccttcaagaaagaggctcaactgggatggacaaagaactgggccttcacccagaagccagactgctagcaggcagccccagccggagggccgcaggagtcatcgggaggggtggcagaacagaagtggattcttccccatgtagctctccctgccgggacacttggttaccgcacctcaggataggtgggggtgctgagcaaggccagagctgagttggtgcagaaaggagctgggaggtcagctggcta

SEQ ID NO: 22935 - DNA, 601 bp, Human
ttggctttggctgagcctctgcctgggcttcttttccaagactgttccaaagttggggtaaccacgggctacaggggactgatctggcctcgaaggaggtcagtgtagacacattcctgtctaagcatttctgcagaaatgaagaaaagggcatttctgcaaagaagtgttgttcccggacgggccctattgaatggctttgcaaatgaggcagaagaaaagctgagaaagaagtggctgaggtttgagcggacagctctagcttccaggctgtgaaagctaagatgaggggctgactcgrggacgacttccaaaggcagtggggctgcccagcgatgtcaggtgtgctccgtcgtggccagggtgaagtgctgcccttcaagaaagaggctcaactgggatggacaaagaactgggccttcacccagaagccagactgctagcaggcagccccagccggagggccgcaggagtcatcgggaggggtggcagaacagaagtggattcttccccatgtagctctccctgccgggacacttggttaccgcacctcaggataggtgggggtgctgagcaaggccagagctgagttggtgcagaa

SEQ ID NO: 22936 - DNA, 601 bp, Human
gagggagaggcaagatggtgagcagggtggggaggccctggccaaccctgccgggtcccctgagagaatgaggggtcagggcaaggactgtcaagttggctttggctgagcctctgcctgggcttcttttccaagactgttccaaagttggggtaaccacgggctacaggggactgatctggcctcgaaggaggtcagtgtagacacattcctgtctaagcatttctgcagaaatgaagaaaagggcatttctgcaaagaagtgttgttcccggacgggccctattgaatggctttgcaartgaggcagaagaaaagctgagaaagaagtggctgaggtttgagcggacagctctagcttccaggctgtgaaagctaagatgaggggctgactcgaggacgacttccaaaggcagtggggctgcccagcgatgtcaggtgtgctccgtcgtggccagggtgaagtgctgcccttcaagaaagaggctcaactgggatggacaaagaactgggccttcacccagaagccagactgctagcaggcagccccagccggagggccgcaggagtcatcgggaggggtggcagaacagaagtggatt

SEQ ID NO: 22937 - DNA, 601 bp, Human
tcaaattggggcccttctgtcacttcctggccacctgtttaaacctccctgtgggaggaaagcacactggcttctgcagggaccttggctggtgtttagagggtcctcagagtccttggagaccagaggaggcagcactgttgtagacactactcaagcaaaggaggcacgaggctgtgttgtccaaatgtgtgtactgaaaccacagaggctgtgatcctgtctgggaaccagtgccctcaggcaggggtttggtcaggctctttttaagactataggctcaggaagggtctcaggaggsacccagaattacaggctggattctgtcacagagggggaatgcgagattctccaggaggcatgaagagggagaggcaagatggtgagcagggtggggaggccctggccaaccctgccgggtcccctgagagaatgaggggtcagggcaaggactgtcaagttggctttggctgagcctctgcctgggcttcttttccaagactgttccaaagttggggtaaccacgggctacaggggactgatctggcctcgaaggaggtcagtgtagacacattcctgtctaagcatttctgcagaaatg

SEQ ID NO: 22938 - DNA, 601 bp, Human
gaaggagttgtggggtagtggggcggcccacttcctcatcccatcaaattggggcccttctgtcacttcctggccacctgtttaaacctccctgtgggaggaaagcacactggcttctgcagggaccttggctggtgtttagagggtcctcagagtccttggagaccagaggaggcagcactgttgtagacactactcaagcaaaggaggcacgaggctgtgttgtccaaatgtgtgtactgaaaccacagaggctgtgatcctgtctgggaaccagtgccctcaggcaggggtttggtcmggctctttttaagactataggctcaggaagggtctcaggagggacccagaattacaggctggattctgtcacagagggggaatgcgagattctccaggaggcatgaagagggagaggcaagatggtgagcagggtggggaggccctggccaaccctgccgggtcccctgagagaatgaggggtcagggcaaggactgtcaagttggctttggctgagcctctgcctgggcttcttttccaagactgttccaaagttggggtaaccacgggctacaggggactgatctggcctcgaaggag

SEQ ID NO: 22939 - DNA, 601 bp, Human
aaactccttgccctaggagtcgtcagaaccaggaatctgcaggggaagtgggagcaggaggtgccttatctgtctagcaaggtacggcgtccagaatgtggcttggacctggcttatggggctggctcttggcttgggtggtttgaaagagcaggacttccactgataaacacggagcctgctacagacttgctaagcacaaagatggtttgagatgagttaggaatttgaggcaatgagaaagagaggctgtgcggctttgccttggatcgaagtgtgggatgctaatcttgtccttgaycaccagtgggaaggtgcccttctccccagtcttggccacgctggtagaagttcaagctgagaaacagcttccctggccttccctggaggactgactccttttcacgatatgaggctgtgggcgtgggcactggttccggaatggaagttcagcctctgtggctccaggtctgtgggcctcctgggaagcggtgtgactagtgggaagaatgagggactccggagtctgacctcttgccacgcccttgctgtggtcaccctggcctcatcagtgtctttctctgcgaaatggatgtgttgg

SEQ ID NO: 22940 - DNA, 601 bp, Human
taaagcatgtcatacgctcctctgacttctaatttagagtgcacagagaagaatttaacataagctttgtcaattatccttcttggtcttaggtaagaccccatggattgtcttgttttttctcccttgctgtcagtcatcgcttactagttagtgctgacttttctgttttctgaaaagcacctctgtcctttcaccttgcatactgtgagctgggactccagggtaccccacttgctggaattgtgctttaaataagaggcaacaagtgccaaataagagccagccagacacggccttyatgctggtgctccatcatggccactgtggctgctctgagctctttccccctggagtccctctttgtggctctgcagagatggttcatattctgatctcctgaaaagtgagccgttacaccttgattaactgaaaacaaagaaggcgctgcaggcctcagctttcttgtttgtagaatgggaatagcatcaaggctgtagctgcctagcctggtgctcagtgtgttctgaggttgaagtgcaattcagatgctgactggaacacctagtgtatgtgtggggcagggggatggtggcaggac

SEQ ID NO: 22941 - DNA, 601 bp, Human
ggctagtggaaagagcactggacttggaggcagaaagacccaacttgcatcctggctctgccacatctggtgccttgactgtggacaagccacactagctctctggttgtcctctgtcctgcctcacagggtgcagagggacgggaccctcacttggaagagaggtgtcccttctctggactcctgggaggggcagcagtgcctgtcatctcaagagtctgatgggacttgggacaaaggtgcctcctcctctcgtcccagccccaactcggagtggagtcagaggtggagaaaacaaggyggcgttggcgcctccaggacagagccttagtcggctgctgtgtgcaggccaagtggcacccacctgcagagcagtggctgccctgcaccacaggcctgcggggaggcaggggactggacgagacggtcgtggggaggcccctgaagtcccaggacttgagctctcagcggaacccaggggtagctcctttgtgaaaccctggtggggaaagccctcttttatggaagtggagtttctaggtgactgtggttgatgattttaagtgtcatcgctgaaggtttgttttactgttgcagaggg

SEQ ID NO: 22942 - DNA, 601 bp, Human
gtggctgggcgggtgcatggctggtccatgtctgggtgggagccaggaagggcttgttttgggaaaaccgctcactcccgtaagcccccagtggagatcccgccccttgccttgaagtgaaaaagagttcaaacagcatcgcagccagagaaagggtctgtgggtggaaacgttggttttctctccagtatttggtttccgattgttgctcgttgctgcttgggtgagttgggtgcctggatggatgggtgcccggaaagcgggtggcagcggggtccatgagggcgggcgggcaggcgasagggtcctcagctaaagcgacgtctccaggctgtggatggggctccctggacttgaagaggtagctgatttgcttgtgtcggtcgtcaggttgatcccactgtcgatggcgctgttgttcttgttgagggatgacggcgggctcgagttctgcttgagcgcggcatcttcttccaggtcggtgtcatcaatgagggggatgtggggctgggaatcttcgatccggaattcaggatgagccatgaagttatggatggaggttcgagattcaggcttttctaaaccttcatagagagagcta

SEQ ID NO: 22943 - DNA, 601 bp, Human
gcccagcagttaatagccctgaccatttcaaagctatttctatatgaccattaatcataaaaaaaaatttctaaaaaaggaacttaagcaattctacatcagtttaagaataatctgtgaaatatctgaccataaggacatattccagtccaacttctctgcccttgagtgtccactaaattaaggtcacagaaaaacccttccgaaccaaaacctgattctctaagacaaatcctccagatctagacctcactttaagcctgcaaaattgttatgaaaataatactccagaggcaggaaraaagactttgggctcgttcccccaccaccttcctccgcccccacacggaaaggcaaagtccctccctctgcagcaacgagtttgacctacagacaggcactggaaagcgctgctgaggtgaactaggcctcaacggccccctacatcctctgcagtactccaaccttcgcgtcgaccccaatccaacagagaggctgagagaaggtgggggaaagggccactcctggtctagggacaagagagtttgacctacaccgagtgaggcctgacagctaggcctcggctgctctgcctcgccct

SEQ ID NO: 22944 - DNA, 601 bp, Human
agaatacaggtaagacttcaatgacttttctggtaccatgaattctaaaaaagcaagcagtaaaaatgaatcagaaacttctgaattgactctttgctgtttggtcatttttaatacataagcaattttaataaagtttcatgctaatgaaattgtaacgcttgctaccttgaataaaatttctaataacagttacaaagagagtaagaactgcttttgacatttccattattgtagtgccgtaagtcaagtcagaaaaaagcaataaataccacacgttctttggcaattttaagtggaycaacaagtatattaggagcgtcacaataaacatttatcattcaaaatagcccagcagttaatagccctgaccatttcaaagctatttctatatgaccattaatcataaaaaaaaatttctaaaaaaggaacttaagcaattctacatcagtttaagaataatctgtgaaatatctgaccataaggacatattccagtccaacttctctgcccttgagtgtccactaaattaaggtcacagaaaaacccttccgaaccaaaacctgattctctaagacaaatcctccagatctagacctca

SEQ ID NO: 22945 - DNA, 601 bp, Human
tgctactattacctctccagtcctactagcctctggtcgagataacactgatgcagaaattggtctgtatgcaactctggatccagctcggatctattaatgaaaaaaaaataaagatttcaatattaagaaagaatacaggtaagacttcaatgacttttctggtaccatgaattctaaaaaagcaagcagtaaaaatgaatcagaaacttctgaattgactctttgctgtttggtcatttttaatacataagcaattttaataaagtttcatgctaatgaaattgtaacgcttgctacsttgaataaaatttctaataacagttacaaagagagtaagaactgcttttgacatttccattattgtagtgccgtaagtcaagtcagaaaaaagcaataaataccacacgttctttggcaattttaagtggaccaacaagtatattaggagcgtcacaataaacatttatcattcaaaatagcccagcagttaatagccctgaccatttcaaagctatttctatatgaccattaatcataaaaaaaaatttctaaaaaaggaacttaagcaattctacatcagtttaagaataatctgtga

SEQ ID NO: 22946 - DNA, 601 bp, Human
taacactacaggtgaccaccaggctgggctaatttttaaatgttttgtagaaacaggatcttactatgtggcccaggctgatcttgaactcctggggtcaagcaatcctccctccttggcctcccacagtgctaggaacacaggtgtgagccaccgcatccagtccaatagagtacatttttcaataactgtagctattataattttaaatataggcaacttaaatcaatagacttgaatataaatacttggccaagttttggatagagaaatttctctattcgtctcatctagttttttsgctatttttggctatttggctcatctagttttttggataaaagggtgggaaagacttgccctcaaactcttattaataaagtttttttccttcactctaatcaaaaccctacccttatttggtagtgttacctaatttcaattattgctactattacctctccagtcctactagcctctggtcgagataacactgatgcagaaattggtctgtatgcaactctggatccagctcggatctattaatgaaaaaaaaataaagatttcaatattaagaaagaatacaggtaagacttcaatg

SEQ ID NO: 22947 - DNA, 601 bp, Human
aaagggtgttgaaaattaagaaacaacatatataaatatgcttttaaataaagtagggttttttgttttgttttttcttaaaagagacaaggtctcacctggtctgtcacccaggctggagtgcagtacagtgtggtgtgatcatagctcactatagccttgaactcctgggctcaagccagctccccacctcagcctcctgagtagctaacactacaggtgaccaccaggctgggctaatttttaaatgttttgtagaaacaggatcttactatgtggcccaggctgatcttgaactccyggggtcaagcaatcctccctccttggcctcccacagtgctaggaacacaggtgtgagccaccgcatccagtccaatagagtacatttttcaataactgtagctattataattttaaatataggcaacttaaatcaatagacttgaatataaatacttggccaagttttggatagagaaatttctctattcgtctcatctagttttttggctatttttggctatttggctcatctagttttttggataaaagggtgggaaagacttgccctcaaactcttattaataaagtttttttcctt

SEQ ID NO: 22948 - DNA, 601 bp, Human
gaaccagccactcctactgttgcagcacctgcaccaataaatttggcagcagtatcaatgtctctgctgattgcactggtctgaaactccctttggattagctgagacacaccattctgggccccattaaataccgtagagccctggaaaacagaaaataaaggtaaaggtcgtatcagtaaccacaggtagctattttaattaaataccatattgtcaaaatgataactacttttttattttgtagctgagtgtaaagagacaaatcaagagcttagaataatctcactcttgtgtaacwgggataacaatatctacatcttaaaagggtgttgaaaattaagaaacaacatatataaatatgcttttaaataaagtagggttttttgttttgttttttcttaaaagagacaaggtctcacctggtctgtcacccaggctggagtgcagtacagtgtggtgtgatcatagctcactatagccttgaactcctgggctcaagccagctccccacctcagcctcctgagtagctaacactacaggtgaccaccaggctgggctaatttttaaatgttttgtagaaacaggatcttactatgt

SEQ ID NO: 22949 - DNA, 601 bp, Human
gtagctattatttcagtagctaagtttccaactactgcaagcatgctcttaacttatttagggatagaaatgattacctggcataaccaatgataaggctgccaaagactgttccaataccagcaccagaaccagccactcctactgttgcagcacctgcaccaataaatttggcagcagtatcaatgtctctgctgattgcactggtctgaaactccctttggattagctgagacacaccattctgggccccattaaataccgtagagccctggaaaacagaaaataaaggtaaaggtcktatcagtaaccacaggtagctattttaattaaataccatattgtcaaaatgataactacttttttattttgtagctgagtgtaaagagacaaatcaagagcttagaataatctcactcttgtgtaacagggataacaatatctacatcttaaaagggtgttgaaaattaagaaacaacatatataaatatgcttttaaataaagtagggttttttgttttgttttttcttaaaagagacaaggtctcacctggtctgtcacccaggctggagtgcagtacagtgtggtgtgatcatagct

SEQ ID NO: 22950 - DNA, 601 bp, Human
attctcataacatcccaaatggtgttatgagaattaagtgagataatgcatacaaagccctttaaatataatgcaagacacagagtaagcacttaatgcaaagtagctattatttcagtagctaagtttccaactactgcaagcatgctcttaacttatttagggatagaaatgattacctggcataaccaatgataaggctgccaaagactgttccaataccagcaccagaaccagccactcctactgttgcagcacctgcaccaataaatttggcagcagtatcaatgtctctgctgaytgcactggtctgaaactccctttggattagctgagacacaccattctgggccccattaaataccgtagagccctggaaaacagaaaataaaggtaaaggtcgtatcagtaaccacaggtagctattttaattaaataccatattgtcaaaatgataactacttttttattttgtagctgagtgtaaagagacaaatcaagagcttagaataatctcactcttgtgtaacagggataacaatatctacatcttaaaagggtgttgaaaattaagaaacaacatatataaatatgcttttaa

SEQ ID NO: 22951 - DNA, 601 bp, Human
tgtctgtcaatataaatggttagttttcattcattttgatgggttctgacattcttatccatctgaaaatatgatctataccttttaagatctgacagtttaggtcttaaataaaataaattgatccttttaaggaatgtgctctaataattttattcccaaaatagcttaacaattaggaatgcagactctgaagtcagacttagttaaaattcattttctgacatttactagctatgacctgggcaagtaatgtggcctctgtgtctctagtccttcatagatgttattctcataacaycccaaatggtgttatgagaattaagtgagataatgcatacaaagccctttaaatataatgcaagacacagagtaagcacttaatgcaaagtagctattatttcagtagctaagtttccaactactgcaagcatgctcttaacttatttagggatagaaatgattacctggcataaccaatgataaggctgccaaagactgttccaataccagcaccagaaccagccactcctactgttgcagcacctgcaccaataaatttggcagcagtatcaatgtctctgctgattgcactggtctg

SEQ ID NO: 22952 - DNA, 601 bp, Human
agaaggaaaaagccagccctcccctcttcccttctccctccacatcctccagctctcaggtgacgggggcccctcccagacctgcacagcttggtgtggggaaagcttgggagccagagccccaggcttccttgtttactgtcaacctagaggaggaggagagggaggggagggggagaggggaggggtggctgcaggggaaggctgagcagctctctccagctccagctggacctgaagtctcagagctgccaccagcagcaggctcagacactgggctcccagctggggactgctccayggccatggagatagacagcaggcctggggggctccccggcagtagctgcaacctaggtgcagcccgagaacacatgcaggcggtcacccgaaactacatcacccacccccgtgtcagtgagtagcccctccaccgtgacgggtgaggtcagggtggggagctggggtgggctgccaggttcccgggccccgcttcttgcctcagaaaaggaggaggacccaagacctggggagacctggagggctctctgtccagcagagtgacgcagtggggccacctggaccagaggccacctctgca

SEQ ID NO: 22953 - DNA, 601 bp, Human
tttactgtcaacctagaggaggaggagagggaggggagggggagaggggaggggtggctgcaggggaaggctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcagtgagtagcccctccacygtgacgggtgaggtcagggtggggagctggggtgggctgccaggttcccgggccccgcttcttgcctcagaaaaggaggaggacccaagacctggggagacctggagggctctctgtccagcagagtgacgcagtggggccacctggaccagaggccacctctgcaggtgaagggttgcaggtccccagcccagcccaccccagaagagagggctggggagtagctgtcatcagcccaatcctgctgtaacacccgaagtccagagatagcttccagttgcccctgagagtggggtgtgc

SEQ ID NO: 22954 - DNA, 601 bp, Human
tgtcaacctagaggaggaggagagggaggggagggggagaggggaggggtggctgcaggggaaggctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcagtgagtagcccctccaccgtgaygggtgaggtcagggtggggagctggggtgggctgccaggttcccgggccccgcttcttgcctcagaaaaggaggaggacccaagacctggggagacctggagggctctctgtccagcagagtgacgcagtggggccacctggaccagaggccacctctgcaggtgaagggttgcaggtccccagcccagcccaccccagaagagagggctggggagtagctgtcatcagcccaatcctgctgtaacacccgaagtccagagatagcttccagttgcccctgagagtggggtgtgctgtgc

SEQ ID NO: 22955 - DNA, 601 bp, Human
ctgcaggggaaggctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcagtgagtagcccctccaccgtgacgggtgaggtcagggtggggagctggggtgggctgccaggttcccgggccccrcttcttgcctcagaaaaggaggaggacccaagacctggggagacctggagggctctctgtccagcagagtgacgcagtggggccacctggaccagaggccacctctgcaggtgaagggttgcaggtccccagcccagcccaccccagaagagagggctggggagtagctgtcatcagcccaatcctgctgtaacacccgaagtccagagatagcttccagttgcccctgagagtggggtgtgctgtgcacctgctcttgtgtaaacgtgcctgtgtgaggagtgtgcacccaagcactca

SEQ ID NO: 22956 - DNA, 601 bp, Human
agacactgggctcccagctggggactgctccatggccatggagatagacagcaggcctggggggctccccggcagtagctgcaacctaggtgcagcccgagaacacatgcaggcggtcacccgaaactacatcacccacccccgtgtcagtgagtagcccctccaccgtgacgggtgaggtcagggtggggagctggggtgggctgccaggttcccgggccccgcttcttgcctcagaaaaggaggaggacccaagacctggggagacctggagggctctctgtccagcagagtgacgcastggggccacctggaccagaggccacctctgcaggtgaagggttgcaggtccccagcccagcccaccccagaagagagggctggggagtagctgtcatcagcccaatcctgctgtaacacccgaagtccagagatagcttccagttgcccctgagagtggggtgtgctgtgcacctgctcttgtgtaaacgtgcctgtgtgaggagtgtgcacccaagcactcagagtcaggcggggtgtgattaagtgtacttggagtggtgtgtgtggcagtgcagagtgtcagcgctctcagcctgag

SEQ ID NO: 22957 - DNA, 601 bp, Human
atcagcccaatcctgctgtaacacccgaagtccagagatagcttccagttgcccctgagagtggggtgtgctgtgcacctgctcttgtgtaaacgtgcctgtgtgaggagtgtgcacccaagcactcagagtcaggcggggtgtgattaagtgtacttggagtggtgtgtgtggcagtgcagagtgtcagcgctctcagcctgaggaaataggtgccccgtgtgcgtcacatcaatgggtgcatgtcgtatgtgtgttctgaggagggtgcctgtgtgcataagcaggtaggagcatgtgyctagggggtgctcccaccttcacttggggtaaggaaatgtgtgactgcatgcttatgcactcagggcaaaggtgtgtgtgtgtgcacttaggtgtgatgtacgtgtgtgcatgtgcactcatggagagaacacttgtgtatgtgttctggcagtgtcacatatctgagtatggtgagtgtgtgtacagctgggataagaatgcgtatccaggtgtggggcatggaagtgtctacaggtgctgggatgtacccttgtcaatttcagaggggaggccctacttgtggctcctgtgcctgtcc

SEQ ID NO: 22958 - DNA, 601 bp, Human
ctatgcagagccagaggctcctaacagggagtgtggtgtgaggggaagtgagcctgatgcagccaccccacctccctctgttcctctgttgctatccaggccaggagaggaggtggagtgaactcagagggtagctgaggggtgaaatcagagtaaaggggcccgggggcgcatgggaggagagccctggggtgtggggcacctcctgaggcctgaggcaggtgctgagggtggagcacattccagctaagaagaaatggtgagaatggggtgggtcagatttctcaagcaaggcctgtargccctgccccatggagctcgggggaggataggaggtccggatactccctaggccaaagctagggtcaccaaggcccagaaatatgcagtgactgggcccccttgggtccagagcccaggcctggagccctgagctggcatgtgtgactcttgccagtctgttgtgatgagccccactccctgcaggccgtccctcctccctgcaggcacccgggagttgctgggtgctgagtgtggtgtgtgatctgcaccttcatgctctgctttccttcttcctggaaagtgcccccacctcctgata

SEQ ID NO: 22959 - DNA, 601 bp, Human
cctaacagggagtgtggtgtgaggggaagtgagcctgatgcagccaccccacctccctctgttcctctgttgctatccaggccaggagaggaggtggagtgaactcagagggtagctgaggggtgaaatcagagtaaaggggcccgggggcgcatgggaggagagccctggggtgtggggcacctcctgaggcctgaggcaggtgctgagggtggagcacattccagctaagaagaaatggtgagaatggggtgggtcagatttctcaagcaaggcctgtaggccctgccccatggagctsgggggaggataggaggtccggatactccctaggccaaagctagggtcaccaaggcccagaaatatgcagtgactgggcccccttgggtccagagcccaggcctggagccctgagctggcatgtgtgactcttgccagtctgttgtgatgagccccactccctgcaggccgtccctcctccctgcaggcacccgggagttgctgggtgctgagtgtggtgtgtgatctgcaccttcatgctctgctttccttcttcctggaaagtgcccccacctcctgatacccagggaccctataggta

SEQ ID NO: 22960 - DNA, 601 bp, Human
gaggggaagtgagcctgatgcagccaccccacctccctctgttcctctgttgctatccaggccaggagaggaggtggagtgaactcagagggtagctgaggggtgaaatcagagtaaaggggcccgggggcgcatgggaggagagccctggggtgtggggcacctcctgaggcctgaggcaggtgctgagggtggagcacattccagctaagaagaaatggtgagaatggggtgggtcagatttctcaagcaaggcctgtaggccctgccccatggagctcgggggaggataggaggtccrgatactccctaggccaaagctagggtcaccaaggcccagaaatatgcagtgactgggcccccttgggtccagagcccaggcctggagccctgagctggcatgtgtgactcttgccagtctgttgtgatgagccccactccctgcaggccgtccctcctccctgcaggcacccgggagttgctgggtgctgagtgtggtgtgtgatctgcaccttcatgctctgctttccttcttcctggaaagtgcccccacctcctgatacccagggaccctataggtaccatctaaccccacactcct

SEQ ID NO: 22961 - DNA, 601 bp, Human
ccatgtttgcatgcttccctcgatgctggctctatatggcctccacccaggagaatgtgttcacaccaaacaacccaacagtggacccagagcaaaggtcagtgcaggggagcccctctaggctctgctccctgccagcgcctttacttttgctgcctatcaagtatcctcacaggatgcaccgggccagcctcagcccagcccagatgccctcccacccccaggggaaggctgggattccttggtgtgtcccttcatccacagtgtctcccaatcccctccccgcctcactcacttcctyctcaggctctgggagtgggagggatgaggggggtggttctccctggggcctgtggacaggcgcagggctggcaagggtttggaaatttagggctgcaccctcagtacgccagaggcagggccactctgtccctctccacctgtctcctccccagcctggcctcctaccctgggtctgtaagcactcccagacaggagaactctgggagaaaagctgggggtgcctaagggcagggaggccccagtgctcgctgggccacggtggaggtgagtccaggtgacttaggcattcccctccccc

SEQ ID NO: 22962 - DNA, 601 bp, Human
caggaaggacaagctggcagcctggttggagggatgaagccaggtcagatccctgaagatcccccaggagcttgagtgccaaaccactgtctttgcctccccacctcggtttcctcaactggaaggggaaggagttacacggagagagtcccaacaagcagggtcttgggctgaagagccctcagcttccagcccctgccctccctcctctaatccctccagcgggatcagggaggaggtgcgggacctgctgccccgggcttgcccccatcccggcctcacgcatgggcgcctgtctcakccctctcccaggacgctgcaggtgtggctgggccagcgctaattagtgggccgcgcgggggccccgctgagcctttgacagaaaaggcggtagggaggtgggggcagggaggcgctccaccagccagaagtccggagcgcaacccaaagtgtcagctaagacaatggagagggggtgggccgggcagctggagggagtgtctgcaaagtctctggaaggcccatggaaggagcgccctttgggtcttctgatccagccctctgcctgtggcaatgcacccgcttccctctccagggtcaa

SEQ ID NO: 22963 - DNA, 601 bp, Human
taagacaatggagagggggtgggccgggcagctggagggagtgtctgcaaagtctctggaaggcccatggaaggagcgccctttgggtcttctgatccagccctctgcctgtggcaatgcacccgcttccctctccagggtcaaggcgaacatcccagggttgcagagtgggccataatcgctgagcgctgcaggataccgtcttgaactgtggtgcgtcctgccagaaactagcccactttctgggcctcgttttgccactccatgcaagggacacacggaggtaggggcggcagtgtayaaacaaaaggaccggcttgcggtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgg

SEQ ID NO: 22964 - DNA, 601 bp, Human
ggccgggcagctggagggagtgtctgcaaagtctctggaaggcccatggaaggagcgccctttgggtcttctgatccagccctctgcctgtggcaatgcacccgcttccctctccagggtcaaggcgaacatcccagggttgcagagtgggccataatcgctgagcgctgcaggataccgtcttgaactgtggtgcgtcctgccagaaactagcccactttctgggcctcgttttgccactccatgcaagggacacacggaggtaggggcggcagtgtacaaacaaaaggaccggcttgcrgtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgt

SEQ ID NO: 22965 - DNA, 601 bp, Human
aggataccgtcttgaactgtggtgcgtcctgccagaaactagcccactttctgggcctcgttttgccactccatgcaagggacacacggaggtaggggcggcagtgtacaaacaaaaggaccggcttgcggtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgtgttcacccagagccaggcctggaggctgcgagaagcccaggaaggcaactcacagctgaggctgatgtgctaagatgttgagcttcgatatctcaccccggtcacccgagcggcctggccggggaaggcatctgactcccagaggacctgcagcaagcactttgcagctgc

SEQ ID NO: 22966 - DNA, 601 bp, Human
tacaaacaaaaggaccggcttgcggtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgawgggtccaggccatgaagcgatgtgttcacccagagccaggcctggaggctgcgagaagcccaggaaggcaactcacagctgaggctgatgtgctaagatgttgagcttcgatatctcaccccggtcacccgagcggcctggccggggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagtt

SEQ ID NO: 22967 - DNA, 601 bp, Human
gcttgcggtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaarcgatgtgttcacccagagccaggcctggaggctgcgagaagcccaggaaggcaactcacagctgaggctgatgtgctaagatgttgagcttcgatatctcaccccggtcacccgagcggcctggccggggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagttgctggatgtcagggcta

SEQ ID NO: 22968 - DNA, 601 bp, Human
ctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgtgttcacccagagccaggcctggaggctgcgagaagcccaggaaggcaactcacagctgaggctgatgtgctaagatgttgagcttcgatatctcaccccrgtcacccgagcggcctggccggggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagttgctggatgtcagggctaatggggattctacatgacaggggctgtgaagtgggggagcagctgtgaaggaagggaggaagttgaaagacttgtctcctgaggcagtggaattagaaatgattcc

SEQ ID NO: 22969 - DNA, 601 bp, Human
tctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgtgttcacccagagccaggcctggaggctgcgagaagcccaggaaggcaactcacagctgaggctgatgtgctaagatgttgagcttcgatatctcaccccggtcacccgakcggcctggccggggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagttgctggatgtcagggctaatggggattctacatgacaggggctgtgaagtgggggagcagctgtgaaggaagggaggaagttgaaagacttgtctcctgaggcagtggaattagaaatgattccctggactttt

SEQ ID NO: 22970 - DNA, 601 bp, Human
agacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgtgttcacccagagccaggcctggaggctgcgagaagcccaggaaggcaactcacagctgaggctgatgtgctaagatgttgagcttcgatatctcaccccggtcacccgagcggcctggccrgggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagttgctggatgtcagggctaatggggattctacatgacaggggctgtgaagtgggggagcagctgtgaaggaagggaggaagttgaaagacttgtctcctgaggcagtggaattagaaatgattccctggacttttctggtccttgg

SEQ ID NO: 22971 - DNA, 601 bp, Human
cccttgaccctgaaggctcagctcaaacggcccttcccataagatgcttcctccaagcgcacccagtctggtcttccctcccactctcgttcacccatcctgatctttcccttaggagcacccactgcagtttgtaattatgttatttgctctgtatccttcttttagcctgtaggcacttcacattttcatttgtcactttcatttgcctagcttagtacatagaaggcatccatgcagtagatatgcttgaagaaaggaagcagggagggaaggaagaaggcagatctcagaggaaagragaggaagaagtggagagccaggccaaacctcgaagtcctccagcacccaaaggtctgagagcgaggagtgtgagtcttcagaggaggctgacaggcggccccagagggaagcttccaaaggacagtgcacccaggctctgagtgtagccatcggaggccactgaagccagagtggagaaggccaaggagagggtggaaggtggggaaggaaagccagcagtggggggccatgcttgtgaggggaggaactggagaaggactgggactgagcgaggtttattttgtactggaaacatcag

SEQ ID NO: 22972 - DNA, 601 bp, Human
gccccagagggaagcttccaaaggacagtgcacccaggctctgagtgtagccatcggaggccactgaagccagagtggagaaggccaaggagagggtggaaggtggggaaggaaagccagcagtggggggccatgcttgtgaggggaggaactggagaaggactgggactgagcgaggtttattttgtactggaaacatcagagcttcatgggaagacaagagagggagagagagacagagagagaggcaaggaggctctggtccttcaccccatggagtcatctctagggcctgtttccyggtgcaggggaaggacccactatgaaggaagcagggacacctccttagtgggaataggaaggaagaagagggtggctcaggtgcaggccaggcaggtctgtaaggtaggtttgaaggcagggagctgagggagatcccctgctctggcaaagtgcaagttgaacttatcttctctggctgtcctcaaggcccggagttttccaaatggttgttacacttggaggatccttataaaaatctgtgcaagaatcaccgtgcccagttgatcttcctagtccaagtcctggtgaaaagagctta

SEQ ID NO: 22973 - DNA, 601 bp, Human
gggactgggtcagggagggccggaggaggagaagggactttgcctccagtctcactgtcacgtggctgctctcccctcctgccagtttgcccagtatgcggagatcgtccacttcaccctcccagatgggactcagaggagcgggcaggtgcttgaggtggctggcaccaaggcgattgttcaggtgagtggggtcaatgggacattggctagttaaatcaatgaattaacccataaagttcccacactatctacaaactctgaaggcaggaaatggtctatttccctgagagcacagaamgtgcccagaatgggtagccccattccctccagcaggccccttagtggagaaactccctcttgttcccacaggtgtttgaagggacatcagggatcgatgccaggaagaccacttgcgaatttacaggggacatcctacgaactccggtgtcagaggacatgctgggtgagggacagggaggggcaggggtgggggtgctcctctgccctcccagcccagcttctctgaccaaaccctcagcacactacactgtcacttcctgtttacttcctgcctgtctctctggtgggctctttgagg

SEQ ID NO: 22974 - DNA, 601 bp, Human
ctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcacttcacgtgggaagggttcatagggctggcaagcatagggacgagcacattaggtgtgctttgagcagtgaaagggacagtgagaggagcagtgagagggacgaaaccatccagaggacatgsagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggagtctgcctactcccaggaaccatggccctggcctaggggatgggggcaagggc

SEQ ID NO: 22975 - DNA, 601 bp, Human
aaagggacagtgagaggagcagtgagagggacgaaaccatccagaggacatgcagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggartctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgc

SEQ ID NO: 22976 - DNA, 601 bp, Human
aagtgaggagcttctcctgagaacaatttggggacagggggagcaaagcttgagtcctgctgtccaccactccctttttcttctccctcagatctacccccccatcaacgtgctcccttccctgtcgcggctgatgaagtcagccattggggaaggcatgacaagaaaggaccatggagatgtctccaaccagctggtaaggagaagagggtccgggggctggtaggtcctctagtttccgaagctgaaggcctgagccccatctgaaggacaagcttttctcctggcaaaattcctttcygaacggggtcccagtgtggccaggttgggggctactggactcccgtggtaagcccgcagcggccaccgacgccttgcccctcccccagtacgcctgctatgccatcgggaaggacgtgcaggccatgaaggcagtagttggggaggaggcgctcacctctgaggacctgctctacctggaattcctgcagaagtttgagaagaacttcatcaatcagggtaaggcgcgtcgctggtgtggagccagtaacctcttcaccctccttccgccccacacacattcctaacactccctcccgct

SEQ ID NO: 22977 - DNA, 601 bp, Human
gaatgtagggggagcccaggctggcccagggagcagttggcggtggaggccttgggcaatttcccgtgttcccactgagtggggctgtccctgggcctgggcggggacgccaccaactgccaaggcctgtgtataagggcagccgccgccttagccacagacctgccccgccatgacccggctgacagtcctggccctgctggctggtctgctggcgtcctcgagggccggtgagtgcctctctgtgccggtggtcccccatctgtgctagggcccggctgccagggcagaactcagactyaaagcacagagaaggcaagcggcttggcctgggtcacacagccagcccggcctggacgatcccgcgaaaggcgtgagggcggacggtgtgcgggactcaggggccccctgtcctcttagggagtgggacgatgggggagggtgggtccccccgcagccccactgggtggatagagctgaggctgcagcttcacacgccctcccggccactgtgtggattcttggggatctcagagctgtctccccccgacccaggctccagcccccttttggacatcgttggcggccggaaggcgaggcc

SEQ ID NO: 22978 - DNA, 601 bp, Human
gggggtcagatgggggaggcccagataagggaaggggctcagatggaggaggtgcagagaaggggagggggtcagatggaggaggctcagagaagggaagggggtcagatagaggaggcgcagagaagggaaggggctcagatggaggaggtgcagagaaggggagggggtcagatggaggaggctcagagaagggaagggactcagatggaggagggggcgcagagaagagaaggggctcagatggaggaggaggcgcagagaagggaaggggctcaagatgggaagggggccctggaargtctcggctctgcttctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggt

SEQ ID NO: 22979 - DNA, 601 bp, Human
ggggagggggtcagatggaggaggctcagagaagggaagggactcagatggaggagggggcgcagagaagagaaggggctcagatggaggaggaggcgcagagaagggaaggggctcaagatgggaagggggccctggaaggtctcggctctgcttctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaacccyggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccgcctgtgatcccagcacctcgggaggccgacgttagccagggaaacaagtccaaacttggtctctacaaaaaaatacaaaaattagccgggagtggtggcgcgcacctgtggcccctgtgcttcaggaggccgaggcggaaggacg

SEQ ID NO: 22980 - DNA, 601 bp, Human
tctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccrcctgtgatcccagcacctcgggaggccgacgttagccagggaaacaagtccaaacttggtctctacaaaaaaatacaaaaattagccgggagtggtggcgcgcacctgtggcccctgtgcttcaggaggccgaggcggaaggacggcttgaggtcaggagttcgagaccagcctgggcaacatggccaaactcagtctctacaaaaatatatatgtgtgtgtgtgtgtgtgtgtgtgtgtgtgtgtgtgtgtatcttgccgggtgaggtggctcatgcctgtaatcccagcattttggga

SEQ ID NO: 22981 - DNA, 601 bp, Human
tggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccgcctgtgatcccagcacctcgggaggccgacgttagccagggaaacaagtccaaacttggtctctacaaaaaaatacaaaaattagccgggagtggtggcgygcacctgtggcccctgtgcttcaggaggccgaggcggaaggacggcttgaggtcaggagttcgagaccagcctgggcaacatggccaaactcagtctctacaaaaatatatatgtgtgtgtgtgtgtgtgtgtgtgtgtgtgtgtgtgtgtatcttgccgggtgaggtggctcatgcctgtaatcccagcattttgggaggccgaggtgggcggatcacgaggtcaggagattgagaccagcctggccaacatggtgaaaccccatctctactaaaaatacaaaaattagccaggcatgg

SEQ ID NO: 22982 - DNA, 601 bp, Human
taacagagccagaccctatctcaaaaaaaacttccaaaaacaatacagcaacacatacagatgtaccacggttcgcgtatggagcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcrcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctc

SEQ ID NO: 22983 - DNA, 601 bp, Human
gcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttmatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcaccc

SEQ ID NO: 22984 - DNA, 601 bp, Human
gggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacrccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtagg

SEQ ID NO: 22985 - DNA, 601 bp, Human
tccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcrcagtggggggcgtctctcccgttttcccaggttcgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgccc

SEQ ID NO: 22986 - DNA, 601 bp, Human
acaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttygtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctc

SEQ ID NO: 22987 - DNA, 601 bp, Human
gaaaacacacttgaagcgggagacccagcacatgcagtgttcaagaggattcacaaacagcacaccctaaaccagcacatcatcccaagatggaaggcctgtaccaataagcagatttttaactggggtgggataatagaggcacagcaatttgtgccatttaattcttggtccctatacataataaagtggtctatatgctatttactgggtattttaaaaactcaaatttatccgaacaagtacatgggttatggtgaatttggaaaggaaagcttttattgcttttttttcttctgaraaattaactttgctttatttggccccacaataaactctgagaaatgtaccaaaacatgtttaaaccacttatttattggtatttggagatttctgtgggaaactatgagcgttctgataagttttatagccattaggaagcatgctatattattagattcatggaatagtctataaatatgtaatatttatgaagctagaggttacaaagtttcttgcatcctctatatttgctgcaatctttcagtccatcttatctccagcttgttgtggcaacaaggtaataacccatgcctaaact

SEQ ID NO: 22988 - DNA, 601 bp, Human
atgttttaaaattttaaaaggcatatggattggaaagcactaatagtattatgtttaagggctcatgagtaactaaaaattcagactcattcttcaaagaaatacagattatctgtccagttaagtatagtgatgagaaaaatgatagctagttaataattagagctataagataaggctgaagcagtatgtagaagtcagatcacagaaagttttgtctaacatttgttcatctttgagtgcttagtattgccaggttctatgataagcattttgcatgcattatcctttttttttttttgctttgtcacccaggctggagtacagtggcaggaacatggctcaccgcagtctcaacctcccaggctcaagcgatctttcctcctcagcccctgctaagtaagtgggactacaggtgcctgctaccacacccagctatttttttagtatttatagagaaagagtttggctatgttgcccaggctggtcttgaactgtcggcctctattaatcctcccatcttggcctcccagagtgctagaattacaggcttgagccatcacacccagccagtccctttttaaaaaataaccataatatc

SEQ ID NO: 22989 - DNA, 601 bp, Human
aaaaaaaaaaaaaaaggaaaggaaagaaaaaatattgggcaattaacaaggtttaataaactccaactctatcccatatcatagtagcaaagcacatgttttaaaattttaaaaggcatatggattggaaagcactaatagtattatgtttaagggctcatgagtaactaaaaattcagactcattcttcaaagaaatacagattatctgtccagttaagtatagtgatgagaaaaatgatagctagttaataattagagctataagataaggctgaagcagtatgtagaagtcagatcayagaaagttttgtctaacatttgttcatctttgagtgcttagtattgccaggttctatgataagcattttgcatgcattatcctttttttttttttgctttgtcacccaggctggagtacagtggcaggaacatggctcaccgcagtctcaacctcccaggctcaagcgatctttcctcctcagcccctgctaagtaagtgggactacaggtgcctgctaccacacccagctatttttttagtatttatagagaaagagtttggctatgttgcccaggctggtcttgaactgtcggcctct

SEQ ID NO: 22990 - DNA, 601 bp, Human
aaaaagaaaaaaaaaaaaaaaaaaggaaaggaaagaaaaaatattgggcaattaacaaggtttaataaactccaactctatcccatatcatagtagcaaagcacatgttttaaaattttaaaaggcatatggattggaaagcactaatagtattatgtttaagggctcatgagtaactaaaaattcagactcattcttcaaagaaatacagattatctgtccagttaagtatagtgatgagaaaaatgatagctagttaataattagagctataagataaggctgaagcagtatgtagaartcagatcacagaaagttttgtctaacatttgttcatctttgagtgcttagtattgccaggttctatgataagcattttgcatgcattatcctttttttttttttgctttgtcacccaggctggagtacagtggcaggaacatggctcaccgcagtctcaacctcccaggctcaagcgatctttcctcctcagcccctgctaagtaagtgggactacaggtgcctgctaccacacccagctatttttttagtatttatagagaaagagtttggctatgttgcccaggctggtcttgaactg

SEQ ID NO: 22991 - DNA, 601 bp, Human
atttaattttatttcaattcttattaaaaaaaaaaatagaggccaaggcaggtggatcacttgaggtcaggagttggagaccagctttcccaatatggcaaaaccccgtctctactaaaaatacaaaaattagccaggtatggtggcacgcgcctatagtcccagctactcaggaggctaaggtaggaaaattgcttgaacctgggaggtggaggttgcagtgagctgagattgtgccactgcctctagcctaggtgacagagcgagactctgtcaaaaaaagaaaaaaaaaaaaaaaaarggaaaggaaagaaaaaatattgggcaattaacaaggtttaataaactccaactctatcccatatcatagtagcaaagcacatgttttaaaattttaaaaggcatatggattggaaagcactaatagtattatgtttaagggctcatgagtaactaaaaattcagactcattcttcaaagaaatacagattatctgtccagttaagtatagtgatgagaaaaatgatagctagttaataattagagctataagataaggctgaagcagtatgtagaagtcagatcacagaaagttttgtct

SEQ ID NO: 22992 - DNA, 601 bp, Human
gatttaattttatttcaattcttattaaaaaaaaaaatagaggccaaggcaggtggatcacttgaggtcaggagttggagaccagctttcccaatatggcaaaaccccgtctctactaaaaatacaaaaattagccaggtatggtggcacgcgcctatagtcccagctactcaggaggctaaggtaggaaaattgcttgaacctgggaggtggaggttgcagtgagctgagattgtgccactgcctctagcctaggtgacagagcgagactctgtcaaaaaaagaaaaaaaaaaaaaaaaaaggaaaggaaagaaaaaatattgggcaattaacaaggtttaataaactccaactctatcccatatcatagtagcaaagcacatgttttaaaattttaaaaggcatatggattggaaagcactaatagtattatgtttaagggctcatgagtaactaaaaattcagactcattcttcaaagaaatacagattatctgtccagttaagtatagtgatgagaaaaatgatagctagttaataattagagctataagataaggctgaagcagtatgtagaagtcagatcacagaaagttttgtc

SEQ ID NO: 22993 - DNA, 601 bp, Human
tccattacctcacaaacttaccatttctttggggtaagaacatttaaaatctaatcttttagcaatttggaaatatacaatacattattattaactatagtcaccatgctgtgcaacagatcaccagatcttagtcttcttgtctaacagaaactttgtaccctttgacctacctttctcccccacccctcccaatcctatatcttaatatataagatagagagcgacagttatgttaaggaaagatgggaactcagagtggatttggccatgaaagataaagtaaaagcaagtataacaygaaagaacaaaaaagcatgactcatatctgtgcaggctttttaatatgtttctgtcccttgccaaaacagtaactcttgttacaacttctaccacaaaatttgggatcaggaaattatgagttcttagaagttacttaaaatcaacacatagagaaataagacctgcaagaaagatctctgttctatcatcctgcagaagagacaatgtgaagtaggtttaatggaatttctcagagtctggggaaaaaaatctggtttccaggcctggattaatcattaactagctatctatgtgacac

SEQ ID NO: 22994 - DNA, 601 bp, Human
ggataaattctgatggatcctaatctatttccctttctcagcctctcttccaaggccaacatattctacctaaggactttttttgccccccgtgcaaactgacacagaatcatgaagagaaagcctatgtttatgatcattcttttcagactaggatgctggcctgttgacttaattcctgaaactgccagagtcattttgtgaccttcagagtaaggctagaaaattgcagaaatgtcaatctaatctccttgattgaaaactacactgagtttctaagccaaagtttgaaccacctatsaccaaacctgttatgtaagagaataagataccttatgctgatgtttaagccaccatcagccacttttctgagaaatgtagccaaaacattcctaatgtattcaccataggagaaactcatgcaaaaactgagaggcaatgaagagcaaggcatttagaggaaccacaagtcattcttcattattttaatttagagtataaggtgggaaataacataataagtctgaaacagaaaacaccaactttatggtgcatagctttgaaagatatattaagcatcttcagtttttttcctaactaa

SEQ ID NO: 22995 - DNA, 601 bp, Human
cttcagaggaaagggcaccttgtaggaagagactgagaaagaaagtgagatcagtaggatagagttgaacagaggattctagatttgctttgttttttccaaaagttttctcattgtggagaaaaatgtcataaaggaggcttggctcagcttcctccctcattgtcagtcatcaaataagcatccttaaattatctatcctacggcaagcactgggagtcacagagagaaaaggaacaatctcttgtcattaaggaactcactgccagatgaagacacaggaggaaaaaaaaaaacacamcagatgattggagcatcataaattctatgatatgagaatgtatgtaggctagactgccaacccagattagcagggaataaaggcaggatcaaagaaaggctctcagaggaaatgggctacaaaacaaatgagtcttcgtattaaaaaatgaaagccaagcctggttaacatagtgagaccctatctctacaaaactaaaaaattagttgaatatggcggtgtgtgcctgtaggcccagctactcaggttgaggtggaaggatcacttgagcccaggagttcaaggctttagtgagctatg

SEQ ID NO: 22996 - DNA, 601 bp, Human
ggtatttggttttatatctgttactttggtgctattcttgtttgccttttcttatttttgccagtgtactatacctcagtcctatttagaagacctgatggaaagaaaagtcatgtaaataataagtaaaatgatttgttttatgatttattcaccatgtccagtttggttagcttgttatgcagtataagtgaaatatcaggtttttaccctatgctctttttaatcattaaaattaatacaaaatgtgtgtgtggcagctgggggagacattccgccatgaaaattgagagaaggtccyggtaaagagatttgcttctttattttctaggaatatctagtcttcttagagttgactggtcacatctggaatgaggtgcttcctgagaaatctctggatctccttccaagcatgttcctgtgcagctgcgtgtgggatcacctctcctccccagtgtaacctcaaatcgtgggtcgttgaggcacagcacagaggagaatagggaggttctatcaggtggcctgccccagggtaagatagcagggtccagttgttcttcccatgtctcttcagctgtcctatggcttgttcagcgtgtgc

SEQ ID NO: 22997 - DNA, 601 bp, Human
ctgacagccgccggggcagcaagagaaaatgcctaccaagctcgcggcgcaggggccggttactgggggaaagggaggggtatccctctggatgacaccaggcttgctcccttgacagatggactaacccagaaactcacccaacttcaacgcctgaatacgcagagcgctcagcctggcgggctgacaccactccagggctactcgctattatcaagaggaagcctggaaacgcaggcggggccactgcccaggaagaggggagggcgggccccgggctgggccgggcgcgggcaccgasgccaggcagctccagtccgggccggaagccggaatcccctcccaggcggcgcgcggcagcagccgcagcaggtgggcgggcccgcgagccgggaggaccgctgattggccgcggccggcgcgccctctgacctcacgccgacgccagcggcgccctcctcccgccttctcccgcacccccctcccccagcgccggccggtcggctcccacctgacccgccagtcccacgctcctcagggcctggatccgcgacccccgccagccccctaagctccggcccctcaccatttccgcactttc

SEQ ID NO: 22998 - DNA, 601 bp, Human
taaacaggggctcaatcggcatcttccatgaacattttagacacggggtctctctccgtagcccaggctggagtgccgtggcacgatcatagctcactgcagcctccaactcctgggtcccagcaatcctcccaccacagcctcccaagtaaggatgtgcactttaaaaagaccactctgctacttggaagtgagaaaaataaaatcacacagtgcaaatgatgaacggactggggaatgaacaagagcagaagcagggaaattagagggaggctggtacatagtttgcaaaggactctcytgacagccgccggggcagcaagagaaaatgcctaccaagctcgcggcgcaggggccggttactgggggaaagggaggggtatccctctggatgacaccaggcttgctcccttgacagatggactaacccagaaactcacccaacttcaacgcctgaatacgcagagcgctcagcctggcgggctgacaccactccagggctactcgctattatcaagaggaagcctggaaacgcaggcggggccactgcccaggaagaggggagggcgggccccgggctgggccgggcgcgggcaccgag

SEQ ID NO: 22999 - DNA, 601 bp, Human
aatcacaaagttcaattcaacatgcagatttcaaagaaaagggagctttctagaaactgagctgaaggggtactgtgggggatgggtactgttgtcagaacctcaaattcttgctggggcagtttgtgacaagaggcagggatgctggaatgacaggtagaggtgagaacaaagctgcgtgtgtgcagatgtgtgtgctgagggcaggggatggggacggcggccacaaagggctgtcagcagctagggtgcccgtgagaggtaggaccacctcaggcatgggcagagctggcaggacagsaagaaatctagacggactctctgcccttgtgtggagaaaagcccttcccttccctccaatgtctctacccagtcctccaacagcagcctacagggcccccagtcctaggggaaagtccgggagtctacagtctccgttcaagttcaagtaacctgaggcacgctctcttctagaaggtgccttccacatctctctcttctcgcagaagctgccagcagctccgtccagagattctggagcagagactgctgcctggaggtcacagatgaatcttggggtggccgatgctccagccaactt

SEQ ID NO: 23000 - DNA, 601 bp, Human
tcttcactcactgttgcccatttccattttcttaaacttttttgaaacaaaaaataaaatcacaaagttcaattcaacatgcagatttcaaagaaaagggagctttctagaaactgagctgaaggggtactgtgggggatgggtactgttgtcagaacctcaaattcttgctggggcagtttgtgacaagaggcagggatgctggaatgacaggtagaggtgagaacaaagctgcgtgtgtgcagatgtgtgtgctgagggcaggggatggggacggcggccacaaagggctgtcagcagytagggtgcccgtgagaggtaggaccacctcaggcatgggcagagctggcaggacagcaagaaatctagacggactctctgcccttgtgtggagaaaagcccttcccttccctccaatgtctctacccagtcctccaacagcagcctacagggcccccagtcctaggggaaagtccgggagtctacagtctccgttcaagttcaagtaacctgaggcacgctctcttctagaaggtgccttccacatctctctcttctcgcagaagctgccagcagctccgtccagagattctggagcaga

SEQ ID NO: 23001 - DNA, 601 bp, Human
gttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaggggacccaggagagggagcgagagagtgccctggaaggcccacggaggggagcgycccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggacc

SEQ ID NO: 23002 - DNA, 601 bp, Human
tgctcagcccccctgcccccgtgccagaaaggctcccggggaccagcgcccaggggtgcgggtgagcacctcctggtgacacccagccgccggtgccagccgcaccccaggagagctggtgtatgagcatgggtgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccrtggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtc

SEQ ID NO: 23003 - DNA, 601 bp, Human
agggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggakccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcactgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctc

SEQ ID NO: 23004 - DNA, 601 bp, Human
tgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcrgggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccc

SEQ ID NO: 23005 - DNA, 601 bp, Human
tggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttcccccyaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttcccct

SEQ ID NO: 23006 - DNA, 601 bp, Human
ggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgrgaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgact

SEQ ID NO: 23007 - DNA, 601 bp, Human
tggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggacaccccctctttctcygccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcggaggcgtgggggcctgcagactt

SEQ ID NO: 23008 - DNA, 601 bp, Human
ctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggacaccccctctttctccgccctgcctccctaccttggccttrgagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcggaggcgtgggggcctgcagacttgctgatgaggagacatttcatcgcc

SEQ ID NO: 23009 - DNA, 601 bp, Human
tccaaggacaccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcrgaggcgtgggggcctgcagacttgctgatgaggagacatttcatcgcctgattaagccaagtcctgtccgggatggggaggggggtagtggaagcagtgaagggagtggagtggaaggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctga

SEQ ID NO: 23010 - DNA, 601 bp, Human
ctccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcrggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaagggggcacatgctggtcctgtgggacggtggcgagcatgatgtaagtgtaggaggggtccagccgtctggctgtgagctgtgcagtttgtgcccacttgtggtggcatccccgtgtgcccgtcagtgtccctg

SEQ ID NO: 23011 - DNA, 601 bp, Human
tgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaagggggcacatgctggtcctgtgggacggtggcgagcatgatgtaagtgtaggaggggtccagccrtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacat

SEQ ID NO: 23012 - DNA, 601 bp, Human
ggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggctkggagcggcaaggcagtggtggcactgctggggctcaggaccgggcctgggtgctgcctcctgccctgcactctgctcacaagcatggactgacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtgga

SEQ ID NO: 23013 - DNA, 601 bp, Human
tggactgacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagygggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggg

SEQ ID NO: 23014 - DNA, 601 bp, Human
ctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtaggktgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcag

SEQ ID NO: 23015 - DNA, 601 bp, Human
gctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccwccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagt

SEQ ID NO: 23016 - DNA, 601 bp, Human
ctcccaatgtactttcatctattgacactgagagaggggcagtgaccaggcagcctggagatgcctattaggaaggaagagtaggagaaagttgtttctgtccccacccctctacccctacaggggaaaggaatctcctagtgatgagggtgagagacttgaaatacatcagcactgcagtgagcaggacaggtttcattactgcttttttacttctgaataaattatttctgtggctgttagggatggggaggctgaagttggttgtgtgggttgctgggcttcaaagttcagggtagartaagtaacttcattcatctgaaaagcacaaataatgatcagttaagtcagtgacacagggcagggcctcaccttgcctggtgtgattcagcaccacaagctgttaccattttgaaattttagctctggagaagggcttttgttgttacccattctctgcttgctgacctcctgatgaatgatcattagaagagagaaattatggtatatatgcaatgggataggataatgcagcaatgagaaccagcaaaccacaaatacatacaatatggatgagtctcacaaagcaatgttgaagaag

SEQ ID NO: 23017 - DNA, 601 bp, Human
gagaggggcagtgaccaggcagcctggagatgcctattaggaaggaagagtaggagaaagttgtttctgtccccacccctctacccctacaggggaaaggaatctcctagtgatgagggtgagagacttgaaatacatcagcactgcagtgagcaggacaggtttcattactgcttttttacttctgaataaattatttctgtggctgttagggatggggaggctgaagttggttgtgtgggttgctgggcttcaaagttcagggtagaataagtaacttcattcatctgaaaagcacaartaatgatcagttaagtcagtgacacagggcagggcctcaccttgcctggtgtgattcagcaccacaagctgttaccattttgaaattttagctctggagaagggcttttgttgttacccattctctgcttgctgacctcctgatgaatgatcattagaagagagaaattatggtatatatgcaatgggataggataatgcagcaatgagaaccagcaaaccacaaatacatacaatatggatgagtctcacaaagcaatgttgaagaagccacatataaggatatgttttatttctcctt

SEQ ID NO: 23018 - DNA, 601 bp, Human
taattatgatttagcacttttcagtatgtatgtttgctctattgaaaaggtaaaatgaaaacttcttttttttttgagacagagtttccctctgtcgcccaggctggagcgcaatggcgcaatcttggctcactgcaaactccacctcctgggttcacgccattctcctgcctcagcctcccaagtagctgggactacaggcgcccgccaccacagctggctaatttttttgtatttttagtagagctggggtttcaccatgttagccagaatggtctcgatctcctgaccttgtgtttcrcctgccttggcctcccaaagtgctgggattacaggcatgagccactgtgcctggccataaaatgaaaaattctataaaattattattaaaaaacaggatctcagatctattaaaattgaaattatccttttgacaataagagcaggatcagactgaaggtaggggagtgagaatgattcagtgccttccttttttaggccattgtgctgggtgctctttgtaggttatctcgtttaatcccttcaacttctctttgaagtaggcagaatgcccattttacagatgacaaagctgatgatc

SEQ ID NO: 23019 - DNA, 601 bp, Human
gagtgaccctctggatatctctatatctccacttggaatcttcttctcagcgcacagaccgagcaacctcatcatcaggtagaatgtttttcccactgactttttttttttttttttcagacggagtctcgctctgtcacccaggccggaatgcagtggcatgatctcagctcactgcaagctctgcctcccgggttcaagccattctcctgcctcagcctcccgagtagctgggactaaaggcatgtgccaccatgcccagctaattttttgtatttttagtagagacggggtttcaccrtgttagccaggatggtcttgatctcctgacctcatgatccacccgcctcagcctcccaaagtgctgggattacaggcgtgagccactgtgcctggcctcccactgaccctttcctggagctgtgatcaggcatccttcctgtgactgtcactttacatacaaaagggaaggtagtgttttttttcattaaataattttttagggaatgatgatgccccatccagtcttcatgaccttactatctggagttccaatccgaaggatttcccactgtaaagaggagttttacttcctggtctg

SEQ ID NO: 23020 - DNA, 601 bp, Human
accttctgcacacacctgcgtcctaccccacatggggtcagggcagagccaatcaccgggcaagccgggagtagagcagggagcagagtctgagctgctcatccctgatgaagggcatttccttctctcatttagggaaaactattgtgagtctgttttaaaacctcacatattccttatatctcatggaataggtaaaagaaggccaagaagttacagaaagggacatgttagtgacagaagcaaattgaccttgaggaccctttctgcttccccctctgtgaagcccctcctgctacayggggctttctggggctgagagaaccccctccccacattccaggctggacctaaggtcagctgtgagaaatcagaaaaacaaagggaagagagtctgcacagatgaattgagagggttcaggggagaatttggacttgtttgtgcctgttggatacaggctgcaaaagaaaatttcttctctgctcctatttgaaaaccagaaagcttgtaccccagatcttagtgttgatgctccaggaattacttaccagtgactatgatcgtcttgactgtggtcctgttgcagccagtgactgagtt

SEQ ID NO: 23021 - DNA, 601 bp, Human
tattttagccaggatggtcactgttagccaggatggtctcgacctcctgacctcgtgatctgcccgcctcggcctcccaaagtgctgggattccgtccgggcatttttcaatcagagttggcatctccccacctctcagccaacccaagtccctaaaagcccatggcaagtgtgtgtttcacaagacagatgtgcaatgatctgagggctcagagaccgtgaggccgcctgctctgtgtgagagaagcacagactttctcaagtgtgaactgagcagcagtgttgggtcgtggacagaccsaggactgggagtcacagccccaggcacttctggtccttccctgactggctgatgcctgcctgacccacctgtgggtcctcacctggaacatacaggtgctgggtcccttccagcttcacagtcctactttgccccactaggtgtgttttctctgcagcttccctgtctgaggacatcctagagatgggtgatgatgggacttcctattgtccttaaaccctgaggatactgagcagcctggcctgggactgtatgtttcagcagaaataacaggggacaccaggggcaagcctgaaggta

SEQ ID NO: 23022 - DNA, 601 bp, Human
tggggcagtttttcccaggtgtttgatgatgactgacttgagccagtgaccccctaaagatagagcagagtccaaggaatgatctagaaaagagtgagggtgacaggcaggggctgcctggatttaacagcatatctacgttccttgtctttggtctttaatgtcccttttccccctgaaaagagcagatgatgacactgtggatcttttctgaaatatgtgggttttttgcaaatgcagaataaccagctagtggaacggaaggagcatgaacttgctgaaagcctgaccctcatggactgtgtgtgtttggtagatctgggatataaatttgagaagttaaattattccatttgtgaaaattgttattaatactctggatctaacaccaattaataagaggaatattctctagagagcgtgataaactcttaaaccaagctctgaagtccagtaggatcatgttatgatcaaagaaagatgctgaagtcagtttgaaatcagtgactccctgggtagaagggactcatgggtcctgttaggaagacagaacttgtcagaaaggatatctgagagttctcaattgcattaagagagaaac

SEQ ID NO: 23023 - DNA, 601 bp, Human
gtaggatcatgttatgatcaaagaaagatgctgaagtcagtttgaaatcagtgactccctgggtagaagggactcatgggtcctgttaggaagacagaacttgtcagaaaggatatctgagagttctcaattgcattaagagagaaacgatgccatatgaggagaagtgatgtatgttatgttagtaaatttagaaagagttctatgttacaaattcctgtggaaattcaggtaaaaagaggaacccaaaacagtcatgtgaaatgctttcttccttttctctcaacctcaggaaacacarctagagtttgaccaaattcatccaaattgggcagagtctaagtgagacaccagtggctaatgcatctccctgtctgagagatcccaccttatgacaatggtgtcatcatgaggacacaggtgtaggtggaatgggcagcaaacccatcagacagcacctgcctggctagctctacctggggaaggtcccaggaaccactagaggatgtgagcccacagcagaacagggatggagttaggagtcaaatgggtgaaatgagcccatgggctttggggactgcagacctgtccttctgcctct

SEQ ID NO: 23024 - DNA, 601 bp, Human
ccaaataaacaatcttattttattttatttttttgagatggagtctcgctctgtcacccaggctagggtgcagtggtgtgatcttggctcactgcaacctctgcctcccaggttcaagcaattctcctgcctcagcctcctgagtagctgggattacaggcacgcaccaccatgcccggctaatttttttgtatttttagtagagacggcatttcaccatgttggtcaggctggtcttgaactcctgacctcatagtccatccacctcggcctcccaaagtactgggattacaggcgtgarccaccgctcccggccgcagcatctattgttgttggattccctgagagtgcctctcagcctgatccctggtggacaaggagctttcaggagcatcctgtctcctctgttcctcctcctggggatggtaaacttcctatggcatctcctaagcccccagggcagttggctgatggcctggggagcttgtccatctgtcctctccaggctgagactaaggtgaaggatgaggctccatccttgcccaaatgaggctctagtgcctgaaccctggctggttaccagctccaggagccacagccc

SEQ ID NO: 23025 - DNA, 601 bp, Human
acacctgacctcacattctagatctctttgcttgtctgtcttccccacccatgagagcgtgagctccgtgagggcagggatttgtgtgatgttggttgcaccccagtgcctgggataggctgcagactcctgtggatgagttagtgagcattcccagggctcttcatgtcctggggtttatttgccaatatctgaggttggtggctcagggctctgtttaatgccccttttaaaatgttttccttaattgtcacgctgacttaaattgtgattattgtcagcagtttttgaaatttattgstcattgatgattcagttggaaaaggtaaaaaatgggagattgtttattcactaacagtttcagatcactgagactttccttttatgatctctatccctttcatgtcctctctcctatttggctccaagagaagccctctgtcccctcttagagctccatcctccccagaggaccctagccattctctgtgcgccctctttccgccccttcccagggtgtcctcccctcacctgtgagcagaagcccctgccagggtacacgcactctgtgaagtggggctgagaggtgccccatggtgtc

SEQ ID NO: 23026 - DNA, 601 bp, Human
catggaggtttgctaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgcyacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggtgaggccctgcgtcttccgggttctttatcgtcttcctttaaattgtgcaaatggtgctgtaaggcctgtagtggggcaagcaagcaaggacattgctgtgggtgccacag

SEQ ID NO: 23027 - DNA, 601 bp, Human
cctcccggaaggggccagggatcccctctgtgcagaagatctgaggccccgctctctcatgtcctctgtctgctgtgtgtctccgacaggatggggctggtaagtagcaaaaagccggacaaggaaaagccgatcaaagagaaggacaagggccaatggagccccctgaaggtcagcgcccaagacaaggacgccccgccactgccgcccctggtgagtgattgcccacccccaccaagagcagattacttacttctcctatgccttaatgtccaagtttgtaaaatgggtatagcaaaaktgccttcctgatagggatgtaacgatctgcaatgtataagcaggtgtgccatgcaatataacacgcacaggacccggcctggttagctcccaataattcttagccagagctcatttctcgagggcagccttgaaaagaaaaagaaatgtaaaaaggtcagcttggggagagggtgtcgtaaggaaggatccgggtatctagctgcagctactacctctcttctccccagcagctcctggagacccttgtcccctatgtggcattgctgctggcattccaaagagcctgctttcctgggat

SEQ ID NO: 23028 - DNA, 601 bp, Human
tcagcgcccaagacaaggacgccccgccactgccgcccctggtgagtgattgcccacccccaccaagagcagattacttacttctcctatgccttaatgtccaagtttgtaaaatgggtatagcaaaagtgccttcctgatagggatgtaacgatctgcaatgtataagcaggtgtgccatgcaatataacacgcacaggacccggcctggttagctcccaataattcttagccagagctcatttctcgagggcagccttgaaaagaaaaagaaatgtaaaaaggtcagcttggggagagrgtgtcgtaaggaaggatccgggtatctagctgcagctactacctctcttctccccagcagctcctggagacccttgtcccctatgtggcattgctgctggcattccaaagagcctgctttcctgggataagcatcatgaaacaggagggtgcctgtcctcacctcccgagcaggctcttaagttttcctggaatcccatgggcattttaaatgaggaaaactttccaaaggaaaaaaaaagtgaaatttcaagtgaaaaggtcttattgctggggaatgcattttcctagtcatgcagtt

SEQ ID NO: 23029 - DNA, 601 bp, Human
cgtgccgggcctgaagatacatttttagatgattctttgtgctctctccactccctgaccagtgacccccttttggtttggggcagttgggagccttgccgcgaccccctctcctgtgctgtccacatgtccacgtggtcatctctttatcctaacagggacctgatggggagacggggattactaatcccacttcctagatgaacccaggcatcttacctatctctgtcccagtttagcgccggtctcagcgcacaaccacaagatgtttattgaataaataattgatcaaatggggaarcttggacttagactgattgagtaatttccccaaaattatatgataataagtagtagcacctggaatttttttcacttaaaagagtcacataatatgtatatggaaaaaattataattactcattattccactatgtagagtcaccagagttgcctcgagacccttcttccgtgtgttcatttcatgtgttcctatttttaagagaaacatacatgcacatcattttgcaaaatgctacttcaaaattgtgttcaataaatatggaattaagaaaagaatatttgtaacatatgtcaggtt

SEQ ID NO: 23030 - DNA, 601 bp, Human
taccctggctgcccggctcagcagtctcaacccccaggccccacccacgcagcagggactgaaataactcaagtgtgtgttttctacccaaggttgtcttcaaccaccttactcctccaccgcccgatgaacacctggatgaaggtaagaagggtggtttgggaagctgaggctccacagccctctcccctaggtggcagctttgtggagttggaaaaaggttgagtcaggagcagcttgagggctggagaagagaaaacggggaagctgagagaggccccggctctgtgcctcttggggsgtctcttcaggaaccaagaacaagtttcttcagtatgcctgagcctgggtgggacttttaaaacatgaaagactttacaaactgtaaacaagaacaaaaacaagagtcccagggaagacacacagcatcatcaaacccaagttttaaaatatgctaactctcaaacgcaaagggctgggccagtggctccaggcccttgcctccagcccctgtccgctctatgtggagggcaccttcttgtttcccgctcccagtcacttcgagagtcccgctgctgaccacctaaccacccacgcccct

SEQ ID NO: 23031 - DNA, 601 bp, Human
gtttcttcagtatgcctgagcctgggtgggacttttaaaacatgaaagactttacaaactgtaaacaagaacaaaaacaagagtcccagggaagacacacagcatcatcaaacccaagttttaaaatatgctaactctcaaacgcaaagggctgggccagtggctccaggcccttgcctccagcccctgtccgctctatgtggagggcaccttcttgtttcccgctcccagtcacttcgagagtcccgctgctgaccacctaaccacccacgcccctccctggtccccagactccacttgkttttttttgagacagagtctcgctcttgtcacccaggctgcagtgcagtgacccaacctcagctcactgcaacctccacctcccgggttcaagagattctcctgcctcagcctcccaagtagctgggattacaggtgcacacaaccacaccgggctaatttttatgtttttactagtgagggggtttcaccatgttggccagattggtcttgaactcctgacctcaggtgatctgcccgcctcagcctctcaaagtgctgggattacaggcgtgagccactgtgcgtggcccctagactc

SEQ ID NO: 23032 - DNA, 601 bp, Human
agctgggattacaggtgcacacaaccacaccgggctaatttttatgtttttactagtgagggggtttcaccatgttggccagattggtcttgaactcctgacctcaggtgatctgcccgcctcagcctctcaaagtgctgggattacaggcgtgagccactgtgcgtggcccctagactccacttctgctctggtgggctggcctgctgggtactgtagggaatgagctcagcctttctgggccagaggctccacccctggggactcccaagagggtggcctccttcaaagtgacttcccrcagcctcctcatcatccatgtccacacagcatggggaagggatgcctcggccagccgggccccacccattaacctgctcatatgatgtgtactgggcattcagcacacagagcccagctctgtcccaggaatggcgaaggggtgacaacaggtagatgcgaccccttccctggaaaagctcagaatctgtcacacttgtgagcagaacctgaatcttaaaacttcagggaaccactgtcacccattctgaccctcgctttcctgctgagaagaggtgaccagcccgaggtcacaacactc

SEQ ID NO: 23033 - DNA, 601 bp, Human
gagcccagctctgtcccaggaatggcgaaggggtgacaacaggtagatgcgaccccttccctggaaaagctcagaatctgtcacacttgtgagcagaacctgaatcttaaaacttcagggaaccactgtcacccattctgaccctcgctttcctgctgagaagaggtgaccagcccgaggtcacaacactcagctcagtgacagagcggagccaccccacccggggaagctaagtgctctccaggtgaccttcatcaggtgggtcctgtggctcccagagctgtgcagagagcctgcgtcwcagcagggctcacttgaagatggtgctccaagctcctgagccctcttcctgccttccatccagggcccgccagcaaggtggggggcccggcagggtcactggcagccatagacagtgtggctggggctctggacacagacagtggagaggccagggctccagctgccacgtggcaagaccacccctactggggatagaggcaggcggggcagaggaagaaaaggataagaggaggcttatgggcctccgagggcaggtgtagaataagaagatgagggctcccagcactatgtccgaatg

SEQ ID NO: 23034 - DNA, 601 bp, Human
cattctgaccctcgctttcctgctgagaagaggtgaccagcccgaggtcacaacactcagctcagtgacagagcggagccaccccacccggggaagctaagtgctctccaggtgaccttcatcaggtgggtcctgtggctcccagagctgtgcagagagcctgcgtcacagcagggctcacttgaagatggtgctccaagctcctgagccctcttcctgccttccatccagggcccgccagcaaggtggggggcccggcagggtcactggcagccatagacagtgtggctggggctctggrcacagacagtggagaggccagggctccagctgccacgtggcaagaccacccctactggggatagaggcaggcggggcagaggaagaaaaggataagaggaggcttatgggcctccgagggcaggtgtagaataagaagatgagggctcccagcactatgtccgaatgtgggcctgaggccaccagcagcccggcagtggctgcctccctgtggctgacctctggccatcagcttcctcacacacgccttgtccaggtcatagggcttcttagtgggtccacaacggaggacaggatgggc

SEQ ID NO: 23035 - DNA, 601 bp, Human
cacccggggaagctaagtgctctccaggtgaccttcatcaggtgggtcctgtggctcccagagctgtgcagagagcctgcgtcacagcagggctcacttgaagatggtgctccaagctcctgagccctcttcctgccttccatccagggcccgccagcaaggtggggggcccggcagggtcactggcagccatagacagtgtggctggggctctggacacagacagtggagaggccagggctccagctgccacgtggcaagaccacccctactggggatagaggcaggcggggcagaggargaaaaggataagaggaggcttatgggcctccgagggcaggtgtagaataagaagatgagggctcccagcactatgtccgaatgtgggcctgaggccaccagcagcccggcagtggctgcctccctgtggctgacctctggccatcagcttcctcacacacgccttgtccaggtcatagggcttcttagtgggtccacaacggaggacaggatgggctctggggggcagcccatccctggtggggtcacagggctgggggtgggggcctgtgctgggtgagaacatcatttccatcatggg

SEQ ID NO: 23036 - DNA, 601 bp, Human
gctccaagctcctgagccctcttcctgccttccatccagggcccgccagcaaggtggggggcccggcagggtcactggcagccatagacagtgtggctggggctctggacacagacagtggagaggccagggctccagctgccacgtggcaagaccacccctactggggatagaggcaggcggggcagaggaagaaaaggataagaggaggcttatgggcctccgagggcaggtgtagaataagaagatgagggctcccagcactatgtccgaatgtgggcctgaggccaccagcagcccrgcagtggctgcctccctgtggctgacctctggccatcagcttcctcacacacgccttgtccaggtcatagggcttcttagtgggtccacaacggaggacaggatgggctctggggggcagcccatccctggtggggtcacagggctgggggtgggggcctgtgctgggtgagaacatcatttccatcatgggcaagcagaagcctgtcctccttggtagccaggctcaccccagccccaccttcccgcttgtgggcctgagtggtggtcatctctcccttgttcattttagacaagcatt

SEQ ID NO: 23037 - DNA, 601 bp, Human
acagtgtggctggggctctggacacagacagtggagaggccagggctccagctgccacgtggcaagaccacccctactggggatagaggcaggcggggcagaggaagaaaaggataagaggaggcttatgggcctccgagggcaggtgtagaataagaagatgagggctcccagcactatgtccgaatgtgggcctgaggccaccagcagcccggcagtggctgcctccctgtggctgacctctggccatcagcttcctcacacacgccttgtccaggtcatagggcttcttagtgggtcyacaacggaggacaggatgggctctggggggcagcccatccctggtggggtcacagggctgggggtgggggcctgtgctgggtgagaacatcatttccatcatgggcaagcagaagcctgtcctccttggtagccaggctcaccccagccccaccttcccgcttgtgggcctgagtggtggtcatctctcccttgttcattttagacaagcatttcgtggtggctctgtatgactacaccgctatgaatgatcgggacctgcagatgctgaagggggagaagctacaggtcctgaaggggt

SEQ ID NO: 23038 - DNA, 601 bp, Human
gtggctggggctctggacacagacagtggagaggccagggctccagctgccacgtggcaagaccacccctactggggatagaggcaggcggggcagaggaagaaaaggataagaggaggcttatgggcctccgagggcaggtgtagaataagaagatgagggctcccagcactatgtccgaatgtgggcctgaggccaccagcagcccggcagtggctgcctccctgtggctgacctctggccatcagcttcctcacacacgccttgtccaggtcatagggcttcttagtgggtccacaamggaggacaggatgggctctggggggcagcccatccctggtggggtcacagggctgggggtgggggcctgtgctgggtgagaacatcatttccatcatgggcaagcagaagcctgtcctccttggtagccaggctcaccccagccccaccttcccgcttgtgggcctgagtggtggtcatctctcccttgttcattttagacaagcatttcgtggtggctctgtatgactacaccgctatgaatgatcgggacctgcagatgctgaagggggagaagctacaggtcctgaaggggtgaggt

SEQ ID NO: 23039 - DNA, 601 bp, Human
gtccttctcagaaactccttctaggtcagctctctctcagtggccaggcttgtcctgtggagctctgagggtctgatttggttcttgaagttctccaaaggccctgagccaagctcacgaaggtcctgactgctgattctatacagtccacgccaaccgtgtttttctcaagcctgtccccagtccctcaccaagctctgaacacgtcccattcatcaagaggaaggctgctggctggatccttgtgccctcttggctggtcaggctgtgtagataagctcttccccctagaacttgcccrgatagccactgtaccactgagcagtgggcacaagccccttcctgcctgccgtactctctacccctgcggattctctgccctccagggagagatgactttgaggaggcctgagagctgcccagtgacgggcctacaggggccatgatctcatctctgtttcccctgctcccattagaactggagactggtggctggccaggtcactcgtcacaggaagagaaggctatgtgcccagtaactttgtggcccgagtggagagcctggaaatggaaaggtaggtgggcacgggaacccccctcg

SEQ ID NO: 23040 - DNA, 601 bp, Human
ggatccttgtgccctcttggctggtcaggctgtgtagataagctcttccccctagaacttgcccagatagccactgtaccactgagcagtgggcacaagccccttcctgcctgccgtactctctacccctgcggattctctgccctccagggagagatgactttgaggaggcctgagagctgcccagtgacgggcctacaggggccatgatctcatctctgtttcccctgctcccattagaactggagactggtggctggccaggtcactcgtcacaggaagagaaggctatgtgcccagyaactttgtggcccgagtggagagcctggaaatggaaaggtaggtgggcacgggaacccccctcgagccaagatgcagtcactgtttctgctccctgggctgttaggcagggcagggccagagtgggactgaccagggagcctgcaggcactagcaaagaggggacaggaaatgagctctgctgggaaaggcctctctgctggctccagacgacattcagaccgctgtgtgacactgagcaagccgctcttcccagctaaacaagagcggtccttctcctggctcccctggatggaaccgg

SEQ ID NO: 23041 - DNA, 601 bp, Human
ttcccctgctcccattagaactggagactggtggctggccaggtcactcgtcacaggaagagaaggctatgtgcccagtaactttgtggcccgagtggagagcctggaaatggaaaggtaggtgggcacgggaacccccctcgagccaagatgcagtcactgtttctgctccctgggctgttaggcagggcagggccagagtgggactgaccagggagcctgcaggcactagcaaagaggggacaggaaatgagctctgctgggaaaggcctctctgctggctccagacgacattcagacygctgtgtgacactgagcaagccgctcttcccagctaaacaagagcggtccttctcctggctcccctggatggaaccggccccagcgtctgatggcctcgaaggctaccagggaggcactatgaccagcatcccctcccctacagcctccatgggcaggactcagggctcagccctcgggggctcccaggagggtggcgttgttcagaactgattaatactcccaatcttctaatcccccagcccccatcttctcccatgtccccatggcactgggaatttcggactcggccagccagagc

SEQ ID NO: 23042 - DNA, 601 bp, Human
tagaatcactgtttttgtttctgtgtgtcttgcttctgtcactcagcagtgtttgtgggattctatgttagtttcctgggctgccgtaacaaagtggcacagactgggtggcttccaccacagaagcttattatctcacagctctggaggctggaagtccacgaccaaagtgtcagcagcgttggctcctcccgggagctctctccttggcttgccgatggccgtcttctctgtgtcctcacgtggccgtccctccatgcatgtctgtgtcctaatctcttcttgtaaggacacctgtcartttggattagggcccacccatatgacctcattttaacttaatcacccctttaaaggctctgtctccacatatagccacattctcaggaccgagggttaggactttaacatatgaattgggagcgcacatgattcaaccagtaacagattcattcatgtggttgaggatggtgagcctgttcatgttcattgctatacagaatcccgggtgtgaccattccagagtcaagttagccattctcatgttgtgggcattgagttgtttccagtttggggctgttaatgcatgtgttgcaccgaa

SEQ ID NO: 23043 - DNA, 601 bp, Human
attgcctattgctaaggtgaaagcctccccaccccctgcccaatctggtgtggaggaagaaggggttctctatgagtctggcatcttttcctgtccatgtccaccccaggaagccagtccaagctgggaataggccatatgggaccagggctgcaggactgttcaaccatcatcaccaccacacgcccatacacatgcacacatgaacacacatgcacatatgcacaaatgcacacatatacacacatgtgcatacacaggcatgtgtgcacacatacacatgcaaacacatacacatgtmcacgcatgcacatatacacacacatgcacacatatacatgtgcacatatgcacagatgcaatgaacacgtgtgcaacacatgtacacaccttacacgtacatatgcacacacacacacaactccaaagcaagacccctctgcttctccgagccacagcagtgaatgcaagacagggatggaagcaggggagtgagttctacccttcgtggcctccggggtgtccttgagcctctcaagcctcagtttactggtgtctatgtgaggatagactagtttcacagctcaaaggcaggcggtcc

SEQ ID NO: 23044 - DNA, 601 bp, Human
tgagttctacccttcgtggcctccggggtgtccttgagcctctcaagcctcagtttactggtgtctatgtgaggatagactagtttcacagctcaaaggcaggcggtccttcagtgctgagaaatcttcatctcagagccaggccctgcctgcccagggcagtccagacataccacagaggcaggggatccaggttttgtgaaactgaagctgataggatctgaggtcgtctttacaaaggacaccaaattgtcagaagccatcagggacggggcctcagagcagccaggcaagtgagggstctaaagcaccagcttgggaagcgtcactgcgtggagagcgggctcctgggctcatcgcccgaggcacccgacacaagtgcagcctacaaaatggagagaaaagcccttgatgaatgaactccctaaggccaggctcgggttccttagagactgggggcacagctgcacccgggcagggtcggggagacagtttgcagcctctgggctgaggctggggtgggggtgtggaggggctgtggcaacagcatggcgtacgcctctgggtgtccttttgcaagtaggtgatgagagaggcacat

SEQ ID NO: 23045 - DNA, 601 bp, Human
gtttcacagctcaaaggcaggcggtccttcagtgctgagaaatcttcatctcagagccaggccctgcctgcccagggcagtccagacataccacagaggcaggggatccaggttttgtgaaactgaagctgataggatctgaggtcgtctttacaaaggacaccaaattgtcagaagccatcagggacggggcctcagagcagccaggcaagtgaggggtctaaagcaccagcttgggaagcgtcactgcgtggagagcgggctcctgggctcatcgcccgaggcacccgacacaagtgccgcctacaaaatggagagaaaagcccttgatgaatgaactccctaaggccaggctcgggttccttagagactgggggcacagctgcacccgggcagggtcggggagacagtttgcagcctctgggctgaggctggggtgggggtgtggaggggctgtggcaacagcatggcgtacgcctctgggtgtccttttgcaagtaggtgatgagagaggcacattggctgagggaaactggaggatggaagggggttgaggcaggggaactgacaggagaggaaagagccttaagtcaaacaggac

SEQ ID NO: 23046 - DNA, 601 bp, Human
cctgggctcatcgcccgaggcacccgacacaagtgcagcctacaaaatggagagaaaagcccttgatgaatgaactccctaaggccaggctcgggttccttagagactgggggcacagctgcacccgggcagggtcggggagacagtttgcagcctctgggctgaggctggggtgggggtgtggaggggctgtggcaacagcatggcgtacgcctctgggtgtccttttgcaagtaggtgatgagagaggcacattggctgagggaaactggaggatggaagggggttgaggcaggggaaytgacaggagaggaaagagccttaagtcaaacaggaccgcggaaaaccaagcgtccacaacgagaacgaggggtccgtgcctgacccctggcggggaggcgtggtactgctcgtggtaggcgcggactcggggaaccgggagccccccagcctgccgcgaactctgctgggccccagcgtcctcatctcccaaataatgggtaaggggcggggtaaggtcatggtacccaagtagctggacagacgcattttataaaaacatcaagttcatggaaaagcgtttcttacctggaaattctta

SEQ ID NO: 23047 - DNA, 601 bp, Human
tggcaacagcatggcgtacgcctctgggtgtccttttgcaagtaggtgatgagagaggcacattggctgagggaaactggaggatggaagggggttgaggcaggggaactgacaggagaggaaagagccttaagtcaaacaggaccgcggaaaaccaagcgtccacaacgagaacgaggggtccgtgcctgacccctggcggggaggcgtggtactgctcgtggtaggcgcggactcggggaaccgggagccccccagcctgccgcgaactctgctgggccccagcgtcctcatctcccawataatgggtaaggggcggggtaaggtcatggtacccaagtagctggacagacgcattttataaaaacatcaagttcatggaaaagcgtttcttacctggaaattcttacctcctaaattgtccttaacccttgacatctgctaccacttgcctgcgggaaaacattaacctagaagacaaaataacaggtgtatgtaacaggcagcaaatgactttgaacagagcccctgggcatagcttattacggtgtccgccatggacatgggtacttgcagctgtgaatggctatctgcttgtagg

SEQ ID NO: 23048 - DNA, 601 bp, Human
cccagcgtcctcatctcccaaataatgggtaaggggcggggtaaggtcatggtacccaagtagctggacagacgcattttataaaaacatcaagttcatggaaaagcgtttcttacctggaaattcttacctcctaaattgtccttaacccttgacatctgctaccacttgcctgcgggaaaacattaacctagaagacaaaataacaggtgtatgtaacaggcagcaaatgactttgaacagagcccctgggcatagcttattacggtgtccgccatggacatgggtacttgcagctgtraatggctatctgcttgtaggagtaagagataccctctttagccagaaaataaagcccctagtcactccaacgagactagatttctcaatagtccatgacaaagggtccccgagtgaccagatgcccaagtggggacctacatgattgctgagaaactgtgctgcctgccgcagggctctgtgattccctggctgagttttgcaggatagtggggggatgccaaggtcagagtcagatggaacttacaggggaggcttccaaaagcatggaggttgagatgcagggaaaggaaacttgtgg

SEQ ID NO: 23049 - DNA, 601 bp, Human
gcccaggatgaatgggagatcccccggcagtctctcaggctggtcaggaaactcgggtctggacaattcggcgaagtctggatgggtgagtgtgtgcacacgtgggagcatttctccccccattccacctgcgccgcatcctgagtccaggttcagcattttcatagcgtgtcatccctcccccagaagtcttgagagggagcgaggacagaggcgaggacactcattttacagaggaggaagtggaggtgcagagccgcgttgtaacagctgggaccgcttatggtggtggcagagcagraacagaatccagctcacccagccccgaagtcgctccctccttcgttctctgcctgaagctggctttgacaatgagctgcagcggcgcgttaactccccttagcttttcatcacccagatggaaacaggaggttaaacgtgatgagccatgatgttccagagcctgagtgcacaccgagggcagccgtgggactttggccaagtcactgaagctccaggcctggtgtcctcacatttccatcgctgctgacacctgcccccttccccccccgcccaccaggatataaaactcgtgttccgt

SEQ ID NO: 23050 - DNA, 601 bp, Human
cctgcccccttccccccccgcccaccaggatataaaactcgtgttccgttttatccctggattggtccatgagtcctcccttacctggggctggtccatgagtgctcccttacctggggctgatgcccacggtgcttttggcaggagctgtacccaggtccctgccaaggcccatgtcctctagaaaagcaagtagagttgtcttttgcccttcaggggacttcatggagtacagggagagtgtggagatacagatagtttaaggagtgggacaggatcgccatggggcttcagaaggagrgaaggagacccccatgcgtcatcctcctgcccagtgtaccccaggctgtgtgcttatttccaccaaggagttattgtgtgatagaagagactcattatgtaggggaggggtgggggaaggacacaggttccgtgcaggacagaaggacacaggcccagggtgtggggcaaataggtgaaatgccccccaggcagggtacattcctccactgcctgaggccccatatagaagggacctggaacgcaaggtacgcaccacacaaccatggcctccggaactgcatgttccagctctggcacc

SEQ ID NO: 23051 - DNA, 601 bp, Human
cagatagtttaaggagtgggacaggatcgccatggggcttcagaaggagggaaggagacccccatgcgtcatcctcctgcccagtgtaccccaggctgtgtgcttatttccaccaaggagttattgtgtgatagaagagactcattatgtaggggaggggtgggggaaggacacaggttccgtgcaggacagaaggacacaggcccagggtgtggggcaaataggtgaaatgccccccaggcagggtacattcctccactgcctgaggccccatatagaagggacctggaacgcaaggtasgcaccacacaaccatggcctccggaactgcatgttccagctctggcacctggaatggggtggcacctgggcacttaccccgattttggttaagggatcacctccgagcaagctctctgtcttctgattggcttcttcactcccccgggctcaggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagc

SEQ ID NO: 23052 - DNA, 601 bp, Human
gatatagctccctaacaactgtcaccaaggggcccccggtcggaggctgtgctgggggtgcctctagcctgcccctagggcaagcatccatccctcccagctttctgattccagggggagctgcatttgtcccctgcaccaaacctgggggacagttctctccattctggtgctttcttgctgatgcctggtcctcagaggcagagggtgtctgccagcagggatcaagggagcgaggccaacacggggggaaagacaagaaggggcatgaaacttcgagtcagaactggggtcccactcscagctcccggctgggtgacttcagacaggtccctgcacctggctgaaacctaacttctgggcaactgctggtatattggctgcctcccggggtgctgagactggcattttgtaaagtggaaggcactcggcagcagtaggtagatccttcctgatgcaccgagagatctgagggtgcaaactcccacttcccgcgcccatggggagccactcacaccagagagaggctggcaccaccaggggcgggtcactttgcagaagggcacttgcaacttctcttttcttaggatgcctgctggat

SEQ ID NO: 23053 - DNA, 601 bp, Human
tcctgaatttaggtgatctgcctgccttgacctcccaaagtgctgggatgacaggtgtaagccatgcccaaatactatttttatatagtccctattaaccttccatggaattaggctttcacagagcacactgtgggaaacacagctctcatgtgcgatcagcaaaccaacctgtattagggtgtccacggagcactgttttactctgtgcatataactgaggtggaaatctacgtcacaagagaatctgaaggggtcacatatatttatcaagctagcaagcagtgtctgctgagcctaygagtcagatgacaagcagacaggatatggcttgttctctcgggaacttcaggctggctggggagaccgagaaatggaggccaggggaggctgtgaagtgccaagccctgaggtctgctccaaatgctggccggggctgcagccattgaggtgcttcacagggcagccggatgtgagttcttcctcatagcggccctcggaggtacaagtgtcaccatttccattttgcaggaagggactaacggaggcgcccgcaggtttaaatggcttgcccaggccatgtcttttaaattaaacaagg

SEQ ID NO: 23054 - DNA, 601 bp, Human
taggtgatctgcctgccttgacctcccaaagtgctgggatgacaggtgtaagccatgcccaaatactatttttatatagtccctattaaccttccatggaattaggctttcacagagcacactgtgggaaacacagctctcatgtgcgatcagcaaaccaacctgtattagggtgtccacggagcactgttttactctgtgcatataactgaggtggaaatctacgtcacaagagaatctgaaggggtcacatatatttatcaagctagcaagcagtgtctgctgagcctatgagtcagakgacaagcagacaggatatggcttgttctctcgggaacttcaggctggctggggagaccgagaaatggaggccaggggaggctgtgaagtgccaagccctgaggtctgctccaaatgctggccggggctgcagccattgaggtgcttcacagggcagccggatgtgagttcttcctcatagcggccctcggaggtacaagtgtcaccatttccattttgcaggaagggactaacggaggcgcccgcaggtttaaatggcttgcccaggccatgtcttttaaattaaacaaggcccctgtaa

SEQ ID NO: 23055 - DNA, 601 bp, Human
ggggtcacatatatttatcaagctagcaagcagtgtctgctgagcctatgagtcagatgacaagcagacaggatatggcttgttctctcgggaacttcaggctggctggggagaccgagaaatggaggccaggggaggctgtgaagtgccaagccctgaggtctgctccaaatgctggccggggctgcagccattgaggtgcttcacagggcagccggatgtgagttcttcctcatagcggccctcggaggtacaagtgtcaccatttccattttgcaggaagggactaacggaggcgccsgcaggtttaaatggcttgcccaggccatgtcttttaaattaaacaaggcccctgtaaggtgaaacaggccccttccatcccaggtggaaacgtggtggctgcccattgaggccatcactctctttttaaagaaccaaagtgggtgactgtgtggtattggtgtccatatcgtctttctgtgctgctgatgccgtgtctgcactcacctggtcatgtgtcctggtgtgcggtagtggctcccccgccatgcctggccgccccgccctgtgaggccccgcagtgggggcttgatggaaggac

SEQ ID NO: 23056 - DNA, 601 bp, Human
agaaatggaggccaggggaggctgtgaagtgccaagccctgaggtctgctccaaatgctggccggggctgcagccattgaggtgcttcacagggcagccggatgtgagttcttcctcatagcggccctcggaggtacaagtgtcaccatttccattttgcaggaagggactaacggaggcgcccgcaggtttaaatggcttgcccaggccatgtcttttaaattaaacaaggcccctgtaaggtgaaacaggccccttccatcccaggtggaaacgtggtggctgcccattgaggccatcrctctctttttaaagaaccaaagtgggtgactgtgtggtattggtgtccatatcgtctttctgtgctgctgatgccgtgtctgcactcacctggtcatgtgtcctggtgtgcggtagtggctcccccgccatgcctggccgccccgccctgtgaggccccgcagtgggggcttgatggaaggacagcaggagcaggggtaggggtgaggatggagggtaggggccaccggccgtggcctcccaaagcttgcatggcttttcccacaggggccaagttccccatcaagtggacagccccgga

SEQ ID NO: 23057 - DNA, 601 bp, Human
cattgaggtgcttcacagggcagccggatgtgagttcttcctcatagcggccctcggaggtacaagtgtcaccatttccattttgcaggaagggactaacggaggcgcccgcaggtttaaatggcttgcccaggccatgtcttttaaattaaacaaggcccctgtaaggtgaaacaggccccttccatcccaggtggaaacgtggtggctgcccattgaggccatcactctctttttaaagaaccaaagtgggtgactgtgtggtattggtgtccatatcgtctttctgtgctgctgatgycgtgtctgcactcacctggtcatgtgtcctggtgtgcggtagtggctcccccgccatgcctggccgccccgccctgtgaggccccgcagtgggggcttgatggaaggacagcaggagcaggggtaggggtgaggatggagggtaggggccaccggccgtggcctcccaaagcttgcatggcttttcccacaggggccaagttccccatcaagtggacagccccggaagccatccacttcggggtcttcaccatcaaagcagacgtgtggtcgtttggagtcctcctgatggaagttgtca

SEQ ID NO: 23058 - DNA, 601 bp, Human
agggtagacaaaacggattccgtaagacattcaagccaacagtcaggaacctgatgtagctgttgggtgaccatacttgtatctaggaggctatcctgagcctagcacagagcctggcatgtggtaaactctctatgaaggaattaatgagttgatgggtgcatcttttgatgggtgcatcttttgatctcctccaacagattacaacagcagtgaattgaaaacagcctgcaggaagcatgagctgtatgtgagtttccaagacctgggatggcaggtgagttctctggacacgggggayaaaggtcctttctcagcagtttactctcatctgaatggtggcagccattaccaaacacccagagcttgattgaaggctgagctgcttccttctgtggaagtcctgaggagccctcccaaatgctcaggctcctggagtaaggcagaggaagcttagtctgtggggcaccaggcgctccaacaccttcctagggtgcctgagctctgtgatccctcaaaaatcaatagccacatttcccaatattctcacctcatcctttcaaagcccataggacatacatttatttgggcatttaaacaa

SEQ ID NO: 23059 - DNA, 601 bp, Human
tggaaaaaaattacctaatggttaacatctccaatggctgcaaaccagctcaccaaacgatgcagaagagcacacgtttgcctcgtacctgagaaccatcactagtttgtaagaaaggcagcaactttaatcacaggtggtgagcgataaaaggtagcttccatatgcaggtggcactacttccgcaggagcaccgtgggctcctggagaggcttgcttgggtccaagcacatattgctggcaacctacgtgcttccaggtagcagctgaggccctgtgggcctctgcaaggagcgagggytctggggtcagatggaccaggttcacttcccagcattgccacttgaatgtgaacttggacaaattcctaagccttcctgcgtctgtatccttgcctgtgcaatgtgaaaaataccttttcacagcattcctgaaaagcacaaatagtgtgagaagtgcatgctcatcttttgttgcttcctttgcatgaaattaaggactggatcattgcacccaagggctatgctgccaattactgtgatggagaatgctccttcccactcaacgcacacatgaatgcaaccaaccacgcgattgtgca

SEQ ID NO: 23060 - DNA, 601 bp, Human
gctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcaatgctcacctcttctttaccagaacggttctttgaccagcacattaacttctggactgccggctctagtaccttttcagtaaagtggttctctgcctttttactatacagcataccacgccacagggttagaaccaacraagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaactgtttgcacttacagctttttttgtaaatataaactataatttattgtctattttatatctgttttgctgtaacattgaaggaaagaccagac

SEQ ID NO: 23061 - DNA, 601 bp, Human
gcagtggctcacgcctgtaatcccagcactttgggaggccaaggcaggtggatcacttgaggtcaggagtttgagaccggcctgaccgacatggtgaaaccccgtctctactaaaaatacaaaaattagctggacacagtggtgcacacctgtagtcccagctactcgggaggctgaggctgaagaatcacttgaatctgagaggcagaagttgcagtaagccgaggtcgcaccactgcactgcagcctgggtgacagagtgagacttcatctcaaaaaaaaaaaaatgtgtgtgtgtgtrtatatatataatatttatcaagtattaaagtttgccatgaatttaaaatatttttcatttatgaaataaagatacagcaaactcttctacctccccatttcttcctccccctccttccatggggtaagccccccaggggtcttcccatccatgtttcagggtcttccttcatctctgtgtagctgcaagtgccgccattgttctgtttatttaaatatctacatgcttggtgttgtgttatacgaatgttttgctacttgcatttctaagctagtttatttttacagaattaagatgtcc

SEQ ID NO: 23062 - DNA, 601 bp, Human
taaataaacatttcaaacaaactgaaaagtatcgcacatcatatattcttaaaacacctaccacctggccgggtgcagtggctcacgcctgtaatcccagcactttgggaggccaaggcaggtggatcacttgaggtcaggagtttgagaccggcctgaccgacatggtgaaaccccgtctctactaaaaatacaaaaattagctggacacagtggtgcacacctgtagtcccagctactcgggaggctgaggctgaagaatcacttgaatctgagaggcagaagttgcagtaagccgagrtcgcaccactgcactgcagcctgggtgacagagtgagacttcatctcaaaaaaaaaaaaatgtgtgtgtgtgtgtatatatataatatttatcaagtattaaagtttgccatgaatttaaaatatttttcatttatgaaataaagatacagcaaactcttctacctccccatttcttcctccccctccttccatggggtaagccccccaggggtcttcccatccatgtttcagggtcttccttcatctctgtgtagctgcaagtgccgccattgttctgtttatttaaatatctacatgc

SEQ ID NO: 23063 - DNA, 601 bp, Human
acgccagcctgggcaatggcgtgagaccctgtctctaaaaaaaaaaaaaagaaaagaaaaaagaaaaagaaaatcactttgccaacaaagatgtattctttcctatcgctgctttaacaaattaaccaagcaaattatcaaaacaatacaagcggattatagctctgtggctctgaagtccaacaccagtcttagcaggtaaatgcaactgggggctctaggggaggatcccttccttgccttgtgcagcttctccaggccacccacatcccagggctggtggccccactcatctccaccmctctgtgctctgtgcttacatggctccaaccacagctcaaaaaggctctctcctataaggactgatgggaccaccctgctacacagagcccgcgtattggaaggccagctgattagcacctgtgattccaagggcagtcgtaactcccctttgccctggagggtgacacattcacgggttccagagattaagacactggcatcttggagaggctattgccctgctcattgcaaatggcttcctgaagagccagagaaacggcacccccgggcagcagctcccctggccggcgggatggga

SEQ ID NO: 23064 - DNA, 601 bp, Human
gtcatgagcacaggagaggccatgatctattagcaatgtctgtcatgagcacagaagggacaaggagtggcctgagtgctactttccccaaccctgtcttaaagtaaagccacgacatttggcataacttagttcaaacccaaggccaaacagaccaaggccgagcacagctcatgaagctagttatggtgtacgagtgaggcgtgggcactggccctgccaccagggactccagaccctgctctgtgcttccagggctctttgatcacggctgtcccagcagaaagtggccggagctccygtgtatccttaggacttattagcaggaaaacaaggaaaggaaacgaaggagggactcccagctcccctgtccgtccaagcctgccccacccgcccccaagcaacagaaagtgagcaggagacagccctgacgccagcaccgggattcatccacctcctcaaccccctgcttgggccgcagacaagtcaggactggtgcttaggctcagctcccgcctccacgggtcatctggcaaaggcggctgcttaccagggagctgggtccaaacgtgggtggggagaaggaagtgcagggacccag

SEQ ID NO: 23065 - DNA, 601 bp, Human
tctcctgcctcagcctcctgagtagctgagactataggcactcatcaccatgcccagctaatttttgtatttttagtagagacggggtttcaccatgttggccaggctggtcacaaactcctgacctcaggtaatccacccgccttggcctcccaaaatgccatttttgaatatatctatttatacagatataaaatttatctacagttcagaaaagcaatgtggaaagatatgcacaccaataacgaaattacatttaattgattataaccgaatcacatgtgtgattcctgaggagacrcttgagactttcggtgaagtgaactcgctgaaggctggggcggggctggtgggctccaggctttggggcaggagcgcttgcccctgggtgccctgccctcgcggcctgcatgccttgtggagtcactcattcattcagccattgctaggggctgcttcctggtgtgcaggcatgagatgagtcccaggtgtaagacagcaaagccctgccactcaggggcttttccagaacgagaggcgggtcatagataagtgagtgcacatgacttacacggagatgagggctacagaggaaaacaag

SEQ ID NO: 23066 - DNA, 601 bp, Human
ttttttttgagacagagtcttgctctgttgcccaggctggagtacagtggtgcaatcttggctcactgcaacctctgcctcctgggttcaagcaattctcctgcctcagcctcctgagtagctgagactataggcactcatcaccatgcccagctaatttttgtatttttagtagagacggggtttcaccatgttggccaggctggtcacaaactcctgacctcaggtaatccacccgccttggcctcccaaaatgccatttttgaatatatctatttatacagatataaaatttatctayagttcagaaaagcaatgtggaaagatatgcacaccaataacgaaattacatttaattgattataaccgaatcacatgtgtgattcctgaggagacacttgagactttcggtgaagtgaactcgctgaaggctggggcggggctggtgggctccaggctttggggcaggagcgcttgcccctgggtgccctgccctcgcggcctgcatgccttgtggagtcactcattcattcagccattgctaggggctgcttcctggtgtgcaggcatgagatgagtcccaggtgtaagacagcaaagc

SEQ ID NO: 23067 - DNA, 601 bp, Human
gaaaagcaggctgcttttattttcatcagcaattttttttttgagacagagtcttgctctgttgcccaggctggagtacagtggtgcaatcttggctcactgcaacctctgcctcctgggttcaagcaattctcctgcctcagcctcctgagtagctgagactataggcactcatcaccatgcccagctaatttttgtatttttagtagagacggggtttcaccatgttggccaggctggtcacaaactcctgacctcaggtaatccacccgccttggcctcccaaaatgccatttttgawtatatctatttatacagatataaaatttatctacagttcagaaaagcaatgtggaaagatatgcacaccaataacgaaattacatttaattgattataaccgaatcacatgtgtgattcctgaggagacacttgagactttcggtgaagtgaactcgctgaaggctggggcggggctggtgggctccaggctttggggcaggagcgcttgcccctgggtgccctgccctcgcggcctgcatgccttgtggagtcactcattcattcagccattgctaggggctgcttcctggtgtgcagg

SEQ ID NO: 23068 - DNA, 601 bp, Human
gtatatgtcaaagagtggaacaccactcaatttttggcttttctctgattcatgagaattctatctgcatagcttctaggataatgagaaatggtaagataagaaggacatcgccgaactcccttccctaagccttactttcttcatctgtaaaatgggtgggacaggagtggtgcagtaagctagcctcccatggaccacacactgcaaattaggacacctcctcagacacagactggacattctgttggtcctggaaaccttcagtgtgccttagctaccccatggctgagaacaattstggaatgaaatgggctagaagcagcaagccaagagtggaaagcagaaaggagaaagaagagggttgaggaggaaggaggcaggagagaggagaacagcatggagagcacaggagtcaggaactggcctccaaggctcaggctgagacaggagcaccatgctccctgctggggactgaaaagcaggctgcttttattttcatcagcaattttttttttgagacagagtcttgctctgttgcccaggctggagtacagtggtgcaatcttggctcactgcaacctctgcctcctgggttcaa

SEQ ID NO: 23069 - DNA, 601 bp, Human
agaggtgtagaccctggagcacagtcagcctctgagtggagtctaactcgtgagtcaagaccaggtcttggggactgctctagctctggagtcaaaccccagctctcctagatcttggactcctggtttgcaaaatgaagagagctcctatacctcctggggtaggcttgagtgttcatggcagtttcatattttattcttcttcttctagcccacttgttagggaaatttgaaactacgcacattctccattcacacacacacacacacacacacacacacacacacacacacacacacatgttaactgtttgaatgcatggctctttcctccacacccactacatgccattagggtatatgtcaaagagtggaacaccactcaatttttggcttttctctgattcatgagaattctatctgcatagcttctaggataatgagaaatggtaagataagaaggacatcgccgaactcccttccctaagccttactttcttcatctgtaaaatgggtgggacaggagtggtgcagtaagctagcctcccatggaccacacactgcaaattaggacacctcctcagacacagactggacattc

SEQ ID NO: 23070 - DNA, 601 bp, Human
tagaggtgtagaccctggagcacagtcagcctctgagtggagtctaactcgtgagtcaagaccaggtcttggggactgctctagctctggagtcaaaccccagctctcctagatcttggactcctggtttgcaaaatgaagagagctcctatacctcctggggtaggcttgagtgttcatggcagtttcatattttattcttcttcttctagcccacttgttagggaaatttgaaactacgcacattctccattcacacacacacacacacacacacacacacacacacacacacacacaactgttaactgtttgaatgcatggctctttcctccacacccactacatgccattagggtatatgtcaaagagtggaacaccactcaatttttggcttttctctgattcatgagaattctatctgcatagcttctaggataatgagaaatggtaagataagaaggacatcgccgaactcccttccctaagccttactttcttcatctgtaaaatgggtgggacaggagtggtgcagtaagctagcctcccatggaccacacactgcaaattaggacacctcctcagacacagactggacatt

SEQ ID NO: 23071 - DNA, 601 bp, Human
acaagactgagcacagacccgctgcctcgtgggagcccacgccagagggcccacacccaagacagacccagccagccccttacctgccagcccaggtctcggaagctgacatacagctcgtgcttcttacaggcctgcctctggtcgctgctgctgttctctgcattgacaaggaagtgaagaagcagagcccagtgaggagaaagaaacacacacacatcaaagttccctccatcttaggcagtgatgtgaacagcaatgaagcacagacggctggggggtaaatttcccgattcaaaakccagttcgagggtctaactgccttaaaactcatttctacccccagcaaaggccctactaagggaggtgccaatgccccattcctctctcatgtagtcttatcccataatactttctggaaccttctgcggacactggtttcttttatacacgtgtgttgtttaaatgctgacatctgcctggattccataagggaatcaaaccccatccacctcacacaaggccactgcaggcgccctgctcaaagagatctgcttatgaacaacctcaactcgtgaggccccaacacactcatccctct

SEQ ID NO: 23072 - DNA, 601 bp, Human
cctcactccatgcaaatggctccagagggggcagccatgtgccagtaacatgaccccacccctgaaacagttgactggttcaggaacaagtgcctgaaccaagctgggcagatccgtccctcccgtgggaatgggaatggggtaaatgaagtcagagggcagagggggagatggctccccaggtatctacattcaaacacacggcccggcatcatcttgagaagcagccagccaagggatgggaatgaggtgcatgcagagaatggggttcagagtccaaagtgtttgggttcctggttcragttcaagtctcaaccacatttctgctctcggatttcatgaggcctccctgtatccttagcccaagtccccttccctagcgaggccacttgatactggagtcttaactggcagagatgagaaacaagactgagcacagacccgctgcctcgtgggagcccacgccagagggcccacacccaagacagacccagccagccccttacctgccagcccaggtctcggaagctgacatacagctcgtgcttcttacaggcctgcctctggtcgctgctgctgttctctgcattgacaaggaagt

SEQ ID NO: 23073 - DNA, 601 bp, Human
cctcatgacaataccctctccagggatatttgagccccacagggcagacacattgcagtgttcatcgctgcatctccaatccagtacctagaacagggcccagaacgctgcagatgctgcatgactgctgaatgagaatcacaccagagctcacggcaggtggatcacatgaccctcactcctctcctaggattcatcccctgccttttgcctcactccatgcaaatggctccagagggggcagccatgtgccagtaacatgaccccacccctgaaacagttgactggttcaggaacaagygcctgaaccaagctgggcagatccgtccctcccgtgggaatgggaatggggtaaatgaagtcagagggcagagggggagatggctccccaggtatctacattcaaacacacggcccggcatcatcttgagaagcagccagccaagggatgggaatgaggtgcatgcagagaatggggttcagagtccaaagtgtttgggttcctggttcaagttcaagtctcaaccacatttctgctctcggatttcatgaggcctccctgtatccttagcccaagtccccttccctagcgaggccactt

SEQ ID NO: 23074 - DNA, 601 bp, Human
ggtgtgaggcaatcatcagctctacccccactaggtggtcacacactggcagttcaccttaaacaaacctccatgcctcggtttgcccacctgccagagaggctaataactcataatggcatcacccatgctggctccgggtgcactggtcagtaagggatccatgtgccatccttgcctctagggtctgggtggcacagaaatgttgcccaataatcaatatactcctcagtgatgcttaagcacatggaatcttccagcagaggcccctggagtttgggttctgtcccagctgcaggtrgatgtggtcatcagtcctgagggcaggctcacaggagggctcagagctggctgtgtgcacgtacgccctgagtgtgtctgggcataatccccagggaagattctggactctcccactgaactacaagctccctgagggtagaataccaccagttgccctgatgacctcatgacaataccctctccagggatatttgagccccacagggcagacacattgcagtgttcatcgctgcatctccaatccagtacctagaacagggcccagaacgctgcagatgctgcatgactgctgaatgag

SEQ ID NO: 23075 - DNA, 601 bp, Human
ctggtggccccacagcctgcccggcccaggtgaccacaccccaagatggcgtgacacccaccagcgtctgcacgatggcgtggttggtggcgttcatgtaggagttcagagggaaggcacactccccctcacagtagtaggcggcgtagccttcaggcgcgatgatccagtcctgaggaggagaagagagtgtgggaaaccatgcagaaggcctgagccacagcatcccaacccccatgctggccagaaaccaccacgccaggctcacgacccaaggtggaagcctcagaccatgccttctgagcagcagggggcccagcaggggcaggaaacatgggtggcctctcatggtcccaaaagaatggaaagaaggaccactctatagtcttggcctatagtccaagcttagtagactgagtgggaagacggctcaaagctgcggtgagctatgatcacaccactgcaccccagcctgggtgacagagcaagaccccatttctaaaaaaacataaaataaaaatgaaggaaagccccacggggcttggctgatcctaaaatggacatccatggctgtgtcttctggacagaacgcggcacagga

SEQ ID NO: 23076 - DNA, 601 bp, Human
tacctgtttcctctactggaaaatgaagcagggcccagtgctcttaggcaccgtaaccagcacccacaatactacaagcatcctcaaaggagcccatacaacttttagttactttaaaaattaggagaaataaatgaactccagggtcgaagattatactcctctttataccaaaccagtcataaagtacaatttttgatttttttttaacggcgcaaggggcccccaaaagtcatgacatggcaatgggctgacatctactcaggccccagcttggaggcagcaggatctggtggccccrcagcctgcccggcccaggtgaccacaccccaagatggcgtgacacccaccagcgtctgcacgatggcgtggttggtggcgttcatgtaggagttcagagggaaggcacactccccctcacagtagtaggcggcgtagccttcaggcgcgatgatccagtcctgaggaggagaagagagtgtgggaaaccatgcagaaggcctgagccacagcatcccaacccccatgctggccagaaaccaccacgccaggctcacgacccaaggtggaagcctcagaccatgccttctgagcagcaggg

SEQ ID NO: 23077 - DNA, 601 bp, Human
actgcaggtgacactccccaagccaagcactccctgttctaagcactttacatggacaactcagttctgggattatccctgttttgcagacaagggaaccaaagcatagaggttttcacattatacagtggggaaggaaggggccagatccgacattcaggaccaggtaattctctgttggggaactgccctgtgcactgtagattgctgaatagtgtccctgacttggacccactagaagtgctccatcttgctcatggacttctctgcaccttacagaggatgtgggacagggacacayagactcaaatgcctatgagtgccacgtgagtgccactgataagcaaaatagaccgaggtaagacaatagggaatagtggggactaaggcaaactaagggaagaggccgccactcaacctaagctgacggcagccaaccaagatcagtgttagcagatctgccacgtgttcaagacaggccagagattccactgtcctgttgttttcaacgtgaaacttctgggtttccagcaactgtaggtgccaggcaagagcatcagtgactggcactctgttcacagcctccaggctgtgactgctg

SEQ ID NO: 23078 - DNA, 601 bp, Human
gggcaaacctcggtaaacactgggcctctgcaagcctcaggatgaaaactgtagggaatggagagggacctccccgccctccacttgacacagcttctgtttacgcatcaggataaaccgagaaatggggataaattgtttaggaaaatatatctgtaacgtcctaaccattttcattcattcgttttattgtgacatttattacaggaacttccgggtcaattttcctttcgcacagacaccaatgtgcccaccccttgccacgcccccttcctcccacggctgggtggcctggctggtrggcgctcataattacctctggaaacgagtccgtgcatggctgagacttcccagccaatgacctggcccggccatttttctttatgcgttgtttttttttcctgctaggttttgcctgcacagcttgtaggatcttgttcattggatgctgccactgaaaaactgatcaaaagccatatgctgctcatgtttcctaatactctcacacctttaaagttggggatagggaggggaaggtctcacaaaaggcagttggtctgctggttcctggccaaggcgagcaatggaggatccagaaaaa

SEQ ID NO: 23079 - DNA, 601 bp, Human
ccctcaccaggttccttcctcctttccacattctactgacttgcatttccccacccgactcttttatagctccctggttcaacctcaaggccttgaggttttggcagctctggaggatgagagagaacatggccaggggcccttgcaacgcgccgagatgggtgtccctgatggtgctcgtcgccataggcaccgccgtgacagcggccgtcaaccctggcgtcgtggtcaggatctcccagaagggcctggactacggtaactggatgcctcccttccctcctctccacccctgaggagsacttacttagcatctactgtgtgcacccctttagatccagcacctggcacactcatagcacctcagggcaggtccccttgcccccattttatatatgaagaaactgaggcaaagcgagttgcctaagattgcagggctgggatggcagagctgggattggagcactggtctagaggactccaagtccagtgctcagacccctgagggtcctcatggtcccctccttccctctatgtaacctccacctttgacttgtaagcccttctcttctttccaaagccagttctcagccttgccatt

SEQ ID NO: 23080 - DNA, 601 bp, Human
ttttaccctcacttcagccttgtgtaagacaaactgctgctatccacatttacacgtgagaagtgggcagcctggatttgagctctggtcttgcctgatgccccagcacggggttgctcgatgctgcctcccgatggcagagagatgacctgcaaaacagtgggtgacacccagccccagggaaatcagaccaaggggaaggcagagcctcaccagttggggtgcgttgggaaaacagacaggactcaggggacctggtatcccacccctgaattcccaccccagcccagcaggacatcastgaatcctagagctgcagacagaaggccacagaagacagaagagctagggggaaggagtatggccctgaagcctgtcgacacagaggctcagtcagggtctttaagttcagtggtcttcatgctccgtcatagcagcctgagtttccccttctacccaggccccttgtgccaatcggagtgagttttctgaaatgcagcaaatccctacacatcctcccctggctcacattctccatggctccctactgccttcagaagctatcctgaccctttggcatggcatttgagacccttcgagg

SEQ ID NO: 23081 - DNA, 601 bp, Human
ctgccccttgtccgctgtgtggcccctagcaagtcacctcagctttctgagcctcagcttccttatctgtgaaatgggggtagtgacaggacctacttcctaggattgtacaaattcatacatatacggagcctagaacagtgcttggcacagagtaaagctcgatacatttcattgatattattatttcctaactggctccgagaaaacccaaagtctgggctccctcatcttactacttactccttttcaggtaatgtgtctgccttttaattggttctttgatgctgttagccacatyataactggtggtagaattcctgccattaggacattatttattcatctaataaatctttttttgttttgttttgagaccgagtctcgctctgtggcccaggctggagtgcaatggtgccatctcagctcactgcaacctctgcctccggggttcaagtgattctcctgcctcaacctcccaagtagctgggattacaggcgtgcaccatcacacccagctaattttttgtatttttagtagagacggggtttcaccatgttggccaggctgaactcttgaactcttgacctaaagtgatcc

SEQ ID NO: 23082 - DNA, 601 bp, Human
tcagagtcacgtgaataaatgcataattacaaatggtaacaggggctccgaaagagcagtccacagcatcatgagaataacacagggcgttgctctgatctactaagccagggagggttcccagaggaagtgatgaatgagctgactagaagctgaccgggtgaatatgggagggaagaatttcttagggagcaagaatagcatgtgcaaaggccctggggagacagtccaaaacccagagaggtgggagatctgtgggggtgtagcatagagcaaataacaaattaagtatccaacaaawactagcaggaggcataactgggtgtttcaggggtgatattttagaccaggggtcagcaaactacagccctccgtttttgtatggcttataagacaaaaatggccttaatgtctttaaatgatgggaaaaaaatcaaaagggccggtcatggtggctcatgcctgtaactccagcactttgggaggctgaggtgagaggatcacttgagcccaggagttcgaaaccagctgggcaacatggtgaaaccccagatctctgcaaaaatgttaaaaaaaaatttttaaaaagttagcctggtgt

SEQ ID NO: 23083 - DNA, 601 bp, Human
gggacggccgctctgcagaaggagctgaagaggatcaagattcctgactactcagacagctttaagatcaagcatcttgggaaggggcattatagcttctacaggtgaggcctatcagagctcaatcctcgatttgcaggacttgtagtgttctggggacaccaagagctagaatgcagagccacaaactcctcaactcacagagtttcatatcccaaagcctgcatttacatcatcccaaggggaggcaacctcccagctgagcgtggaggaagccacaaaaaccacgactcccaggaartgtgtcatgaacccccaaactctgcgccatatgtcaattagaatgtgcaagttttcaaggtcagaaaatcttttctaaaatggcttaaggcagaatgcattggctcacatggccggaaagtctctggaagagtctggcttcaggttcagcttgaggcaggcttacatgtcactgggccctgtttctctcttgccacctctcagcatcacttccttggacaggcctaattcgcaggcagtgtgtcccctccagaggcaagacagccaccagtaagtctctctagatctcctgctcagcact

SEQ ID NO: 23084 - DNA, 601 bp, Human
tatacagagctcttctgtacagagcttccagtgaaagggccttctattttatcttcattgattgccacacaccctgcaaaatagcaatcactgtgcccattttacagatgaggaaactgaggctggggtaattatgcccaaggtaacccaagagtatattaaagagcaggatttaaatgcaagttttttctgacttcaaaacctaagccactccagttgcctacatatctgccaagcctgctttcttagctttgggctcctcctggaatggatggagtgaaggaccaggtggtgggggacragtctgcattaaccattaacgaagtcctcatgtgtgcacctaggagtatatgaaattatatgacattcacatttctcctttgcagcatggacatccgtgaattccagcttcccagttcccagataagcatggtgcccaatgtgggccttaagttctccatcagcaacgccaatatcaagatcagcgggaaatggaaggcacaaaagagattcttgtgcgtttccatgcttgcggtttgttgggtgtgctcttggtgatatttggacgggattagagagtcagcgtctctggaatgcccaa

SEQ ID NO: 23085 - DNA, 601 bp, Human
cttgcctattaccacctatagccacagcgttcctcaggaaattcttcacatgagaagattcaacataacccttgattaatagctgagaatttatccacatctcagtgcaggatactggcgaggctgagttggtgtatgtggcttagggtggaaatctaagtggaacctttaatttatcccgtttatcagttagctattgctgtgtaacaaaccatcccaaattctgtggcttaaaacaacaatcggctgtcatcacttatgtatctgtcggctggggcttagctgatctgggttgggcttagcagaggaggcttggctccacctgtgactcctcctccttggaccagtgggttatgcagagcatattcttggtgatagcagaggtgcaaaaagggaaagcaggaacacacaggtcctcttaaggcccaggctcagaatttatataccatggccaaatcatttcacgtggccaagcccaaagtcaagggcaagcaaaggcaccttcctcaaccctgccatgataggcaatggcaagggtatgaatgcagggcagggtgaaaaataggggcaaataacccaaactacaactccaaatctaagt

SEQ ID NO: 23086 - DNA, 601 bp, Human
gcctattaccacctatagccacagcgttcctcaggaaattcttcacatgagaagattcaacataacccttgattaatagctgagaatttatccacatctcagtgcaggatactggcgaggctgagttggtgtatgtggcttagggtggaaatctaagtggaacctttaatttatcccgtttatcagttagctattgctgtgtaacaaaccatcccaaattctgtggcttaaaacaacaatcggctgtcatcacttatgtatctgtcggctggggcttagctgatctgggttgggcttagcagaggaggcttggctccacctgtgactcctcctccttggaccagtgggttatgcagagcatattcttggtgatagcagaggtgcaaaaagggaaagcaggaacacacaggtcctcttaaggcccaggctcagaatttatataccatggccaaatcatttcacgtggccaagcccaaagtcaagggcaagcaaaggcaccttcctcaaccctgccatgataggcaatggcaagggtatgaatgcagggcagggtgaaaaataggggcaaataacccaaactacaactccaaatctaagtcct

SEQ ID NO: 23087 - DNA, 601 bp, Human
cgttcctcaggaaattcttcacatgagaagattcaacataacccttgattaatagctgagaatttatccacatctcagtgcaggatactggcgaggctgagttggtgtatgtggcttagggtggaaatctaagtggaacctttaatttatcccgtttatcagttagctattgctgtgtaacaaaccatcccaaattctgtggcttaaaacaacaatcggctgtcatcacttatgtatctgtcggctggggcttagctgatctgggttgggcttagcagaggaggcttggctccacctgtgwctcctcctccttggaccagtgggttatgcagagcatattcttggtgatagcagaggtgcaaaaagggaaagcaggaacacacaggtcctcttaaggcccaggctcagaatttatataccatggccaaatcatttcacgtggccaagcccaaagtcaagggcaagcaaaggcaccttcctcaaccctgccatgataggcaatggcaagggtatgaatgcagggcagggtgaaaaataggggcaaataacccaaactacaactccaaatctaagtcctgggatctctccacagctaccctgc

SEQ ID NO: 23088 - DNA, 601 bp, Human
acaaaaacaaaagaatgtccactgtctcaaccaaaacccatttcatccctgaaggaggagttattaacctcattactgaattaatgggggcattaatgaatgaaagtcattggccccaaacacccagctttttagtagcaaagctgagacacacactctggtgtctgactgctgatccagggtctgagggaggaaatggaagctcagagaggtaagaaacatgcccaaggccacacagctagggcagcagctgaagcagtggttaagagcaggtttctgccaggcaaacatgagttccgarttcaggttggattcctgactctcccactcggctgctatgtgatcttgggcaagctgcctcttctctctgaacgtacctcctcacctggagtggggataataacaaaacccgccttccagcactggggcaaagtttgaatgtcagtgggaagaaaggacttgtcccacattcctctttgttcttcttcagaaaaatgagcggcaattttgacctgagcatagaaggcatgtccatttcggctgatctgaagctgggcagtaaccccacgtcaggcaagcccaccatcacctgctccagctg

SEQ ID NO: 23089 - DNA, 601 bp, Human
catccctgtattccgaaaacacatccagagtgccacctgcatgccaggccttgctcagaggcctcaggcatggtacgggggccaggggcccacagatgaaccagacactgtctctttctcaaggcatcatttgttcattccatactcatccagcagactttactgagcacttactatgtcccaggctcatactaagcactttacatatgcactaaattatatcctcatcacaaatctgtaggcattcatctatccatccattcaacaaatacctagtgagaatcagctctgcaccaggctygtgcaacatggtcaggaaacaggagtgacaaatgaaaacttagcaagagctaatattggtcagaggctgactgtgcccagcactgatttgatcacactcattatctcattcaagccacaccatgactctgtgaggtcggtctattattaccccattttctggggagaaaaccaaagcatggagagataggcaataacttaagttgctacagctaatgagtgttcaagtccaggtctatttcaccccagactcagccacacagtcctgttctcttaaagttttcagcccagtggggaagac

SEQ ID NO: 23090 - DNA, 601 bp, Human
atgtcccaggctcatactaagcactttacatatgcactaaattatatcctcatcacaaatctgtaggcattcatctatccatccattcaacaaatacctagtgagaatcagctctgcaccaggctcgtgcaacatggtcaggaaacaggagtgacaaatgaaaacttagcaagagctaatattggtcagaggctgactgtgcccagcactgatttgatcacactcattatctcattcaagccacaccatgactctgtgaggtcggtctattattaccccattttctggggagaaaaccaargcatggagagataggcaataacttaagttgctacagctaatgagtgttcaagtccaggtctatttcaccccagactcagccacacagtcctgttctcttaaagttttcagcccagtggggaagacaatcattaaccaaagcattgcatgaatgaatggcccacacagaattacaaaaggagacaagaattaagaaaaagaggtacaaacttctatgaacgcagagaaccagaggctctgaccgcatctgggagcaggccaattcttccttggtgaaatgacatttgaactgagatgaaag

SEQ ID NO: 23091 - DNA, 601 bp, Human
taaattatatcctcatcacaaatctgtaggcattcatctatccatccattcaacaaatacctagtgagaatcagctctgcaccaggctcgtgcaacatggtcaggaaacaggagtgacaaatgaaaacttagcaagagctaatattggtcagaggctgactgtgcccagcactgatttgatcacactcattatctcattcaagccacaccatgactctgtgaggtcggtctattattaccccattttctggggagaaaaccaaagcatggagagataggcaataacttaagttgctacagmtaatgagtgttcaagtccaggtctatttcaccccagactcagccacacagtcctgttctcttaaagttttcagcccagtggggaagacaatcattaaccaaagcattgcatgaatgaatggcccacacagaattacaaaaggagacaagaattaagaaaaagaggtacaaacttctatgaacgcagagaaccagaggctctgaccgcatctgggagcaggccaattcttccttggtgaaatgacatttgaactgagatgaaaggataagtaggcattagttagggaggtgttggggaggg

SEQ ID NO: 23092 - DNA, 601 bp, Human
atctgtaggcattcatctatccatccattcaacaaatacctagtgagaatcagctctgcaccaggctcgtgcaacatggtcaggaaacaggagtgacaaatgaaaacttagcaagagctaatattggtcagaggctgactgtgcccagcactgatttgatcacactcattatctcattcaagccacaccatgactctgtgaggtcggtctattattaccccattttctggggagaaaaccaaagcatggagagataggcaataacttaagttgctacagctaatgagtgttcaagtccagktctatttcaccccagactcagccacacagtcctgttctcttaaagttttcagcccagtggggaagacaatcattaaccaaagcattgcatgaatgaatggcccacacagaattacaaaaggagacaagaattaagaaaaagaggtacaaacttctatgaacgcagagaaccagaggctctgaccgcatctgggagcaggccaattcttccttggtgaaatgacatttgaactgagatgaaaggataagtaggcattagttagggaggtgttggggaggggggtgttttaagcagagggaa

SEQ ID NO: 23093 - DNA, 601 bp, Human
ggggggcagagagaaagagacaccatatgcaagcagatgtgatggccccccgcagttagacctggcacccgcctcttcagcacatttgcgctgttttcacgccgccttgacccacatccctgcccagtcccgccctctccctggcaccaagtcgtccttcttcaccttgagacgagccccagaggtttatgtgctactcatttctcctggcatcatgttgacaagcattactgcttcagaaacgtatagatttaatttctcttaaacacccatgggcctctaaagtaaaggagctggagakgatacagctgggtgtgggctgagcacaggctttctggaatatgcaggggatggggatagggtatgagaatccacggagcagaaatcctggggctactgactcttgaggagcaagggcaagtttttaagctttgtacagtgttggagacaaccaaggctttgccttcaaggagccctgttcgaaaccctgctttattttatttatttttttttagacagagttttgctctgtcacccaggctggtgtgcagtggcatgatctcagctcactgcaacccctgcctcccgggttcaagcaatt

SEQ ID NO: 23094 - DNA, 601 bp, Human
atgcaggggatggggatagggtatgagaatccacggagcagaaatcctggggctactgactcttgaggagcaagggcaagtttttaagctttgtacagtgttggagacaaccaaggctttgccttcaaggagccctgttcgaaaccctgctttattttatttatttttttttagacagagttttgctctgtcacccaggctggtgtgcagtggcatgatctcagctcactgcaacccctgcctcccgggttcaagcaattctcctgcctcagcctcccgtgtagctgggactacaggtgcrcaccaccacacctggctaatttttgtatttttagtagagacatggtttcccatgttggccaggctagtcttgaactcctgacttcaagtgatctgcctgcctcagcctcccaaaagtgctgggattacaggcatgattcaccgtgcctggccaaaactctgctttattatagcctgggcaacatagtgagaccctgtctctacaacaaaatttttaaaaattagctgagcttggtggcatacccctgtaatcccagctacctgggaggctgaggtgggaggatcacctgagcccagggag

SEQ ID NO: 23095 - DNA, 601 bp, Human
ctgcaacccctgcctcccgggttcaagcaattctcctgcctcagcctcccgtgtagctgggactacaggtgcgcaccaccacacctggctaatttttgtatttttagtagagacatggtttcccatgttggccaggctagtcttgaactcctgacttcaagtgatctgcctgcctcagcctcccaaaagtgctgggattacaggcatgattcaccgtgcctggccaaaactctgctttattatagcctgggcaacatagtgagaccctgtctctacaacaaaatttttaaaaattagctgrgcttggtggcatacccctgtaatcccagctacctgggaggctgaggtgggaggatcacctgagcccagggaggttgaggttgcagtgagctgtgattttgctgtgtagtgcagctgtgactacactctagcctgagctagtgagaccccatctcaaagaagaaaaaaaaaagcaaaccgtgctttgctaattgttagctgtgtgaccttggaccattgtttgatctctgagtatgtttcctcatctgtaaaaatgagagtaatggcccttgcctcttgtaatgttactggtattcagtgg

SEQ ID NO: 23096 - DNA, 601 bp, Human
ctcccaaaagtgctgggattacaggcatgattcaccgtgcctggccaaaactctgctttattatagcctgggcaacatagtgagaccctgtctctacaacaaaatttttaaaaattagctgagcttggtggcatacccctgtaatcccagctacctgggaggctgaggtgggaggatcacctgagcccagggaggttgaggttgcagtgagctgtgattttgctgtgtagtgcagctgtgactacactctagcctgagctagtgagaccccatctcaaagaagaaaaaaaaaagcaaaccrtgctttgctaattgttagctgtgtgaccttggaccattgtttgatctctgagtatgtttcctcatctgtaaaaatgagagtaatggcccttgcctcttgtaatgttactggtattcagtgggatagagcgcccaatacagctaatgaatggttggggttcaataaacagccatatgttccccccttcctctgagatcactgttaaaaatgtcataaaggccttaaagggaaaatagtatattggctcaggtaactgaaaaatccaaggctttcagtcaaggaaagacccaggtgctcaaa

SEQ ID NO: 23097 - DNA, 601 bp, Human
tgctggcttcattgcccagcaggctgtcaccaagtggtggcaaaatagtcaccaggagcttccttattttcccagagaaaagagaataccttattcccaatattcccagcagaagtcctgggactgactttcattgggccagcataggtcagaggtacatccttgcagcaatgactgtagcagaagaagtggactatgccctttggtcagcatggcccagagctcagtgtggggtcaacggcactaacaatgcagggaatgtgtgaattctccaaaggcaacatcggggggctgtgacccrtggaaggggagtggatactgggtgggaaaaccagacagtatccaccagagtgggtctctcctctctagagactgggttctcatgctagtcaggcaattggtggtctcagtcccctcctccccctctcacaggctgctcctggaactgaagcactcaaatattggccccttcccggtgagtctgaggcccttggtggcttcttcctccttctgacctggcggcggggagggggacatgtcataggctcaaggcattatttaagaggctactggctcatttgcatttaatttggttgtgaat

SEQ ID NO: 23098 - DNA, 601 bp, Human
ccacctgagtgagtgtagtatggtttaaatgggattaaacatgcacaatctggtagagaaaatctgctcaacaaatgtttgttggatgaacaaatgaattactttattgagcacctattatgtgccaagtactcttccaagtatggggtaggctgatgcatcagacagggaagtgatgccttctcagagccttacatggcagtgggaagacagcacaataagaaatgaaaggccaggcatggtggctcatgtccataatcccagcactttgggaggctgaagcaggaggactgcttgaggytaggacttcaagaccagcctgggcaacatagcaagacctcatctcttataaaaaataaaaattaggtgggtgtggtggcatgcacatgtagtcccagatacctgggagtctgaggcaggaggatggcttcagcccgggagttccaggttacacaagctaagatcatgctacactgcactccagcctgtgtgacagagtgaaatcttgtctcaaaaaaaaaaaaaaaaagagagagaagatcgtttcagtcacaatcaaagctataaaaaccaaagcggggatgggcggaaagtgatgagg

SEQ ID NO: 23099 - DNA, 601 bp, Human
ggttaggacttcaagaccagcctgggcaacatagcaagacctcatctcttataaaaaataaaaattaggtgggtgtggtggcatgcacatgtagtcccagatacctgggagtctgaggcaggaggatggcttcagcccgggagttccaggttacacaagctaagatcatgctacactgcactccagcctgtgtgacagagtgaaatcttgtctcaaaaaaaaaaaaaaaaagagagagaagatcgtttcagtcacaatcaaagctataaaaaccaaagcggggatgggcggaaagtgatgmgggagaatgaagagtcagaagatgtgatcagggagggcctctccgaggaggtgacgtttggactgaaggaggagaaggagccagcagaggaaacagcaggggcaaaagccctgtggtagagacaagcttggtgcgtttggggaatgaagggagcctgtgtgtctggagcagagcaagtagggggcatcggaagagatgtggccagaggggcaagcacaggctagctcatccagggtcttccgggctgagctagaggaggggagattgttgtgttgcacaggcagtgagaagccggtgcgc

SEQ ID NO: 23100 - DNA, 601 bp, Human
aaaaccaaagcggggatgggcggaaagtgatgagggagaatgaagagtcagaagatgtgatcagggagggcctctccgaggaggtgacgtttggactgaaggaggagaaggagccagcagaggaaacagcaggggcaaaagccctgtggtagagacaagcttggtgcgtttggggaatgaagggagcctgtgtgtctggagcagagcaagtagggggcatcggaagagatgtggccagaggggcaagcacaggctagctcatccagggtcttccgggctgagctagaggaggggagattgytgtgttgcacaggcagtgagaagccggtgcgctgtttccctgcagggagtgctgtgagtctatttatacctttgtaaaagcttcccctggctggggtggggggatagattacagacaaggggtcattgaggaggctggtgtgtttgtccacgtgagatgctggaggttgggactcagccaggcagaagagaaagatggtggattggagatatattttggaagtagatttagagagaccttagtgagagatatgagcctcttttataaagtgcatttaaatatttaatgaatattttgcac

SEQ ID NO: 23101 - DNA, 601 bp, Human
agaagagaaagatggtggattggagatatattttggaagtagatttagagagaccttagtgagagatatgagcctcttttataaagtgcatttaaatatttaatgaatattttgcacaccttcttttgcacccagcaccatactaggcacagtggggtataacatgtggtcaatgtctggcagatttagacacagcacagaagcctccctcatggctgtgtggtgagggaaaggattgtccaggtgacttctagggttttgggtggagcagttggatgaatggcagagctacgtactgacrtggagaaagggctggtaggagagggaagagcagggagaaacccagctcaagtaggtggttcgcctgcccaggaatcactgctcatcattaagtagatttgccgctactgccctcacgaggggcattgatgacgagttgcccctgttagtagtaagtagtcgcccatgctgttcaacaccagccacacagagcacctgccctgtgtctaacgtcagaagctgcagtctgctgatcctgtccagcgtcttgctacattgacctgaatctcctggtgggctctggttgaatcccagtttctgc

SEQ ID NO: 23102 - DNA, 601 bp, Human
cagaacctacagatttgcaaaagaaagaaaataaaaaccatgcatattttcatcacttagttaataatttggagtatatccttcctgaccttttgctatgcctatttaattaaaaaatggaatgatgtgatttctatagcctggttctcctcactcaaaaacatatcatggttatgtctgtgttgttacttacatttctacaatatcattcttaacagttgcataatatttccttgtattaaagtattaccattttccaccaagtgattcccctattgttggacatggagattgcttttartttattgttttggataaatttgttgctttggtcaacattcttgcatccacattttttcctacaccctacattatttccttaggataaattcctcagaggcatgtttgctagcccaaaaggcacacgggtcttgctgtgttgcccaggctggtcttgaactcctcctggtctcaagtgatcttctcgcctcagcctcccaaagcactgctgttacagtcatgaaccaccaagcccaaccaggcacacacaggctttggaagaacattgtgccaaatagccgtcaaagaggttgatttgatt

SEQ ID NO: 23103 - DNA, 601 bp, Human
tttaatttattgttttggataaatttgttgctttggtcaacattcttgcatccacattttttcctacaccctacattatttccttaggataaattcctcagaggcatgtttgctagcccaaaaggcacacgggtcttgctgtgttgcccaggctggtcttgaactcctcctggtctcaagtgatcttctcgcctcagcctcccaaagcactgctgttacagtcatgaaccaccaagcccaaccaggcacacacaggctttggaagaacattgtgccaaatagccgtcaaagaggttgattygatttgccctcttactgcagtgtctgagaggactcattttttaagctaagcttttcccatttaaatactctctgatgagcttcctcatgattgtcgtgagttgtaaggccttgcaccttacaattgagaacatgctttacatctggaaccattggagcaaaagaaaccacttccatgaccttgattgggctgccaagtattcacatatcacttgcgtccacctctcagcagttttcccaactgcgcggttgctgagcagcgctaggggaaaggagggtgacagaggtggggtgatgagga

SEQ ID NO: 23104 - DNA, 601 bp, Human
tcccaaagcactgctgttacagtcatgaaccaccaagcccaaccaggcacacacaggctttggaagaacattgtgccaaatagccgtcaaagaggttgatttgatttgccctcttactgcagtgtctgagaggactcattttttaagctaagcttttcccatttaaatactctctgatgagcttcctcatgattgtcgtgagttgtaaggccttgcaccttacaattgagaacatgctttacatctggaaccattggagcaaaagaaaccacttccatgaccttgattgggctgccaagtrttcacatatcacttgcgtccacctctcagcagttttcccaactgcgcggttgctgagcagcgctaggggaaaggagggtgacagaggtggggtgatgaggactgctggacccgcaaggttctggcgatgcagggccatcctcccatcctccctctgatttccaggttgaattgctgcaggatatcatgaactacattgtacccattcttgtgctgcccagggttaacggtaaggaactttgaagaaaccattcattttcagtcatgggggaagagggtggggttgattacccacagccac

SEQ ID NO: 23105 - DNA, 601 bp, Human
gcaaaagtactaatagaggcccatataacctgtgactaggatatttagaacttaccaattaatccaacaaattatcatatgaaatatgatacatcagtcctgggatctgtcctcctaccttgacaaatgtagctttgtaatgacctgggaggccacgttctaatttagagttctccaaagttccgtgtcagaatgtggcagtatgtggggggcttgccctggccactgtccacctctggctttatcctaaatgttgaggggtttcatgctcacatgcataaatacccctattacacaccaygctctagtcacaccattgcaagcagcagatttttggtttagtgtataccagcagtgctgcaccctcaggagggccatcatggggatggagtccacgcaggtgctagaagtggacttggggttgatggacaacaggtgggaggtacggactctggggcagccttcctttcaggcatgtatgcccatgccagtccctacctagggccaggcatgctggttcagggaggctgtctacccaggctctctggccctccctcctcccctgcccttctctttcttttctcctggtcctcaccatcgg

SEQ ID NO: 23106 - DNA, 601 bp, Human
aacatgtggtcgacgtctggcagatttagacacagcacagaagtctccttcgtggctttcgcccaggctgacttccgtctgcatttgacactgatgcgcttcctgggcatgctttcttctcttagtttccagcactcccctagctcttggttgtctacctgccacctcctctgcttgttctcctgccccttctctgcaagctggagatctccaggacccctccccaggcctcttctcttcccccgccattggcaagccttcgtcactcttgtcaacctcttcaggcttagctgccacctgygtgccacccaatgtcccagacatgcttccagtctttttattttttccaaactctcagcttgtgcattcgcaggctccctcaatgtctccaccctgaggcctcttaaacccagcatgtccccacaaagctgtcacctccgcagcgaaaccgtcacccagcttgcatttctcaccttggtcaaaggctttcctgataacttgtggccctcctggggagcctcgcatcacccagatccctccctctccctttcccccaatgtccaggccatcaatcctcaattctttagaccagggagctaat

SEQ ID NO: 23107 - DNA, 601 bp, Human
gtgtctaagaaggaggcagcttccagggaagctgctgacagattcgcagatgttggcagctgtggatgtgtagatccgggcagcgaaacactgagtgacccccactggccctgcctttctccttcctaagaggcaggctcccaaaatgtccttcttaaaactccagtagctccacactcacaaacaaggggtgcatcttcaactggtgacaacattctcatctctccctagaacttcctgctgttcggtgcagacgttgtctataaatgaaggcaccaggggtgccgggggctgtcagccrcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtggattctgtgtgc

SEQ ID NO: 23108 - DNA, 601 bp, Human
caaaagtggggtttctcaccacacacacacacgcgcacacacggctacaccgctgcacggcggcgctgccagcactgcagactccacctgcttcccaggctgcaggcagctctggccagtaagccccaggctaagctttctgctcagaagaaacccttctcagtctcctgcacaaatgcacaaaaggaacaaaactgtgaaccaccctacccagcagggagagaccaaaggtctttcacccacttggctgtccaaattagctcaatgtgggaacctcgtgctgtgcttgaaacccagtcargcctggctgggtttccacagggctggcgggggcggcttatcttccgcgctcacctcacccatgggctcctatctgtgtctccccagagagctggccgcagtgctggggccaggcccttgcccaggagacattcgataaagggccactttggttaccaggaagacgaaatctcagacgtaggtcaggagttagctggcaaagcctctggaagaaggagccccctccccagcctctgcccaaggccccctacggctcaatgcccaggacagaggctcgaagcccttgctcttgacccttcag

SEQ ID NO: 23109 - DNA, 601 bp, Human
agctagcacaccccggccctccggtccccgacaagcccacaggagacgcggacggccaaccttgggcactcaccccacccggctgtgccccaccaacccgcagacgcccctgaagcaagtttcaggagaggcaaacacagtcacgaattcacagagcaaacagcagtgtccaccccacacgggccaaggctgtgttgcccagaccttgtggtcttcacgagtcagtccccagcaaaagtggggtttctcaccacacacacacacgcgcacacacggctacaccgctgcacggcggcgctgycagcactgcagactccacctgcttcccaggctgcaggcagctctggccagtaagccccaggctaagctttctgctcagaagaaacccttctcagtctcctgcacaaatgcacaaaaggaacaaaactgtgaaccaccctacccagcagggagagaccaaaggtctttcacccacttggctgtccaaattagctcaatgtgggaacctcgtgctgtgcttgaaacccagtcaggcctggctgggtttccacagggctggcgggggcggcttatcttccgcgctcacctcacccatgggctc

SEQ ID NO: 23110 - DNA, 601 bp, Human
cagcatcgctcccaaagggaccaaaaggctttggatggaacaaccctgtgtccctccggatgctgatgatgctggtgtctgtgtattgacgtgtcactgggggtgggggggcgtccggaagagaaagcctccatagaggctcctcggggacaatgcagagcgcccccaccccacggaccaccccatctcgcccgccgcaccaggagcctccacccatgagcagcaggaggagggacggcgcctgaccctcggccacagccccagaaaggttagaattcgattctggccacatgagacgtarcccatgttctcaagtaaagtcaccttcatctaaaaacagcctccgcctccttgcccagggctcagggccaggcaggccgcgtggtacttgtacacaagcagccccgcaggataaggctgcccgcccccacccgccctcctccccacccaccccagtgctcagacagcagccagcgagaacagctctgggaagcagcctcgggcacctcccccacccacccccaccggccgcagccaggcactcccactcctctcatctgaggctcgggggtgaagccctccaccctcgggacccagctag

SEQ ID NO: 23111 - DNA, 601 bp, Human
acacacacacacaaggacacacgtctgcaaacacacacaacacatacacacgtgcatatgcgtgcacacggctccgaggctgcgtggcagtgcacaggtcacggcccccaaggccacggggacaggaatgttcacgtctgagcacctcaggtgagctctgggcaggcgcagttgacaagttttggcagcgccattttctttctcctcttcttcttttttttttttttgagacagagtctcactctgttcagcagtggtgtaatctcagctcaccgcaacctctgcctcccgggttcaagcrattctcctgcctcagcctcccaagtagctgggattacaggtgcctgccaccacactcagctaatattttgtatttttagtagagacggggtttcaccattttggccaggctggtattgaacccctgacctcgtgatccaccctcttgggcctcccaaagtgctgggattacaggcgtgagccaccgcgcctggctggcagtgccattttcacaaagggatctcctcctggtaacctacatttcttgggagttaagatttcccagactgcaacactggcagctatgtgcagagctgggcga

SEQ ID NO: 23112 - DNA, 601 bp, Human
aaaatcccttagaacgagatgctgcgaaggacacagaaggttctgagacctgcaagcctgggctgagcttggagggcccctcaggcttgcagtatggacgctcagggagggagccgggcaggcgcccggggaagcagaaacgacggaacggatggcacgagggtcgaggggaggacgaggacccacctgctggagggcagagccctgcctgccccgagccaggccgcccagcgctggtggtcaggcggcgagcccacccccttcaggtccgggcccctccgtccaggcggtgggcccaacrgggcacagcgggacggagaggggaggaggcgtctgggttctactgagcaggagccgggaggcgagcggcacaggagggaaactgagggaggcggggagggaggtgcccgccactcacgttccaggactagcacgactgcctgggcgcggacccacttgaccctgggcgcccgggtcaggtggttgcgatccgggtcgttgctggcccggcactcgtaagtgcccgtgtcctcctccacgagcgtgtcgatggagatggtgctggccgcgtgctggtggtaggtggcgtggatgtggacgc

SEQ ID NO: 23113 - DNA, 601 bp, Human
gaggctcacgcctgtaatcccagcactttgggaggccaaggcgggtggatctcgaggtcgggagatcgagaccatcctggctaacacggtgaaaccccgtctcttctaaaaatacaaaaaattagctgggcatgttggctcatgcctgtaatcccagctactcaggaggctgaggcagaagaatcgcttgaacccgggaggcggaagttgcagtgagccgagattgtgccaccacactccacctgggaacagcaagactccatctccaggaaaaaaaaaaaaaatagccacagcaccccctgccaaggctcccgtgcccttctctaggaggcactcaggtggccccacatccccccagccccaggctgacggcactccagcagtgctgggagcaccccggttcttctgccaatccccaaccaagcaaatctcttggttcttggttagtttacaatattcccgctaggaattgaaatttgaaaatcccttagaacgagatgctgcgaaggacacagaaggttctgagacctgcaagcctgggctgagcttggagggcccctcaggcttgcagtatggacgctcagggagggagccgggcagg

SEQ ID NO: 23114 - DNA, 601 bp, Human
ccccagcacaaactggaaattcttttctaaaaacgtagccagctgggcgcggtggtggccgggcgcggaggctcacgcctgtaatcccagcactttgggaggccaaggcgggtggatctcgaggtcgggagatcgagaccatcctggctaacacggtgaaaccccgtctcttctaaaaatacaaaaaattagctgggcatgttggctcatgcctgtaatcccagctactcaggaggctgaggcagaagaatcgcttgaacccgggaggcggaagttgcagtgagccgagattgtgccaccrcactccacctgggaacagcaagactccatctccaggaaaaaaaaaaaaaatagccacagcacccccggccaaggctcccgtgcccttctctaggaggcactcaggtggccccacatccccccagccccaggctgacggcactccagcagtgctgggagcaccccggttcttctgccaatccccaaccaagcaaatctcttggttcttggttagtttacaatattcccgctaggaattgaaatttgaaaatcccttagaacgagatgctgcgaaggacacagaaggttctgagacctgcaa

SEQ ID NO: 23115 - DNA, 601 bp, Human
ttgtagcagccccagcacaaactggaaattcttttctaaaaacgtagccagctgggcgcggtggtggccgggcgcggaggctcacgcctgtaatcccagcactttgggaggccaaggcgggtggatctcgaggtcgggagatcgagaccatcctggctaacacggtgaaaccccgtctcttctaaaaatacaaaaaattagctgggcatgttggctcatgcctgtaatcccagctactcaggaggctgaggcagaagaatcgcttgaacccgggaggcggaagttgcagtgagccgagatygtgccaccacactccacctgggaacagcaagactccatctccaggaaaaaaaaaaaaaatagccacagcacccccggccaaggctcccgtgcccttctctaggaggcactcaggtggccccacatccccccagccccaggctgacggcactccagcagtgctgggagcaccccggttcttctgccaatccccaaccaagcaaatctcttggttcttggttagtttacaatattcccgctaggaattgaaatttgaaaatcccttagaacgagatgctgcgaaggacacagaaggttctga

SEQ ID NO: 23116 - DNA, 601 bp, Human
agcccagcgcctgctgaggaggccccttcgggaaggcacccccttcgggaaggcacccttcgctggcagctggcgggccctgggctaaggcgctgggaacccagaggccccgcctggcgatgttcctgcccagagacacacgaggctgggaccagggtgtggggacagacaaggcacccacccacgtccctgagcagggaccagggcatcgagctcttgtagcagccccagcacaaactggaaattcttttctaaaaacgtagccagctgggcgcggtggtggccgggcgcggaggctcaygcctgtaatcccagcactttgggaggccaaggcgggtggatctcgaggtcgggagatcgagaccatcctggctaacacggtgaaaccccgtctcttctaaaaatacaaaaaattagctgggcatgttggctcatgcctgtaatcccagctactcaggaggctgaggcagaagaatcgcttgaacccgggaggcggaagttgcagtgagccgagattgtgccaccacactccacctgggaacagcaagactccatctccaggaaaaaaaaaaaaaatagccacagcacccccggccaaggc

SEQ ID NO: 23117 - DNA, 601 bp, Human
ctggccacgcctccgggaagggaagagcccagcgcctgctgaggaggccccttcgggaaggcacccccttcgggaaggcacccttcgctggcagctggcgggccctgggctaaggcgctgggaacccagaggccccgcctggcgatgttcctgcccagagacacacgaggctgggaccagggtgtggggacagacaaggcacccacccacgtccctgagcagggaccagggcatcgagctcttgtagcagccccagcacaaactggaaattcttttctaaaaacgtagccagctgggcgcrgtggtggccgggcgcggaggctcacgcctgtaatcccagcactttgggaggccaaggcgggtggatctcgaggtcgggagatcgagaccatcctggctaacacggtgaaaccccgtctcttctaaaaatacaaaaaattagctgggcatgttggctcatgcctgtaatcccagctactcaggaggctgaggcagaagaatcgcttgaacccgggaggcggaagttgcagtgagccgagattgtgccaccacactccacctgggaacagcaagactccatctccaggaaaaaaaaaaaaaa

SEQ ID NO: 23118 - DNA, 601 bp, Human
cgaccggtcttttgttctcacggaccacaggccgctggcggcaagagagccgtgagaaggggcaggtggcggcatggcgtggtcaggcactcacttgaactccgttttctggccgggcagcgcgtcctccttcagcaccacgccccccttcagccagcggtgccctgtgacctctgtggcgctgtcattcaaggagcaggtgaggagtatcttggagccaaggtcttctacggtagtgaagactgtgccggctgcaaggcccggcgagacgcggtcagcagagtggaggagcacggcccgygctgcctgcctgacccccaggaacctgcggctcctccccgggaaggactggttttcatcccaaaaatacaccgtggcccttacgccccgaggaccggaggcccaaggggaacttctggccacgcctccgggaagggaagagcccagcgcctgctgaggaggccccttcgggaaggcacccccttcgggaaggcacccttcgctggcagctggcgggccctgggctaaggcgctgggaacccagaggccccgcctggcgatgttcctgcccagagacacacgaggctgggaccagggtgtg

SEQ ID NO: 23119 - DNA, 601 bp, Human
ctggcagtgtggcgccctttcgtgcccgggacctagtgaggagcaagcaatggggactcctgccagggctgctggagccccctgcctcacaaggacgcccctcagacccctccctggggtttccctctgggggtctgcgcggagctggtccctaacttccgcctggatcaagcctgccgaccggtcttttgttctcacggaccacaggccgctggcggcaagagagccgtgagaaggggcaggtggcggcatggcgtggtcaggcactcacttgaactccgttttctggccgggcagcgcrtcctccttcagcaccacgccccccttcagccagcggtgccctgtgacctctgtggcgctgtcattcaaggagcaggtgaggagtatcttggagccaaggtcttctacggtagtgaagactgtgccggctgcaaggcccggcgagacgcggtcagcagagtggaggagcacggcccgcgctgcctgcctgacccccaggaacctgcggctcctccccgggaaggactggttttcatcccaaaaatacaccgtggcccttacgccccgaggaccggaggcccaaggggaacttctggccacg

SEQ ID NO: 23120 - DNA, 601 bp, Human
ggcatgcctcagtgtggtgccctcttgtgccaggagcacagagcctgggaggcccgcacacgtgcccgggacctggcagtgtggcgccctttcgtgcccgggacctagtgaggagcaagcaatggggactcctgccagggctgctggagccccctgcctcacaaggacgcccctcagacccctccctggggtttccctctgggggtctgcgcggagctggtccctaacttccgcctggatcaagcctgccgaccggtcttttgttctcacggaccacaggccgctggcggcaagagagccrtgagaaggggcaggtggcggcatggcgtggtcaggcactcacttgaactccgttttctggccgggcagcgcgtcctccttcagcaccacgccccccttcagccagcggtgccctgtgacctctgtggcgctgtcattcaaggagcaggtgaggagtatcttggagccaaggtcttctacggtagtgaagactgtgccggctgcaaggcccggcgagacgcggtcagcagagtggaggagcacggcccgcgctgcctgcctgacccccaggaacctgcggctcctccccgggaaggactgg

SEQ ID NO: 23121 - DNA, 601 bp, Human
tggggtccgagcagggcatgcctcagtgtggtgccctcttgtgccaggagcacagagcctgggaggcccgcacacgtgcccgggacctggcagtgtggcgccctttcgtgcccgggacctagtgaggagcaagcaatggggactcctgccagggctgctggagccccctgcctcacaaggacgcccctcagacccctccctggggtttccctctgggggtctgcgcggagctggtccctaacttccgcctggatcaagcctgccgaccggtcttttgttctcacggaccacaggccgctgrcggcaagagagccgtgagaaggggcaggtggcggcatggcgtggtcaggcactcacttgaactccgttttctggccgggcagcgcgtcctccttcagcaccacgccccccttcagccagcggtgccctgtgacctctgtggcgctgtcattcaaggagcaggtgaggagtatcttggagccaaggtcttctacggtagtgaagactgtgccggctgcaaggcccggcgagacgcggtcagcagagtggaggagcacggcccgcgctgcctgcctgacccccaggaacctgcggctcctcc

SEQ ID NO: 23122 - DNA, 601 bp, Human
ctggatgttggccgtgcccatgggctcggggaggaagacgcaggagtactctccccactggtcgtcggagtccaccctgcaaccacagcaggcaggtgagccgcgtaccagctctgcaggacgcctccaaggacccagggttctccaggggcccaaccacggcacagtgaaaaagcaaaactgtcccagtcaagtctgaacctcaaaagaactcctggggtccccgtgcggccccaaggacagagccaggctggcaagaccccacaggtgagagaaccaacagacccccttctccccgacygatgaaccccacacctctggtccctgctctgcaccccacaccctgtgaccgtcttcccagtcagcctgaaaacaaaaggctctgtgctcccagggccgtcccagccccagttatgacaaagctccggccatgacagcgtctggggtccgagcagggcatgcctcagtgtggtgccctcttgtgccaggagcacagagcctgggaggcccgcacacgtgcccgggacctggcagtgtggcgccctttcgtgcccgggacctagtgaggagcaagcaatggggactcctgccagggctgctg

SEQ ID NO: 23123 - DNA, 601 bp, Human
tcaccgtggagctggatgttggccgtgcccatgggctcggggaggaagacgcaggagtactctccccactggtcgtcggagtccaccctgcaaccacagcaggcaggtgagccgcgtaccagctctgcaggacgcctccaaggacccagggttctccaggggcccaaccacggcacagtgaaaaagcaaaactgtcccagtcaagtctgaacctcaaaagaactcctggggtccccgtgcggccccaaggacagagccaggctggcaagaccccacaggtgagagaaccaacagacccccttctccccgactgatgaaccccacacctctggtccctgctctgcaccccacaccctgtgaccgtcttcccagtcagcctgaaaacaaaaggctctgtgctcccagggccgtcccagccccagttatgacaaagctccggccatgacagcgtctggggtccgagcagggcatgcctcagtgtggtgccctcttgtgccaggagcacagagcctgggaggcccgcacacgtgcccgggacctggcagtgtggcgccctttcgtgcccgggacctagtgaggagcaagcaatggggactcctgc

SEQ ID NO: 23124 - DNA, 601 bp, Human
ccctccagggagcagggggccagggctctgggatgtgccgggtgcctcaggccaacaacttctcccgacagtcggtggtgcccggtacccctggctgcaggactcaccgtggagctggatgttggccgtgcccatgggctcggggaggaagacgcaggagtactctccccactggtcgtcggagtccaccctgcaaccacagcaggcaggtgagccgcgtaccagctctgcaggacgcctccaaggacccagggttctccaggggcccaaccacggcacagtgaaaaagcaaaactgtccsagtcaagtctgaacctcaaaagaactcctggggtccccgtgcggccccaaggacagagccaggctggcaagaccccacaggtgagagaaccaacagacccccttctccccgactgatgaaccccacacctctggtccctgctctgcaccccacaccctgtgaccgtcttcccagtcagcctgaaaacaaaaggctctgtgctcccagggccgtcccagccccagttatgacaaagctccggccatgacagcgtctggggtccgagcagggcatgcctcagtgtggtgccctcttgtgcca

SEQ ID NO: 23125 - DNA, 601 bp, Human
tgagagagaggagcctggaaccgcaggcccgcccccatccccggcctcccgcaggagggctgttcccctccagggagcagggggccagggctctgggatgtgccgggtgcctcaggccaacaacttctcccgacagtcggtggtgcccggtacccctggctgcaggactcaccgtggagctggatgttggccgtgcccatgggctcggggaggaagacgcaggagtactctccccactggtcgtcggagtccaccctgcaaccacagcaggcaggtgagccgcgtaccagctctgcaggaygcctccaaggacccagggttctccaggggcccaaccacggcacagtgaaaaagcaaaactgtcccagtcaagtctgaacctcaaaagaactcctggggtccccgtgcggccccaaggacagagccaggctggcaagaccccacaggtgagagaaccaacagacccccttctccccgactgatgaaccccacacctctggtccctgctctgcaccccacaccctgtgaccgtcttcccagtcagcctgaaaacaaaaggctctgtgctcccagggccgtcccagccccagttatgacaaag

SEQ ID NO: 23126 - DNA, 601 bp, Human
tccggagggctgggtccgggacccccagtctaggcccctcacccagtcctgagggctgggtccgggacccccagtctacgcccctcacccagtcctgagggctgggtccgggacccccagtctaggcctctcacccagtcctgagggctgggtctgggacccccagcctccttggcttctcaccttgtcctcagagtcagtgatcttgtaccaggcccagtcagtgacaggtggcacggactctgacttgcagaccagcatggccgtctccccctcgttgatgtgttctgacgacttcacrgccttcactctgggaggccctgacaggagggtgagagagaggagcctggaaccgcaggcccgcccccatccccggcctcccgcaggagggctgttcccctccagggagcagggggccagggctctgggatgtgccgggtgcctcaggccaacaacttctcccgacagtcggtggtgcccggtacccctggctgcaggactcaccgtggagctggatgttggccgtgcccatgggctcggggaggaagacgcaggagtactctccccactggtcgtcggagtccaccctgcaaccacagca

SEQ ID NO: 23127 - DNA, 601 bp, Human
cagtctaggcccctcacccagtctggagggctgcagtccagagggctgggtccgggacccccagtctaggcccctcacccagtccggagggctgggtccgggacccccagtctaggcccctcacccagtccggagggctgggtccgggacccccagtctaggcccctcacccagtcctgagggctgggtccgggacccccagtctacgcccctcacccagtcctgagggctgggtccgggacccccagtctaggcctctcacccagtcctgagggctgggtctgggacccccagcctcctkggcttctcaccttgtcctcagagtcagtgatcttgtaccaggcccagtcagtgacaggtggcacggactctgacttgcagaccagcatggccgtctccccctcgttgatgtgttctgacgacttcacagccttcactctgggaggccctgacaggagggtgagagagaggagcctggaaccgcaggcccgcccccatccccggcctcccgcaggagggctgttcccctccagggagcagggggccagggctctgggatgtgccgggtgcctcaggccaacaacttctcccgacagtcggt

SEQ ID NO: 23128 - DNA, 601 bp, Human
gctgggtccgggacccccagtctaggcccctcacccagtctggagggctgcagtccagagggctgggtccgggacccccagtctaggcccctcacccagtccggagggctgggtccgggacccccagtctaggcccctcacccagtccggagggctgggtccgggacccccagtctaggcccctcacccagtcctgagggctgggtccgggacccccagtctacgcccctcacccagtcctgagggctgggtccgggacccccagtctaggcctctcacccagtcctgagggctgggtctrggacccccagcctccttggcttctcaccttgtcctcagagtcagtgatcttgtaccaggcccagtcagtgacaggtggcacggactctgacttgcagaccagcatggccgtctccccctcgttgatgtgttctgacgacttcacagccttcactctgggaggccctgacaggagggtgagagagaggagcctggaaccgcaggcccgcccccatccccggcctcccgcaggagggctgttcccctccagggagcagggggccagggctctgggatgtgccgggtgcctcaggccaacaac

SEQ ID NO: 23129 - DNA, 601 bp, Human
ggctgggtccgggacccccagtctaggcccctcacccagtctggagggctgcagtccagagggctgggtccgggacccccagtctaggcccctcacccagtccggagggctgggtccgggacccccagtctaggcccctcacccagtccggagggctgggtccgggacccccagtctaggcccctcacccagtcctgagggctgggtccgggacccccagtctacgcccctcacccagtcctgagggctgggtccgggacccccagtctaggcctctcacccagtcctgagggctgggtcygggacccccagcctccttggcttctcaccttgtcctcagagtcagtgatcttgtaccaggcccagtcagtgacaggtggcacggactctgacttgcagaccagcatggccgtctccccctcgttgatgtgttctgacgacttcacagccttcactctgggaggccctgacaggagggtgagagagaggagcctggaaccgcaggcccgcccccatccccggcctcccgcaggagggctgttcccctccagggagcagggggccagggctctgggatgtgccgggtgcctcaggccaacaa

SEQ ID NO: 23130 - DNA, 601 bp, Human
tggccggggtcggcctccatgttcaggttctcaatgtgtagctctgaccggccctgcgaggaactcacgaagaacctgctctcggagccgttcatgagggcctaggggaccaaaggcaagggctgagtccaggacccccagtctaggcccctcacccagtcctgagggctgagtccgggacccccagtctaggcccctcacccagtccggagggctgagtccgggacccccagtctaggcccctcacccagtccggagggctgggtccgggacccccagtctaggcccctcacccagtcckgagggctgggtccgggacccccagtctaggcccctcacccagtctggagggctgcagtccagagggctgggtccgggacccccagtctaggcccctcacccagtccggagggctgggtccgggacccccagtctaggcccctcacccagtccggagggctgggtccgggacccccagtctaggcccctcacccagtcctgagggctgggtccgggacccccagtctacgcccctcacccagtcctgagggctgggtccgggacccccagtctaggcctctcacccagtcctgagggctgg

SEQ ID NO: 23131 - DNA, 601 bp, Human
agagggcggccaggtggctgcgcacgcggagcgtgatgatggcctggtcggagcccttggagctggtgccgttgcaccggtactggccggggtcggcctccatgttcaggttctcaatgtgtagctctgaccggccctgcgaggaactcacgaagaacctgctctcggagccgttcatgagggcctaggggaccaaaggcaagggctgagtccaggacccccagtctaggcccctcacccagtcctgagggctgagtccgggacccccagtctaggcccctcacccagtccggagggctgrgtccgggacccccagtctaggcccctcacccagtccggagggctgggtccgggacccccagtctaggcccctcacccagtcctgagggctgggtccgggacccccagtctaggcccctcacccagtctggagggctgcagtccagagggctgggtccgggacccccagtctaggcccctcacccagtccggagggctgggtccgggacccccagtctaggcccctcacccagtccggagggctgggtccgggacccccagtctaggcccctcacccagtcctgagggctgggtccgggac

SEQ ID NO: 23132 - DNA, 601 bp, Human
gatggtgaccagcaccagcacctcagccacgatgcccaggaagggccagagggcggccaggtggctgcgcacgcggagcgtgatgatggcctggtcggagcccttggagctggtgccgttgcaccggtactggccggggtcggcctccatgttcaggttctcaatgtgtagctctgaccggccctgcgaggaactcacgaagaacctgctctcggagccgttcatgagggcctaggggaccaaaggcaagggctgagtccaggacccccagtctaggcccctcacccagtcctgagggctgagtccgggacccccagtctaggcccctcacccagtccggagggctgagtccgggacccccagtctaggcccctcacccagtccggagggctgggtccgggacccccagtctaggcccctcacccagtcctgagggctgggtccgggacccccagtctaggcccctcacccagtctggagggctgcagtccagagggctgggtccgggacccccagtctaggcccctcacccagtccggagggctgggtccgggacccccagtctaggcccctcacccagtccggagggctgggtccggga

SEQ ID NO: 23133 - DNA, 601 bp, Human
ggacgtcctcgggcttccggcgcttctcgtagatgaagatgatggtgaccagcaccagcacctcagccacgatgcccaggaagggccagagggcggccaggtggctgcgcacgcggagcgtgatgatggcctggtcggagcccttggagctggtgccgttgcaccggtactggccggggtcggcctccatgttcaggttctcaatgtgtagctctgaccggccctgcgaggaactcacgaagaacctgctctcggagccgttcatgagggcctaggggaccaaaggcaagggctgagtccrggacccccagtctaggcccctcacccagtcctgagggctgagtccgggacccccagtctaggcccctcacccagtccggagggctgagtccgggacccccagtctaggcccctcacccagtccggagggctgggtccgggacccccagtctaggcccctcacccagtcctgagggctgggtccgggacccccagtctaggcccctcacccagtctggagggctgcagtccagagggctgggtccgggacccccagtctaggcccctcacccagtccggagggctgggtccgggaccccca

SEQ ID NO: 23134 - DNA, 601 bp, Human
gttcttgcctttgtcattctggtgctgcccgctgctcttcctggggcacgaggggccgggtgagagggtgtcccccgcaagtcactctctccaagtcacccctgcccaccccggcccccaggacccccgaatactgaagcccaggggctctgcctttgtgttttaaaggcctggggcagcaggccgctccttgggacccccgacccccacagctggaacttacaggggtgcagagccggcgtcgtcatctgaagaaggaccgccgccatgaaaaagaggacgagaggacagcctgtcagcrctggccccactcaggccccgagcaggggcatctgtgctgccagccctgccctcagtgacccccaggggtggctcggggcagctcatcagccccggccacgtgcatcttctgagtgctgtggggaaaggcagccctccccacctgcaggtgtgctccccatggtgagctgtccccatggcctcgtgggcctcacccctgccccacagcgttttccaggagctgccatcacaggccccacacaggcctcgccccggcacacgcagcccaaggggcagaagggctccgcgaggaggcaggcag

SEQ ID NO: 23135 - DNA, 601 bp, Human
gggagcgtcctcgggccacctgtggacagggaggggcgctcagactggacccacctcccagcgacccacaggcgggacccaggagcccacacctggctagcagatcccgcccaccacacctggctcaggagttcccgcccacccacccaccacacctggctcaggaggagctcccgcccaccgcacctgcctcaggaagagttcctctggcggacgttcttgcctttgtcattctggtgctgcccgctgctcttcctggggcacgaggggccgggtgagagggtgtcccccgcaagtcacyctctccaagtcacccctgcccaccccggcccccaggacccccgaatactgaagcccaggggctctgcctttgtgttttaaaggcctggggcagcaggccgctccttgggacccccgacccccacagctggaacttacaggggtgcagagccggcgtcgtcatctgaagaaggaccgccgccatgaaaaagaggacgagaggacagcctgtcagcactggccccactcaggccccgagcaggggcatctgtgctgccagccctgccctcagtgacccccaggggtggctcggggcagctca

SEQ ID NO: 23136 - DNA, 601 bp, Human
tgggagtggactccggcggcggcgcagacgtggagcagggagcgtcctcgggccacctgtggacagggaggggcgctcagactggacccacctcccagcgacccacaggcgggacccaggagcccacacctggctagcagatcccgcccaccacacctggctcaggagttcccgcccacccacccaccacacctggctcaggaggagctcccgcccaccgcacctgcctcaggaagagttcctctggcggacgttcttgcctttgtcattctggtgctgcccgctgctcttcctggggcaygaggggccgggtgagagggtgtcccccgcaagtcactctctccaagtcacccctgcccaccccggcccccaggacccccgaatactgaagcccaggggctctgcctttgtgttttaaaggcctggggcagcaggccgctccttgggacccccgacccccacagctggaacttacaggggtgcagagccggcgtcgtcatctgaagaaggaccgccgccatgaaaaagaggacgagaggacagcctgtcagcactggccccactcaggccccgagcaggggcatctgtgctgccagccctg

SEQ ID NO: 23137 - DNA, 601 bp, Human
aagccacagacggggccgcagggcagcagctcccgggctctcgtgaaacacttcagaaggaaaaaaacctaaggaacagaatcctgaatggagaaaacccaacttttttaaaaaagaaggaagtgtatgatgggaatctacggggtgggttttctttaagaggtgagaacttggaatcttgcaagcactgggagtggactccggcggcggcgcagacgtggagcagggagcgtcctcgggccacctgtggacagggaggggcgctcagactggacccacctcccagcgacccacaggcggracccaggagcccacacctggctagcagatcccgcccaccacacctggctcaggagttcccgcccacccacccaccacacctggctcaggaggagctcccgcccaccgcacctgcctcaggaagagttcctctggcggacgttcttgcctttgtcattctggtgctgcccgctgctcttcctggggcacgaggggccgggtgagagggtgtcccccgcaagtcactctctccaagtcacccctgcccaccccggcccccaggacccccgaatactgaagcccaggggctctgcctttgtgt

SEQ ID NO: 23138 - DNA, 601 bp, Human
aagggcaaggacctggcactgactccggccagtggagaaggctgtgccgcccacccggccatgactcagacccagaggctgaaagccacagacggggccgcagggcagcagctcccgggctctcgtgaaacacttcagaaggaaaaaaacctaaggaacagaatcctgaatggagaaaacccaacttttttaaaaaagaaggaagtgtatgatgggaatctacggggtgggttttctttaagaggtgagaacttggaatcttgcaagcactgggagtggactccggcggcggcgcagacgyggagcagggagcgtcctcgggccacctgtggacagggaggggcgctcagactggacccacctcccagcgacccacaggcgggacccaggagcccacacctggctagcagatcccgcccaccacacctggctcaggagttcccgcccacccacccaccacacctggctcaggaggagctcccgcccaccgcacctgcctcaggaagagttcctctggcggacgttcttgcctttgtcattctggtgctgcccgctgctcttcctggggcacgaggggccgggtgagagggtgtcccccgca

SEQ ID NO: 23139 - DNA, 601 bp, Human
aagaggtcagagtcgtccctgaggctgagtcgaacacagacccgtggccctcataaaattaaacataaaagcacaaaaatggcgcaaccagacagcattggcttcagacaggcaggacacggggcccctcgtgtgacctgtgactttccacaaagggcaaggacctggcactgactccggccagtggagaaggctgtgccgcccacccggccatgactcagacccagaggctgaaagccacagacggggccgcagggcagcagctcccgggctctcgtgaaacacttcagaaggaaaaaawcctaaggaacagaatcctgaatggagaaaacccaacttttttaaaaaagaaggaagtgtatgatgggaatctacggggtgggttttctttaagaggtgagaacttggaatcttgcaagcactgggagtggactccggcggcggcgcagacgtggagcagggagcgtcctcgggccacctgtggacagggaggggcgctcagactggacccacctcccagcgacccacaggcgggacccaggagcccacacctggctagcagatcccgcccaccacacctggctcaggagttcccgcccac

SEQ ID NO: 23140 - DNA, 601 bp, Human
ctcacatcagttatcttgctgctccagaagggtgggagatggcagttttcccaagctccggtctccccagatgtctgctcaccctcattctcctccagctgcccaaactggattcaggtaagtctctctctctctctgggctgcatagttgaaatatatcaataaatgtaaaataaacaatcccacttggctctccctggagacctccactggatccagacaaactcagctgtcaaaggagtaagagagcgcggggcactgcgctttggcgggaatctggtcggtgtctgtccgtagttcscatctccacatcccgtctgatcccgctcgtttttcggcagctccctttgacgtgattggacccccggagcccatcctggccgttgtgggtgaggacgccgagctgccctgtcgcctgtccccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggc

SEQ ID NO: 23141 - DNA, 601 bp, Human
agtctctctctctctctgggctgcatagttgaaatatatcaataaatgtaaaataaacaatcccacttggctctccctggagacctccactggatccagacaaactcagctgtcaaaggagtaagagagcgcggggcactgcgctttggcgggaatctggtcggtgtctgtccgtagttcgcatctccacatcccgtctgatcccgctcgtttttcggcagctccctttgacgtgattggacccccggagcccatcctggccgttgtgggtgaggacgccgagctgccctgtcgcctgtcyccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacga

SEQ ID NO: 23142 - DNA, 601 bp, Human
gcctagaccactaacccacctctgagttattggtcttagtgttcctgctggctggacaagcacccccaagtctgcccaccaaactgctgcaaacatttcaaaggcttgatcccaacaaggcatccttctctgataaggtatatgaaattccttttattggtacttcaatttcctttaaaaaaaaaaaaaaacttttttagaaacagcatttcactctgtcacccaggctggagtgcagtggtgccatcacagctcactgcagccttgaactcctgaactcaagcaatcctccaacctcagmctcccaagtagctaggaatacaggcaagaaccaccatgcccaaagagatggggtctcattgtgttgcccaggctggtcttgatctcctggactcaagtaatcctgcctcagcctcccaaagtgctgacattacagacataaaccactgtgcctggccctcagtttccttgtatattgaaatatggagatgagttcttccccctactagtccacttgtgcctttctgtctctctctttctcaaactatgtagctctctggttataaggctcccaaaaggggtccgctaaaacattaagtct

SEQ ID NO: 23143 - DNA, 601 bp, Human
aggcttgatcccaacaaggcatccttctctgataaggtatatgaaattccttttattggtacttcaatttcctttaaaaaaaaaaaaaaacttttttagaaacagcatttcactctgtcacccaggctggagtgcagtggtgccatcacagctcactgcagccttgaactcctgaactcaagcaatcctccaacctcagcctcccaagtagctaggaatacaggcaagaaccaccatgcccaaagagatggggtctcattgtgttgcccaggctggtcttgatctcctggactcaagtaatcctgcctcagcctcccaaagtgctgacattacagacataaaccactgtgcctggccctcagtttccttgtatattgaaatatggagatgagttcttccccctactagtccacttgtgcctttctgtctctctctttctcaaactatgtagctctctggttataaggctcccaaaaggggtccgctaaaacattaagtctagattctctctccatagctctgggctctgaccctcacatcagtatgcaagttcaagagaatggagaaatctgtctggagtgcacctcagtgggatggtacc

SEQ ID NO: 23144 - DNA, 601 bp, Human
aacagcatttcactctgtcacccaggctggagtgcagtggtgccatcacagctcactgcagccttgaactcctgaactcaagcaatcctccaacctcagcctcccaagtagctaggaatacaggcaagaaccaccatgcccaaagagatggggtctcattgtgttgcccaggctggtcttgatctcctggactcaagtaatcctgcctcagcctcccaaagtgctgacattacagacataaaccactgtgcctggccctcagtttccttgtatattgaaatatggagatgagttcttcccmctactagtccacttgtgcctttctgtctctctctttctcaaactatgtagctctctggttataaggctcccaaaaggggtccgctaaaacattaagtctagattctctctccatagctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgc

SEQ ID NO: 23145 - DNA, 601 bp, Human
tctctctctttctcaaactatgtagctctctggttataaggctcccaaaaggggtccgctaaaacattaagtctagattctctctccatagctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctrcgaaaaatgtgtcctgctacatccagaatctccttcttggacaggagaagaaagtagaaatatccataccaggttagtggaaccaatgctgctggattcctatgttgacacagcttcagagccacaccacctgggacacctgcccagatgtgacctcatggcagagttgtctactttccccacctaagctcttttccagtgacttaagggaaccccaccaactttattagaagagttaagatactgaagacataaacctaccttgatctcaaataaatttcagattatttatctatttat

SEQ ID NO: 23146 - DNA, 601 bp, Human
ctcccaaaaggggtccgctaaaacattaagtctagattctctctccatagctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctacgaaaaatgtgtcctgctacatccagaatctccttcttggmcaggagaagaaagtagaaatatccataccaggttagtggaaccaatgctgctggattcctatgttgacacagcttcagagccacaccacctgggacacctgcccagatgtgacctcatggcagagttgtctactttccccacctaagctcttttccagtgacttaagggaaccccaccaactttattagaagagttaagatactgaagacataaacctaccttgatctcaaataaatttcagattatttatctatttattttttgagacagtgtctcactctgttgcctagactggagtg

SEQ ID NO: 23147 - DNA, 601 bp, Human
gccgggcgtggtggctcacgcctgtaatcccagcactttgtgaggccgagacaggcagatcacaaggtcaggagatcgagaccatactggccaacatggtgaaaccccgcctctactaaaaatacaaaaaaattagccaggcatggtggcgggtgcctgtagtcccagctacttgggaggctgaagcaggagaatggtgtgaacccgggaggcagagcttgcagtgagctgagattgcgccactgaactccactccagcctgggtgacagagcgagactgcatctcaaaaaaaaaaaaaaagactaagttatttttctacttttgccatttccacccatactcacttctccttcctatcccatgctagggctctgtctaggtttccagggtcctcagggaagaaaatcctctcattattccccagatactgtctctggttcaggcagaaacctttccttattctttggtcaatgagtcccattctgttacatacagaggcacacttccccttccttatttacctccttcatcctcttggctcccattctgcactgatagttaaggaagaatttccataatgacatgaattggtccattata

SEQ ID NO: 23148 - DNA, 601 bp, Human
tcagaatttctcaactaatgtccttcttggggattttgttttagcttcctccctcccaaggctgactccctggatagtggctgtggctgtcatcctgatggttctaggacttctcaccattgggtccatatttttcacttggagactatacaacgaaagacccagagagaggaggaatgaattcagctctaaaggtaaaccatagaatccacaagggctacgtgtcaggagtgcttcagaggcaggctggatccaagtcctttagaatgacttattttaggatgacaggaagatatttgasgctgggcatggtggctcacgcctgtaatcccagcggtttgggaagccgaggtaggtggatcatctgaggtcaggagttcgagatcagcccggccaacatggcaaaactccatctcgactaaaaatacaaaaattagccaggcttattggtgagtgcctgtaatcccagctactcgggaggctgaggcaggagaattgcttgaacccaggaggtggaggttgcagtaagccgagatcgtgccattgcactctagcctgagcgacagagtaagactccgtctcaaaaaaagtagaagatact

SEQ ID NO: 23149 - DNA, 601 bp, Human
acgaaagacccagagagaggaggaatgaattcagctctaaaggtaaaccatagaatccacaagggctacgtgtcaggagtgcttcagaggcaggctggatccaagtcctttagaatgacttattttaggatgacaggaagatatttgaggctgggcatggtggctcacgcctgtaatcccagcggtttgggaagccgaggtaggtggatcatctgaggtcaggagttcgagatcagcccggccaacatggcaaaactccatctcgactaaaaatacaaaaattagccaggcttattggtgrgtgcctgtaatcccagctactcgggaggctgaggcaggagaattgcttgaacccaggaggtggaggttgcagtaagccgagatcgtgccattgcactctagcctgagcgacagagtaagactccgtctcaaaaaaagtagaagatacttgattctagaattctgaaaattggaggaaatcataagggtcctgaagtcacagatgccaatatgaagaagcacagaggattggggcataggcagagtctaatcaagatatcagggctgatgtttactcactacccaccctcagaccctactc

SEQ ID NO: 23150 - DNA, 601 bp, Human
tgacttattttaggatgacaggaagatatttgaggctgggcatggtggctcacgcctgtaatcccagcggtttgggaagccgaggtaggtggatcatctgaggtcaggagttcgagatcagcccggccaacatggcaaaactccatctcgactaaaaatacaaaaattagccaggcttattggtgagtgcctgtaatcccagctactcgggaggctgaggcaggagaattgcttgaacccaggaggtggaggttgcagtaagccgagatcgtgccattgcactctagcctgagcgacagartaagactccgtctcaaaaaaagtagaagatacttgattctagaattctgaaaattggaggaaatcataagggtcctgaagtcacagatgccaatatgaagaagcacagaggattggggcataggcagagtctaatcaagatatcagggctgatgtttactcactacccaccctcagaccctactcccacttttaactcaattgcccagtaccaatcttattattaaagatctgaggccgggcgcagtggctcatgcccgtagtaatcttagcactttgggaggccgagatgggtggaaca

SEQ ID NO: 23151 - DNA, 601 bp, Human
ctgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggastctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagt

SEQ ID NO: 23152 - DNA, 601 bp, Human
cgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggagtctgcccctagggatgcagacactctccattctaagctaatccctacccaayccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaac

SEQ ID NO: 23153 - DNA, 601 bp, Human
gtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttayaccttccatttccatcgtattctccagtttccaggatagatgttgctcatcgtctttacctaataaataagtttgtctgattgctgaaagcaacctcttaacctttcttttttaatatcaactgaaacaaaataaaacatagggcaagaaacctgcatgggaatgcagctgtctaaagctttgccattgtatgtggtctaagacccatccctaggcctgatggcagtgggctcaccagggcaggtgcacatgggggctgatgcctcatgagggaacaactgcttaccagggtcttcaagc

SEQ ID NO: 23154 - DNA, 601 bp, Human
caaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttacaccttccatttccatcgtattctccagtttccaggatagaygttgctcatcgtctttacctaataaataagtttgtctgattgctgaaagcaacctcttaacctttcttttttaatatcaactgaaacaaaataaaacatagggcaagaaacctgcatgggaatgcagctgtctaaagctttgccattgtatgtggtctaagacccatccctaggcctgatggcagtgggctcaccagggcaggtgcacatgggggctgatgcctcatgagggaacaactgcttaccagggtcttcaagcaggaatacagaatctcaactcaggaacaattttttattagt

SEQ ID NO: 23155 - DNA, 601 bp, Human
cttttgacagaggaactctgtcagggtaagtgttttccagagaaatatatgttagaggcagacatgtaaataagatgggatagtagattcctttttggatagcatcttttatagtgaaatgtctaactttattttattttatttatttattttttgagacagaatttcgctcttttgcctgggctggagtgcaatggcgtgataccggctcattgccacctccgtctcctgggttcaagtgattctcctgcctcagcttcccaagtagctgggattataggcatgcgccaccatgctggcyaatttgtgtgtgtgtgttgttatttttttagtagagatggggttttgacatgttggccaggctggtcttgaactcctgacctcaggtggtccacttgccttagcctcccaaattgttggcattacaggcatgagccaccgcacctggcctgaaatttctagctttaatatcttcagtgttaacatccatgcaggaaaatagtcttttggaatttgtggtttttacttccacttctttccctcccccactctaccctatattttgttctttgattgaggaaaaaaattttctcttgatgtt

SEQ ID NO: 23156 - DNA, 601 bp, Human
ctttgtatatttcatataaaatggaatcatacagtatgtggctttctctgtccagtttctttcatttagcacagtgttttccaggtttatctgtgttgaagcatgtatcagtactgcattcctttttatgattgaataaattctactgttttgataatgccacattttatttatccatcctttggtggacatttaggttgtttgctcctttttgtctgtgattatgaataatgctgctatgaatgttcatgtactggtttttacataaatatgttttttcttttcttgcttttttttttttgagatggagtgtagctctgtcgcccaggctggagtgcagtggcgccatcacggctcactgcaacctctgtctcccgagttcaagtgattctcccgccctagcctcccaagtagctgggatcacaagcgcatgccaccacacccagctaatttttgtatttttagtagacacggggttttaccatgttggtcaggctgatctcgatctcctgacctcaggtgatctacccgcctcagcctcccaaagtgctgggattacaggcgtgagccaccacacctggcctcttttctttagacatga

SEQ ID NO: 23157 - DNA, 601 bp, Human
tccagatgaagaggccacaaaacccgaaggctggttagatgatgagcctgagtacgtacctgatccagacgcagagaaacctgaggattggtaagaacttcagttaactttttttaattacctggtttttttgtttgtttttttttttgagatggagtctcactctgtctcccaggctggagttcagtggcgcagtttcggctcactgcaactttcacctcctgggttcaagtgattctcctccatcagccttgcgagtagctgggattacaggtgtgtgccaccacacccggcaaatttytgtattttttgtatttttagtagagacggactttcaccgtgttggccaggctggtctcaaagtcctgacctcaagtgatctgtctgccttggcctcccaaagtgctgggattacaggcgtgagccaccacacccagcataagttacctgtttttattgaagtcaatcttaatacttaaatatagccaagttccctaatttcagggtagaatttgacaattttaattatattttcttcttttttaaaaaataaatttttcctgaaaaactgttattactggaaatacaggagaagctggtc

SEQ ID NO: 23158 - DNA, 601 bp, Human
gttaccaggtttgtgcctcttgatggttgagttgctttcattaatctgtttgtattcagatagaagttttatctagagtaaggctgccaggttggtcattatattcaagctgttgaattaaaagcagaaagtagacttcctaagttgaaagagagcttaatgggttaggtattgcaaagataaacctagaaactggagtgaataactttctttaactttatttatttatttatttatttatttatttttgagatggagtttcgctcttctacccaggctggagggcagtggtgtgatgtcrcctcactgcaacctctgccttccggtttcaagcgattctcttgcctcagactcccgagtagctgggattacaggtgcctgccaccacgcctggctaatttttatatttttagcagagatggtgtttcaccatgttggccaggctggtctcgaactcctgacctcgcgatccgcccacctcaacctcctaaagtgctgggattacaggcgtgagccactgcatctggtcaactttctttttttgagactgagtctcactctagtggccaggctggagtgcaatggctcagtctcggcacac

SEQ ID NO: 23159 - DNA, 601 bp, Human
aacctcctaaagtgctgggattacaggcgtgagccactgcatctggtcaactttctttttttgagactgagtctcactctagtggccaggctggagtgcaatggctcagtctcggcacactgccacctccacctcctgggttcaagcaattctcctgactcagcctcccgagtagctgggagcacaggtgtgctcacaggtgtgctcacctcacctggctgattttttgtatttttagtagagacggggcttcgccatgttggccaggctggtctcgaactcctgacctcaggtgatccasctgccttcgcctttcgaagtcctggggtttcaggcgggagccactgtgcccagccaagaataactttcatagttgctttgtaactatatttaaaaacaaaagagaaatggaaaactgttgatttgggtaccctgctcttgggtgccagggttgcttcagccataggatccacagctgagtctggacaatctgtgatgtggtgggtagaggactgtggtttgagtcagcatcttgactacatcaagtcagctcactgcttggcctcaatgcttgcaactataaaaagactgaggcccaaaa

SEQ ID NO: 23160 - DNA, 601 bp, Human
atctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagcmttgaccttataggttcaagtgatcctcctacctcagcacccctccaagtagctgggaccacaggcatgcgctaccatgctcagctgtttgtttgtttgtttgtttattgatttatttatttgatatggtctggccctgttgcccaggctggagtgcagtggtgtgatctcggttcactgcagcctttgcctcccagattcaagcgattctcccacctgggcctcccaaagtgttgggattacaggcgtgcagccagacccagcgagatcctgtctcttaaaaaaaaattgttggccaggt

SEQ ID NO: 23161 - DNA, 601 bp, Human
aacccgggaggcggagtttgcagtgagccgagatcgcgccactgcactccagcctgggcgacagagcaagactctgtctccaaaaaaaaaaaaaaaaattgtagatctagagatgtgttctaatgctaatatataatcaccaaaaataataaggttttgctcagttgtttaacttctgtcttagaagagaaacagaaaagtgatgctgaagaagatggtggcactgtcagtcaagaggaggaagacagaaaacctaaagcagaggtaaaggaaaggggtcacacattttgttttaccaagytgaaggtacatttatgtaaagggaatattttaatagggtagtttacagtggcttatggcagtaaaaattctgttaaagccaattttgttgaagtgggattctttgtgatacaggtcagtgttttgtttgataattttaagctacatattaatctcagaagtatctttttagctgaaaatcattttctgaaataagcagaaggttatagggggaaaataaaatgcttgctaagaaggaaacttcgggtcattaacagtctatttgcctctcctcactgtgccctgaaaagtatttcttata

SEQ ID NO: 23162 - DNA, 601 bp, Human
cagggagaatcagggcgaccagttaggaggtccctgtaatcatctaggaaagatacggtggccccacaaagggtgacaggagaggaacagagggtatgagaactagttggagatctggatcttggttttgtggtagattggatatatagagtatgagagaaagggaacagtcactgtctgtatgtaccattgcttactaaagtcctttacccagcacctctgtgtctaaatctggtctctcccggaaagctctcctcaggttttactttcagctacaactctgccttcctattaataaagrtcattgctatctgtatcttttgtatattttccatggatatgttctgtcttaactagaatgcaattcttaaaagtagagaccatgtttcccccaaactccctcacacgttaaaaagttgctggtgcatttaaaaaaagggaatattttcatagggtaatttacaatcttagcaacttgtgatagagtacagagcagcagccttggagtcagtctacttggatagccttccatcttcatgaatccttggtttcttatcctcagaatggggctagtgtgccataggccagtagattgtttggg

SEQ ID NO: 23163 - DNA, 601 bp, Human
tagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaaygctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgattt

SEQ ID NO: 23164 - DNA, 601 bp, Human
aaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgytttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatggg

SEQ ID NO: 23165 - DNA, 601 bp, Human
caggctctgcacccaggaaatggggcaaaggggtgtgggaggggaggggcactgactcagccaccgcagaacagggccgcctgccacagtggagctactggagacacagagtgtcttccactaagacaatctgtggaatcaatccgtgcacacagatcagtctatgcacggcccgacatttgacccgaacgggctgtctgggagatgtgtgaagcctcacctccacacagctgttgacttcctctcccgtgagtctggactgcacagctttctcaagtggctctgtggcaagctgcactgmgtgctgaatccgttcgagcatctgctttttatcgggatccgtggtctcatttaattttactgaaaatggctgcaaccataaagagacgtcaaatctattagatactgctcagcaaaacctaaattcataaaggtgattccaggtagaaaacagaacggtttttcccatggccccatagagatagagaagtgtgcaacccaagtggccaggcagtaaggaactaagagagactgaagctcccggctcaggagctcctggttctgccctctcacgtgtgaccctggacagggcacctaacct

SEQ ID NO: 23166 - DNA, 601 bp, Human
cattcaaatcatagtaattagtatcagaagacataagaatgatacaaaacagtaagaaaaggaccaataacctcatgggaaagggggagagatgggggcacagaatcacagctggaagcaagcacttgacaagatgctcagtctcaggagaggttggaaaaagggacattcaaaccacagcaatcagcacttcacattcattgactgatgaaagggaagaatccaacaatacaaatgcaggtgtatgtgcaaatacacagcacacccaaaatgtggtagaagaagaagaaatttgcatagrcatttctttctttttttttaagagtctgggtctcactctgctgcccaggctggagtgcagtggtgtgttcatggctcactgcagcctcaaactcctgggctcaggtgattgtctcacctcagcctccccagtagctggaaccacaggcttgcatcaccatgcttggctaatttttaaaagttttgtagaaatagagtctcactattttgcctaggctggtctggagctcctgggctcaagtgatcctcttgccctggcttcccaaagtgctgggattacaagtgtgagccactgtgcctg

SEQ ID NO: 23167 - DNA, 601 bp, Human
atttatttcttacaattctgtaggctggaaagttcaaggtcaaggggccacatctgttctgggccttcttgctggtggggacttttcccagagtcccaaggtggcgcagagcatcacatggccagggggctcatgagggccaaactggcttctgtaacagccccactctcatgataactaccccacttctgtgataacccattaatccattaacccattcatgagggcagagctctcatgactcgatcacctctaaaaggccttacctcttaatactgttacactagggattaagtttcarcatgagttttggaggggacaaacattcaaatcatagtaattagtatcagaagacataagaatgatacaaaacagtaagaaaaggaccaataacctcatgggaaagggggagagatgggggcacagaatcacagctggaagcaagcacttgacaagatgctcagtctcaggagaggttggaaaaagggacattcaaaccacagcaatcagcacttcacattcattgactgatgaaagggaagaatccaacaatacaaatgcaggtgtatgtgcaaatacacagcacacccaaaatgtggta

SEQ ID NO: 23168 - DNA, 601 bp, Human
tcaaaacacacctaacgacaaaaccaagatggggcctcttacccatcagatacctgtgagagacagcatgatactcctgcaggactgggcaatttttataaattttttaaattttaaattcttaaactttttgtagagatagagtctcactatgttgtcccggctgatctcaaactcctgggctcaagggatcctcttgccttggcctcccaaggtgctatgattacaggaacgagccactgcacctggtctgggctggacaatttgaccaacagaacagaattaagagacacaaacacaygccaacatgtaacagagatgaattcgtgtcttagtctgttttctgtttttttgtttgttcttttttttgttttctgttttttgttttgttttgttttgttttttttgagacagtctcactctgtttcccaggctggaatgcagtggcgtgatctcggctcactgcaacctccgcctcctggtttcaagctattctcctgcctcagcctccagagtagctgggattacagacgcgcgccaccacatttggctaatttttgtatttttagtagcaacggggttttgccatgttggccaggct

SEQ ID NO: 23169 - DNA, 601 bp, Human
ataattcctgggctaaaaaatccaaaatggaaattagaaattgtttacaagtaaatgatgtcaaattttgcagcaaaaacagtcagaggaaaatgtatagccttaaattcttaaatcagaaaataagctaaactgctaagtgagacaaagaaaaacagaataaatccaaaggaaaaagaagaaaagaaggaataaagaatggacaaaaactgataaaacaaaaagactacagaggatcaacacagccaaactggatctgagatggttcttagatacaacatgtaaaatcccaacagtgtcttacatggaacttgacaagctgaggcttcaaaacacacctaacgacaaaaccaagatggggcctcttacccatcagatacctgtgagagacagcatgatactcctgcaggactgggcaatttttataaattttttaaattttaaattcttaaactttttgtagagatagagtctcactatgttgtcccggctgatctcaaactcctgggctcaagggatcctcttgccttggcctcccaaggtgctatgattacaggaacgagccactgcacctggtctgggctggacaatttgaccaaca

SEQ ID NO: 23170 - DNA, 601 bp, Human
ggggaggaagggataatagctggagcacagaggatgttcagggcagtgaaactattctgtgtgataccgtaatggtggatacgagatagtatttgtccaaacccataggatgtaacaatcctgagagtgaaccctaaagtaaaccacggactcagggtaatgacgctcagagcaggttcgctgactgtaagaaacgtaccccctggtgggtgcggatgctgggggaggtgacggtgaggtgggtaggggatatatatagcctctcaattctgatgtgaaccagaatctcctctaaaaaaagaactttttttttttctaaaaagtgaaaaaataaggagaaacagacaaattcatcatcagagggggagttttgttttggttcttgtttttgtttttttaagaaactgtatgaataggctaagccaacaggaagaattagcaaagacacacaaaatattaaccacacggccaacaggtatagctaagtggatggcatgtggaactgtgcactaggggattagacggaatcttctcaagcacaagagaacattcagaaaccagcacacacaggggccacaacacaagtctctgttcacagatc

SEQ ID NO: 23171 - DNA, 601 bp, Human
taggcagggcactggtcccagaggtctcaaaagccccatctccctgacgccattgactgaagatgccatccccacttgacacaccatggaatgggagtaaaaaccaccaatcccagcaaaacatggcacctatgtgaaccaggtcctgaccacacacactctaggcatgagacacgccccaactgcactcatgtcagaaaagagaaatgtctaccctccgccatcttggagggacctagagtctcaatgcactgacgtggacccaggacagggcgtggcaccaagcagatggtctgtggcstactatgggaaggggaggcaaagaaccaaggctggagagaaaaagtgtaggaaaatggcctggcagacagcgaggacacagggtggacaaagccacaacacagacagagaaggggcacagggcccacgtgggccaggttcctgatgcaatccctgcctacagctcctgaatcaaacagatgtgttaaatgtattgcaggcctgcaagtggcaaggcacgtctgcaggaatgagcacaccctccccaccgcggcagggcatccagtgggcagacaagcaccaaaagcagggtgtgcgctct

SEQ ID NO: 23172 - DNA, 601 bp, Human
gataggagctgaggggacatagtgaggagtgaccagaagacaagagtgtgaacctcctgttatgcccggacacggccaccagaagggttccttggtctagtggtaacgccagcgtctgggaggatgcccgttgccaagcggactgtggtctagcggtagcgtaagtgtcaaggaaaaacacccgctacttagcagaccaggaaagggagtctcccttgccccgcgggagtctggagaagactctgctcctccacctcttgtggagggcctgacatgagtcaggctcgcccgcagttatccrgaggcctaaccgtctccctgtgatgctgtgcttcagcggtcacgctcctagtcctccttcatgttccatcctgtacacctggctctaccttctagatagcagtagcaaattagtgaaagtactaaaagtctctgatatgcagaaataatggcgtaagctgtctctctctgtctcctctctctctctgccttggctgccaggcagggaagggccccctgtccagtggacacgtgacccacgtggccttacctatcattggagatggctcactctccttaacctacccctttgtcttgtatc

SEQ ID NO: 23173 - DNA, 601 bp, Human
tgaatatcattaatcattagtttgtagcaattactctttattccaatattataataatcctcgctctataatcataatctaggaaaaaccaggccatacagagataggagctgaggggacatagtgaggagtgaccagaagacaagagtgtgaacctcctgttatgcccggacacggccaccagaagggttccttggtctagtggtaacgccagcgtctgggaggatgcccgttgccaagcggactgtggtctagcggtagcgtaagtgtcaaggaaaaacacccgctacttagcagaccrggaaagggagtctcccttgccccgcgggagtctggagaagactctgctcctccacctcttgtggagggcctgacatgagtcaggctcgcccgcagttatccggaggcctaaccgtctccctgtgatgctgtgcttcagcggtcacgctcctagtcctccttcatgttccatcctgtacacctggctctaccttctagatagcagtagcaaattagtgaaagtactaaaagtctctgatatgcagaaataatggcgtaagctgtctctctctgtctcctctctctctctgccttggctgcc

SEQ ID NO: 23174 - DNA, 601 bp, Human
agttataccagatatagatcttagatatgattatatatgaatatcattaatcattagtttgtagcaattactctttattccaatattataataatcctcgctctataatcataatctaggaaaaaccaggccatacagagataggagctgaggggacatagtgaggagtgaccagaagacaagagtgtgaacctcctgttatgcccggacacggccaccagaagggttccttggtctagtggtaacgccagcgtctgggaggatgcccgttgccaagcggactgtggtctagcggtagcgtaagtgtcaaggaaaaacacccgctacttagcagaccaggaaagggagtctcccttgccccgcgggagtctggagaagactctgctcctccacctcttgtggagggcctgacatgagtcaggctcgcccgcagttatccggaggcctaaccgtctccctgtgatgctgtgcttcagcggtcacgctcctagtcctccttcatgttccatcctgtacacctggctctaccttctagatagcagtagcaaattagtgaaagtactaaaagtctctgatatgcagaaataatggcgtaagctgt

SEQ ID NO: 23175 - DNA, 601 bp, Human
tggaatgacctgtcctctctgagcttcggcttgcccatgcctctcggcttggcacaggctcttatgctgccccacagtagtttgtgtgaagtggggagagaagcagcgctactgcttaagagtctgccccgttcctggcactgtcacaacctcttgtttctctttcagccagcctgtgtggttcctgtgggagggaagcaatctgaggctggacacagtgggtctctgggagcaggcgcacggtacagtgctgagcactactgtgggcggcaagccacccaggtgccgaggcaagagaccragggcacgagctgttccagtataataaaatataaaataagaatagttataccagatatagatcttagatatgattatatatgaatatcattaatcattagtttgtagcaattactctttattccaatattataataatcctcgctctataatcataatctaggaaaaaccaggccatacagagataggagctgaggggacatagtgaggagtgaccagaagacaagagtgtgaacctcctgttatgcccggacacggccaccagaagggttccttggtctagtggtaacgccagcgtctg

SEQ ID NO: 23176 - DNA, 601 bp, Human
ccaccctgccttgctcagggctgctgccgtcctcattcttgtgtggcctcacctttccctgaatgtccacactctacccattagcttagctgaggctcttggcctccaagaagcactctagattactccagtctggaatgacctgtcctctctgagcttcggcttgcccatgcctctcggcttggcacaggctcttatgctgccccacagtagtttgtgtgaagtggggagagaagcagcgctactgcttaagagtctgccccgttcctggcactgtcacaacctcttgtttctctttcakccagcctgtgtggttcctgtgggagggaagcaatctgaggctggacacagtgggtctctgggagcaggcgcacggtacagtgctgagcactactgtgggcggcaagccacccaggtgccgaggcaagagaccaagggcacgagctgttccagtataataaaatataaaataagaatagttataccagatatagatcttagatatgattatatatgaatatcattaatcattagtttgtagcaattactctttattccaatattataataatcctcgctctataatcataatctaggaaaa

SEQ ID NO: 23177 - DNA, 601 bp, Human
acaccagccctgtgaatccaggccccaggggccactgtgtttctcaagacagcactgcgtttactgtcttttgtttcttaaaaaataacacaccataaaaaaatgacatcttgtcttttacagcaacatggatggaactggaagacgttctgttaagtgaaataaaccaggcagagaaagacaaatatcacatgtcctctctcttatgtgggagctaaaaaacggtggacctcaaggaggtgcagcatagaacagtggtcaccagaagctgagaagggtcaggtcaggggcagtgagtggrgagaggttggtttctaggcacaaacacacagacagaaagaataggttcttgtggtcactagcacagtagggtgactatagttaccaaaacatttgttgtatatttcaacatagccagaagatctggaacattcccaatgcaaagaaaaggtaaatgtctaaggtgacgagcatcctaactaccccgatcatcacacagggtgtgcatgtattaagacatcacatgttccccataaattgcataattattatatatccattaaaaaaacacatgtcatggtcttagagctgcacaatgttg

SEQ ID NO: 23178 - DNA, 601 bp, Human
ccaatataattctgcctggtctagaaaaagtctgatatctgtgtttgaagcatttggatccagatgggcgcacaggctgttgtcaaatatgcatcactcggcacacatcccagcaccccacaatccccctaaacctcacatgctcagccagcaaacaccagccctgtgaatccaggccccaggggccactgtgtttctcaagacagcactgcgtttactgtcttttgtttcttaaaaaataacacaccataaaaaaatgacatcttgtcttttacagcaacatggatggaactggaagacrttctgttaagtgaaataaaccaggcagagaaagacaaatatcacatgtcctctctcttatgtgggagctaaaaaacggtggacctcaaggaggtgcagcatagaacagtggtcaccagaagctgagaagggtcaggtcaggggcagtgagtggggagaggttggtttctaggcacaaacacacagacagaaagaataggttcttgtggtcactagcacagtagggtgactatagttaccaaaacatttgttgtatatttcaacatagccagaagatctggaacattcccaatgcaaagaa

SEQ ID NO: 23179 - DNA, 601 bp, Human
cattgcgggaatccccactctgcagggaggcttccaaccttgcctcttgtggatgtgtccccagattcacttaagggataaacatgaagaaaacaccaacgaaagggttcccaatataattctgcctggtctagaaaaagtctgatatctgtgtttgaagcatttggatccagatgggcgcacaggctgttgtcaaatatgcatcactcggcacacatcccagcaccccacaatccccctaaacctcacatgctcagccagcaaacaccagccctgtgaatccaggccccaggggccactrtgtttctcaagacagcactgcgtttactgtcttttgtttcttaaaaaataacacaccataaaaaaatgacatcttgtcttttacagcaacatggatggaactggaagacgttctgttaagtgaaataaaccaggcagagaaagacaaatatcacatgtcctctctcttatgtgggagctaaaaaacggtggacctcaaggaggtgcagcatagaacagtggtcaccagaagctgagaagggtcaggtcaggggcagtgagtggggagaggttggtttctaggcacaaacacacagacaga

SEQ ID NO: 23180 - DNA, 601 bp, Human
atcgctccatggtgacagaatgagggctccttgacagaatgagggttccttgaaaacggttctttgagatttgtggaaatctttctgtggcctggcatatgtttctgtgttcttggaaggaaaggatgttctttaattcctgagtgcaaagttcccagctctcaaaccaagcctgttaactgtatttcaaacctttcatatccatattaattcttggcctacttgatctgtcaactcctgggaagtgcatgaaacgtgggcatgtccactctggttctagggtagtgaagccttctggtcyagaggcccaggctgcatcctctcagagctgaggcgcttcatcatcacaaacccgcccctctactcccacaaacccggagcctgaaatgccatgggtctgatatttatgtgtcaacctggctatctctatctttcttcagtctgtgttgtctggttttattttattatatatttttttgagacagagtctcattctgtcacccaggctggagtgcagtggcacaatcttggctcactataacctctgcctcctgggttcaagtgattctcatgcctcagcctcctgagtagctgggattac

SEQ ID NO: 23181 - DNA, 601 bp, Human
gcctcccaaagtgctgggattacaggtgtgggtcgccatgtctggccaagtgttgttatctaatacaatcgctccatggtgacagaatgagggctccttgacagaatgagggttccttgaaaacggttctttgagatttgtggaaatctttctgtggcctggcatatgtttctgtgttcttggaaggaaaggatgttctttaattcctgagtgcaaagttcccagctctcaaaccaagcctgttaactgtatttcaaacctttcatatccatattaattcttggcctacttgatctgtcarctcctgggaagtgcatgaaacgtgggcatgtccactctggttctagggtagtgaagccttctggtctagaggcccaggctgcatcctctcagagctgaggcgcttcatcatcacaaacccgcccctctactcccacaaacccggagcctgaaatgccatgggtctgatatttatgtgtcaacctggctatctctatctttcttcagtctgtgttgtctggttttattttattatatatttttttgagacagagtctcattctgtcacccaggctggagtgcagtggcacaatcttggctc

SEQ ID NO: 23182 - DNA, 601 bp, Human
ctcctgggctcaagcgatcctcctgcctcggcctcccaaagtgctgggattacaggtgtgggtcgccatgtctggccaagtgttgttatctaatacaatcgctccatggtgacagaatgagggctccttgacagaatgagggttccttgaaaacggttctttgagatttgtggaaatctttctgtggcctggcatatgtttctgtgttcttggaaggaaaggatgttctttaattcctgagtgcaaagttcccagctctcaaaccaagcctgttaactgtatttcaaacctttcatatccrtattaattcttggcctacttgatctgtcaactcctgggaagtgcatgaaacgtgggcatgtccactctggttctagggtagtgaagccttctggtctagaggcccaggctgcatcctctcagagctgaggcgcttcatcatcacaaacccgcccctctactcccacaaacccggagcctgaaatgccatgggtctgatatttatgtgtcaacctggctatctctatctttcttcagtctgtgttgtctggttttattttattatatatttttttgagacagagtctcattctgtcaccca

SEQ ID NO: 23183 - DNA, 601 bp, Human
ccaaagtgctgggattacaggcgtgagccactgcacccggcacctcacttattttccatctttgttttttaataactacatttaaaaacatcagtttcctctaattggtgctttaggggcattctccagatttggtgtgtggcacctttgctgctgttctgcttaaacacccctgatttcccactgtggttttctttcctaggagttatccaggagcatgatttcaaccccccagacaagtttgtacattttagacgtccgtcctgtcagtgctggtatcttttttatttaaaaaaaaaawtttttttaatgtctttgagacagagtcttgctctgttgcccaggctggagtgcaatggcacaatcagggctcactgcagccttgacttcttgggctgaagtgatcctcctgcatcagcctcttaagtagctgggactataggcacgtgccaccacacccagctcatttttaaattttttgtagaaagggggtctccctatgttgcccaggttggtctggaactcctgggctcaagcgatcctcctgcctcggcctcccaaagtgctgggattacaggtgtgggtcgccatgtctggccaa

SEQ ID NO: 23184 - DNA, 601 bp, Human
gacctcgtgatccgcctgccttggcctcccaaagtgctgggattacaggcgtgagccactgcacccggcacctcacttattttccatctttgttttttaataactacatttaaaaacatcagtttcctctaattggtgctttaggggcattctccagatttggtgtgtggcacctttgctgctgttctgcttaaacacccctgatttcccactgtggttttctttcctaggagttatccaggagcatgatttcaaccccccagacaagtttgtacattttagacgtccgtcctgtcagtgytggtatcttttttatttaaaaaaaaaattttttttaatgtctttgagacagagtcttgctctgttgcccaggctggagtgcaatggcacaatcagggctcactgcagccttgacttcttgggctgaagtgatcctcctgcatcagcctcttaagtagctgggactataggcacgtgccaccacacccagctcatttttaaattttttgtagaaagggggtctccctatgttgcccaggttggtctggaactcctgggctcaagcgatcctcctgcctcggcctcccaaagtgctgggatt

SEQ ID NO: 23185 - DNA, 601 bp, Human
tccccatggcgaggagcacatgactgcacagagctaaggctacactccttatgactccccatggtggggggaggttgcgggggtggtcatgtgcccacgtctgatcactgactgtggaggggtggaaatccatgtccctctttggtcctgcatattggctgttagattctactcctgtttcctggaacttaaaccaatgctgaagtcattctggaagaaaatgggcccaagaataaatggtatttaagaaaaagaccctagatggggccagatagcaaaattcatcataaagtggtgagtyagtgtgctctagctgcctccagaacattccttcaccacgtgacctgagggcactgctccacttaccactcccacctttcccatgtgctgccagttccctcccggcatctaagtgtcaaatgcagtgcgagttgttcacggcttcctctaaggactttaagaaatgctctactatatccatagttacattccatttttgtcttgttattcaaacatacatacatacatacatacattcaaacacacacacaggatcttgctgtcagccaggctggagtgcaacggtgtaatcacagctcac

SEQ ID NO: 23186 - DNA, 601 bp, Human
ccatccgcttccctgcagctctaactgagagtcacatagcacgctgaccacctgctccaccactgttcctagcgatagaatctctaaccctggacctttttaccaagaactgcttaaggtattttttggatcctgaattccagcaggacagctgttgccaactggtctgaagacctgcaccaaggaactgactcgtcgcagaaatgtggtttacctccctgtcccatgacttcgcccctcacttccccagcaaccggcaatccccatcacctgtccagagcaattaaaaacccctccccaratctcagggaggcggatctgaggtttcctcccatctccatttgtccaccatacaattactacgcttcttctacggcaacccctggtatcccggtatactgactcgctgtgcattgggcaacagacctattatggttacaacacaatgtctttcaagttttccttcttggtttcatttcctgtctctctccccagaggcagagtgagtgtttctagctttgaccctacaagcatgttcataccagcacaacagggtcctgttctctcccactgggggagcttcctccctgcactaggcctt

SEQ ID NO: 23187 - DNA, 601 bp, Human
atgagaattccaaggcaggctataggcagaatgatgaggccggtcactggccaggtgcagtgcacgtccatccgcttccctgcagctctaactgagagtcacatagcacgctgaccacctgctccaccactgttcctagcgatagaatctctaaccctggacctttttaccaagaactgcttaaggtattttttggatcctgaattccagcaggacagctgttgccaactggtctgaagacctgcaccaaggaactgactcgtcgcagaaatgtggtttacctccctgtcccatgacttcrcccctcacttccccagcaaccggcaatccccatcacctgtccagagcaattaaaaacccctccccaaatctcagggaggcggatctgaggtttcctcccatctccatttgtccaccatacaattactacgcttcttctacggcaacccctggtatcccggtatactgactcgctgtgcattgggcaacagacctattatggttacaacacaatgtctttcaagttttccttcttggtttcatttcctgtctctctccccagaggcagagtgagtgtttctagctttgaccctacaagcat

SEQ ID NO: 23188 - DNA, 601 bp, Human
cacaccatagaaattccccatgtggccaggcgcagtggctcacgcctataatcccagcactttgggaggctgaggtgggcggatcacctgaggtcgggagttcgagaccagcctgacaaacatggagagacccccacctctactaaaaatcagaaattagccaggtatggtggcgcatgcctgtaaccccagctactcgggaggctgaggcaggagaatcgctcgaacccgggaggtggaggttgtggtgagccgagatcacgccactgcactccagcctgggcaacaagggcgaaactcygtctcaaaaagaaaaaacaaaaaagaaattctccatgcacttcaacacccagagcagctcccattagcagagccgcctatcctgaattaattctgcacaacgtacgacagtgtccccagcccttcctcgacagtccaggacacatggtggccaagatgcgaggctaggcatagaacatgggcatgctcaaaaaccccaaagaaatggcaccaccttacttcttattcagttctgcttcttcttctccccacttctcaaactgaccagtgatgtcaacaggagcgcgaaggatatctttca

SEQ ID NO: 23189 - DNA, 601 bp, Human
ttttgcttctcttttttttttttttttgagatggaatctcactctgtcgcccaggctggagtgcaatggcgcaatcttggctcactgcaagctctgcctcctgggttcatgccattctcctgcctcagcctcccgagtagctggaactacaggaacccgccaccatgcctggctagttttttgtattttttttagtagagacggggtttcaccgtgttagtcaggatggtctccatctcctgaccttgtgatccgcccgccttggcctcccaaagtgctgggattacaggtgtgagccacmgcgcctggcgtggttttgcttttcaaactccaagatgggagtagagggaaacggagtcaaaggaaagaaatagctctgagtaaggacaactatatggatgttacttatttttgtctggttttgagacagggtctcccctctattgcccagagtggagtgcagtagtgcaatcacacctcactattcaacctcctgggctcaagcgagcccctcacctcagcctcccaagcagctggaaaacaggtgtgtgccaccacacctggctaatttttaatatattttatagacccgggatctcac

SEQ ID NO: 23190 - DNA, 601 bp, Human
ttgtccctggttttgcttctcttttttttttttttttgagatggaatctcactctgtcgcccaggctggagtgcaatggcgcaatcttggctcactgcaagctctgcctcctgggttcatgccattctcctgcctcagcctcccgagtagctggaactacaggaacccgccaccatgcctggctagttttttgtattttttttagtagagacggggtttcaccgtgttagtcaggatggtctccatctcctgaccttgtgatccgcccgccttggcctcccaaagtgctgggattacaggygtgagccacagcgcctggcgtggttttgcttttcaaactccaagatgggagtagagggaaacggagtcaaaggaaagaaatagctctgagtaaggacaactatatggatgttacttatttttgtctggttttgagacagggtctcccctctattgcccagagtggagtgcagtagtgcaatcacacctcactattcaacctcctgggctcaagcgagcccctcacctcagcctcccaagcagctggaaaacaggtgtgtgccaccacacctggctaatttttaatatattttatagaccc

SEQ ID NO: 23191 - DNA, 601 bp, Human
tgagggtgccctcattgctccaggatggccctgactcacagctaccctctccagctctgtttcagccagaagccactggagcccaacaacaaggaaagaggaggagaggggaggggagttgagtccaggccctgctggcctttcaaggtgcactgcggggaagggctctgcacaggatgtgttcagagaggaggccttgtccctggttttgcttctcttttttttttttttttgagatggaatctcactctgtcgcccaggctggagtgcaatggcgcaatcttggctcactgcaagctcygcctcctgggttcatgccattctcctgcctcagcctcccgagtagctggaactacaggaacccgccaccatgcctggctagttttttgtattttttttagtagagacggggtttcaccgtgttagtcaggatggtctccatctcctgaccttgtgatccgcccgccttggcctcccaaagtgctgggattacaggtgtgagccacagcgcctggcgtggttttgcttttcaaactccaagatgggagtagagggaaacggagtcaaaggaaagaaatagctctgagtaaggacaactata

SEQ ID NO: 23192 - DNA, 601 bp, Human
agaccaggaaagagatggaagcagcagctccaggagccccagaaacccgagcctgagggtgccctcattgctccaggatggccctgactcacagctaccctctccagctctgtttcagccagaagccactggagcccaacaacaaggaaagaggaggagaggggaggggagttgagtccaggccctgctggcctttcaaggtgcactgcggggaagggctctgcacaggatgtgttcagagaggaggccttgtccctggttttgcttctcttttttttttttttttgagatggaatctcaytctgtcgcccaggctggagtgcaatggcgcaatcttggctcactgcaagctctgcctcctgggttcatgccattctcctgcctcagcctcccgagtagctggaactacaggaacccgccaccatgcctggctagttttttgtattttttttagtagagacggggtttcaccgtgttagtcaggatggtctccatctcctgaccttgtgatccgcccgccttggcctcccaaagtgctgggattacaggtgtgagccacagcgcctggcgtggttttgcttttcaaactccaagatgggag

SEQ ID NO: 23193 - DNA, 601 bp, Human
tgttcctcgttcacgggagggggtgccccaagaccaggaaagagatggaagcagcagctccaggagccccagaaacccgagcctgagggtgccctcattgctccaggatggccctgactcacagctaccctctccagctctgtttcagccagaagccactggagcccaacaacaaggaaagaggaggagaggggaggggagttgagtccaggccctgctggcctttcaaggtgcactgcggggaagggctctgcacaggatgtgttcagagaggaggccttgtccctggttttgcttctcttttttttttttttttgagatggaatctcactctgtcgcccaggctggagtgcaatggcgcaatcttggctcactgcaagctctgcctcctgggttcatgccattctcctgcctcagcctcccgagtagctggaactacaggaacccgccaccatgcctggctagttttttgtattttttttagtagagacggggtttcaccgtgttagtcaggatggtctccatctcctgaccttgtgatccgcccgccttggcctcccaaagtgctgggattacaggtgtgagccacagcgcctggcgt

SEQ ID NO: 23194 - DNA, 601 bp, Human
agcctttcgatgaagcatttactgaatacaggtcagtatatgtgatgaagtcatgtgtgttcatgatgccaagtggccgcagcaaaatgcaaataagcagcggcctatgtagttggggtccaagaccaagctcatgggacagcacaatggcaaagtgccccaaaccaacagtcacaaccaaagcagaccctccacaccggcagggcagctgaccacacttagcactctcagagccagaattgccatttagctcgaggcgctgtccggaagggtctggtgtgggtgggcagacagaggaggkgcagttcagagggacacagaggggtagggagtggggagggagcaggtgcagaaggcaggaccctgcatgctactcacactgaggctggttccaggccctccgaccgggaatcccagggagctgtcctcttctacggccccaaagatctaggaaaagaaacagatgggacctgaagctgcggcaagatgaaggcggcatgtggcgagcagctgtgagctgtgttcctcgttcacgggagggggtgccccaagaccaggaaagagatggaagcagcagctccaggagccccagaaacccgag

SEQ ID NO: 23195 - DNA, 601 bp, Human
agttaatccatgaacgtcaaatggccatgatgtgtgggcacaggacgttttgtcagcaggctcaccattcgccgcagctgcttcttcgcaatcagctgactgcaaaggccaaatgaggctgcctgggggatgcggatgcgtgtccacagcacgctgaaggcacccccacaaccacagcagccgttaagatgaaaaacactgcagttcaaaggcaggctgactttaacccaggaggtgtgttttggttttttgtttttaaagaaaataaatatcttagtatcatttgcgcaagagaacaaagaagctatgtgggttttcttaaaagcaccaaagaaggttcatatcaggaagtctcaaaaataccacaccaactaccacaaccaagctagctagcgctaaggctggcaaaaggcaccaggcacatgggctaggtgctctggcaggacttcttacaacacggactgttttctctttgcaagttggttcctgggggagcatctgtaagctccatccgcatgggggctcttcacaccacttgtcattaggaaacaggattttaaaaaggttttgcattttgactttgtattaagctcctgtttta

SEQ ID NO: 23196 - DNA, 601 bp, Human
actcgggaggcagagggtgcagtgaccggagattgcgctactgcactccagctgtggaaagaagagcttttgttcgctgagagctgctcacactcctatatccataactgaataatagctcagcggccacgacacagggcagggactggcatgggcgacagagtgagactctgtctcaaaaacagaaacacacaaatttagcaagtgcaaaagtcaggcaggctagcaagcccttaagtctaagccaagctccctgagacccaattctgcatctgaactttggacttcttgggggttttcsatctgtatctccacccaccacacagccagcccagacaagccttggggaaggacagaaagggaggcattcaccccactgctaggctcagttccagccctaggggcactggaggggaactctcagaatggctgcaggggtgtgtctcaagaacgcctggggctgcaacccccacctgagcatgctagcaggtggctgtgtggcgacactgaggtggtacaagatggaggaactgcctcccttgctcctaaaaccatttggatttggaagttaatccatgaacgtcaaatggccatgatgtgt

SEQ ID NO: 23197 - DNA, 601 bp, Human
tgtggtgcacggggcagccttcccagaggatgatccggcctgaacgccatagtgcctcgggggagacgcccggtccggggagcccagtgaggggagtggctcccacactctttccagcaactggtcctcacctttttgctctcgggcaatcttccgcactccttctcggaattctgataacacctgaaggtagggcatgactgtggcctcgagctgcggaaagaacagttttggttcactgagagctgctcacactcccatattcataacagaataatagctcagtggccgcgacacaggkcagggactggcatgggcagtgctgctgtgcacactacagctgtgaccggcatcccagagcctggacgctctcgtccctgacacacagtccctgctaggtgtgcgagtcacacagactctcaggccagagagcatgaagtgagcttcctttctactgcagcaggtgggtctgccgccgctctgcccagctgctgacaggccctgctttcctcaggtcagacacgctgctgtgaaacagcttgtctttatggtttcagaggggccagctctgggagggactatttcctaaggagcccaagga

SEQ ID NO: 23198 - DNA, 601 bp, Human
ttaacactttcttaaaactggcagtcaaaacgaatgctcagattcagcactttctaagtcttaaaccacacacatctcagaaatttcaaaagatgaaggaatggccaggcgcggtggctcacgcctgtactcccagcactttgggaggccgaggcgggtggatcacgaggtcaggagatcgagaccatcctggccaacacggtgaaaccccatctctgctaaaaaaaaaaaaatacaaaaaattagccgggcgcggtggcgggcgcctgtagtcccagctactcaggaggctgaggcagargaatggcgtgaacccgggaggcggagcttgcagtgagccgagatcgcgccactgcactccagcctgggagacagagtgagactccatctcaaacaaacaaacaaacaaaaagatgaaggaatggctgcttatggacagtgaggggccactgtgtgaaccccaagttcaagcattcatctggcatgcctgagcagaaaagggaaccctggaagctgcagctcggctccactcggcagcaggaacgagccacacctcagcgcacccagcctaccaggtcaccaggaacaaaaataagcccca

SEQ ID NO: 23199 - DNA, 601 bp, Human
gcctgccctgcctttgggcagcactgaccatgcacatgctgccattctcgtctgtccttttcctgctgtgtcctcataactgagacccctagagctccttgctgggcaccccacaccttcattcactgctagataaaatattcacatatccgggcaggcacggtggctcatgactgtaatcccagcacttttggaggctgaggcgggtggatcacaaggtcaggagatcgagaccatcctggccaacatggtgaaaccccatctctactaaaaatacaaaaactatctgggtgtggtggcrtgtgcctgtaatcccagctacttgggacgctgaggcagaagaatcgcttgaaccagggagtcggaggttgcagtgggccaagatgacaccactgcactccagcctagcgacagggcaagactccatctcaaaaaaaaaaaaaaaaaattgcatatccttgggcttcaaggccgcgctcataagcacagccactttgggcagcttccggagtttcaacctccccaggcagagacctaggggaacaatggcctttatatttgtctgcagtatcattcctgggaacaggccctcctcagccac

SEQ ID NO: 23200 - DNA, 601 bp, Human
tgcctgccctgcctttgggcagcactgaccatgcacatgctgccattctcgtctgtccttttcctgctgtgtcctcataactgagacccctagagctccttgctgggcaccccacaccttcattcactgctagataaaatattcacatatccgggcaggcacggtggctcatgactgtaatcccagcacttttggaggctgaggcgggtggatcacaaggtcaggagatcgagaccatcctggccaacatggtgaaaccccatctctactaaaaatacaaaaactatctgggtgtggtggyatgtgcctgtaatcccagctacttgggacgctgaggcagaagaatcgcttgaaccagggagtcggaggttgcagtgggccaagatgacaccactgcactccagcctagcgacagggcaagactccatctcaaaaaaaaaaaaaaaaaattgcatatccttgggcttcaaggccgcgctcataagcacagccactttgggcagcttccggagtttcaacctccccaggcagagacctaggggaacaatggcctttatatttgtctgcagtatcattcctgggaacaggccctcctcagcca

SEQ ID NO: 23201 - DNA, 601 bp, Human
tcgcttgaacccgggaggcagaggttgcaatgagccgagatcgcgccactgtactccggcctgggcgacagagcgaaactctgtctcaataaacaaataaataaaaattgaaaataaaaaacaaaaaaattaactttctgtggaacaaaaagacctccacgaagtgggagaacaagcatgcaatctgttgacagtgtacaggatacaggctggttcctcagctgagagcttcaaaggcggtagcaacaggggcagcgggcagccaggcccctaggggagatgatgcgcaggggaggtgacrccaccacacgcagcagtgggaaggagctacggggtgctcccctgcccctgccaggctggccagcgtgggaatggcgccgggggacccatggggctgccactttgggattctgcatcagcaatcatgaagcatgagcctcagcccagccccgggagctctccttgtgacacctctccaagctcctggtaactttgtagcaaacagcaagggctcacccaccttcgtggtcttcaaaccgcaccccaagctcaggcaggatgttgtcccgcagggcatcgctgagctgcagaatctcaggga

SEQ ID NO: 23202 - DNA, 601 bp, Human
agtaggaaaataggacatgacatctgagatttaaaattaccaggggcagagtggaagagtggaattggagggttcgtaacacaaagaaatgataaatgcttgaggtgatggacatctcagttacctagatttgatcatagtacctcatacgcatgtatccaaatatcacacatagcccataaatatgtacaactattatgtatccataaaaactgaaactaaggctgggcatgtggctcatgccactttaggaggccgaggtgggcagattacttgaggtcaggagttcgacactagcctkgtcaacacagtgaaaccccgtctctactaaagatacaaaaattagccgagcgtggtgatgggcgtctgtaatcccagctactcgggaggctgaggcaggagaatcgcttgaacccgggaggcagaggttgcaatgagccgagatcgcgccactgtactccggcctgggcgacagagcgaaactctgtctcaataaacaaataaataaaaattgaaaataaaaaacaaaaaaattaactttctgtggaacaaaaagacctccacgaagtgggagaacaagcatgcaatctgttgacagtgt

SEQ ID NO: 23203 - DNA, 601 bp, Human
ccgggccggcggggcgaggctctccaattgctgggccagagcgggacccttcctttccgcaccctcctgggtatctccggtcttcaggcctccttcggagagccctgctccgagcccattgggcttccaatcttggcctgcctagcgccgagcagccaatcagaaggcagtcctcccgagggggcgggacgagggggtggtgctgattggctgagcctgaagtcgccacggactcggggcaacaggcagatttgcctgctgagggtggagacccacgagccgaggcctcctgcagtgttcygcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttcccccggggcggcgcttggagggactgtaccgcggctcactgggcaggggggatccccttcggtgcagacggacttttacattcgccgaagcaggggaggggggtccgggtagtggggcgcgggactgcaggctttgtt

SEQ ID NO: 23204 - DNA, 601 bp, Human
tgtgagccatacatacctttaagaaagattagtaaaataagatagttatttactagcttattccagttcaaggtggtgggaggccagagcctgtcctggcaggttggggtacaaggcaagagccagccctggacaggatgctgtccattgcagggtggactcacactgggaccattcagacatgccagttcacctaacacgcacatctttgggatgtggggggaagctggagtaccaggagaaaacctatctagacatggggagaacatgcagactccacacagatggtggcctcagctaggaatagatttttttctcatcaacgttataatgaaacaacgttgaacaaaacaatgttgtttgaggacctgctgtacagaaatacagacatagacacatgcactgcaattgcaactaagtttaaatgatgtacttactgggtaattactggaatgagctgcaaaatttggggtagttatgttagggtggtgggtttgtgatgatttttcctttccttttttccaacaatttctgtaaaactttctttatcgctgttatatcagacacaaaagatgggggtggtatttgaaagaaagtgaaa

SEQ ID NO: 23205 - DNA, 601 bp, Human
ggcaggttggggtacaaggcaagagccagccctggacaggatgctgtccattgcagggtggactcacactgggaccattcagacatgccagttcacctaacacgcacatctttgggatgtggggggaagctggagtaccaggagaaaacctatctagacatggggagaacatgcagactccacacagatggtggcctcagctaggaatagatttttttctcatcaacgttataatgaaacaacgttgaacaaaacaatgttgtttgaggacctgctgtacagaaatacagacatagacacrtgcactgcaattgcaactaagtttaaatgatgtacttactgggtaattactggaatgagctgcaaaatttggggtagttatgttagggtggtgggtttgtgatgatttttcctttccttttttccaacaatttctgtaaaactttctttatcgctgttatatcagacacaaaagatgggggtggtatttgaaagaaagtgaaaaactcagttggaaaaagagctccacagaaaggaagtttttctcttagcttgctgacttggacttccagttaggacttctgcatttcttcatctcttc

SEQ ID NO: 23206 - DNA, 601 bp, Human
agacacaaaagatgggggtggtatttgaaagaaagtgaaaaactcagttggaaaaagagctccacagaaaggaagtttttctcttagcttgctgacttggacttccagttaggacttctgcatttcttcatctcttcttcctggataaggtttctccccatcttctccagtggtttgtgtgtatttttccatcttgacttgtttagtttattgcttgctttgtatcatcgttgctaagtgttgaaaagattctttctcttatgttttcatctcctcttctctctgttcttcactttctctyataggtcctacctgtacttcaggcccctctgagaccctgtgtccttgggccaaccttgacgacttctagcctcactcacctccttctcttggctccagctatgtggcattcgacttagcactgaatgatagaatagggctttgcatttcaccctctttattttgtgtttgggcatttccccttcctccaacatactggaagctcccagaaggctggtgctaaccatcattttctcttgtcacccaggtgcctgttgaggacctgaatgtctgagtaatggtctcatggtaaggatttctg

SEQ ID NO: 23207 - DNA, 601 bp, Human
agtttattgcaaattccattataaggtatgtgttacctttggggcagagggtacaaggctcctaccgcatacctccttatttttcctgaaggattgagcaaagattaaggcttctcccacttttccctcacctccatccccaaagttgggaagtattgatctcattgatcagtactgattttgttggctaccatctgaggaccttggagcgtatcccaatctcattatcacttccaacatccaatagtgtctttccaatatcatttcttttaactttttaagtcatccatctatttacttwgcatttattgaggttttattatgaacaaggcatataagtaaaatcaattacaaatgtcagaaaacaaaattatactgtttttaaaaatttgcattcatatagccagatcaaatcagttacatctggggagggttttgagaatgttttaatcaactgaaatattataaagggccctcttttggtataagcatggcatttgttacaatgagcaatattgccagtgaaccctggcatgttagtgatattcccagagaactcccaagggctagtcagaaacaagcctgagaacctctgtttcca

SEQ ID NO: 23208 - DNA, 601 bp, Human
tggggcagagggtacaaggctcctaccgcatacctccttatttttcctgaaggattgagcaaagattaaggcttctcccacttttccctcacctccatccccaaagttgggaagtattgatctcattgatcagtactgattttgttggctaccatctgaggaccttggagcgtatcccaatctcattatcacttccaacatccaatagtgtctttccaatatcatttcttttaactttttaagtcatccatctatttacttagcatttattgaggttttattatgaacaaggcatataagyaaaatcaattacaaatgtcagaaaacaaaattatactgtttttaaaaatttgcattcatatagccagatcaaatcagttacatctggggagggttttgagaatgttttaatcaactgaaatattataaagggccctcttttggtataagcatggcatttgttacaatgagcaatattgccagtgaaccctggcatgttagtgatattcccagagaactcccaagggctagtcagaaacaagcctgagaacctctgtttccaaatactgctgctaagataagcagaaagaagtgggctcgt

SEQ ID NO: 23209 - DNA, 601 bp, Human
ttgctaaggaaatctttctgcggcacttggcttgttgggaggtctttgagaataagatcacatggtcagtccatcaaagaacagtatgatatgataacaggagcacttatgaagtgacacagcttctctgggttttaatgtcttgcttggaaagtcagaatattaattttgcctgctcatagtcagagaactagttccaggtggctgtactgaagttcttttcaactctatgagctatgattctatgatttattaaaaaaaaaaaaaaaaggaataggacaggggtgaagggatactggcygagcacagtctcagtaattgatttgagctgtcatgaaatggaattaaaacattacttcatgataaaaggcaagtagtcctttaattttattaatcttttgcctacttttaagtatattttgatttttctgatttggaaagtaacatgagtgtaaaaattcaaataatagaatacataaagggaaagataggactgattttaaatatgaaatgtgtagatgggattcccttgacatttaaaagtattgggataatcaagtagaatttcttgttgataaattcattagtatcagatttgaac

SEQ ID NO: 23210 - DNA, 601 bp, Human
aacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtgagtcagtaaacaactatattgttttcttttttaagtctcttcttacctaattagaaaaaaaatctagtcaaacaattataataatggggaagtcatatacaaaatacagagggtaccacttcasagtgtcctaagctgtgaatgagtgcttaccagcatcttacttccacgttcctgtttgtcatttcattgagtatgtgtatgtggcttcatatattgttattaacagggaacagattatgaaaagctgatgtactttttcctggggaaactgtcagtatttaccacttactattgtgaaagatttaactaaggcactcatcttaaattcttatgttttattggatttaaaaattattttcattggcttgattgtatttgaaatctggtatttttgtgggtagctttgatttccttcagttga

SEQ ID NO: 23211 - DNA, 601 bp, Human
attgtcttgttggacaggaagtggaaagccagttaggggggctttggggttattcctgctgagagctcatgagtattgtagcctaggcagtggcggttgatatattaatgggcagtgtttacaggtgccttttaacaaggtcatgttattaagttttataactttatccaaagtggtgagccacaccatggtgaaatggacaaataatataatacaagtcatagagagactgtcctgtcccctgagtacctgaggacacaggtgcagcctttcttgctctcattctctgcattttgccaakagttggagaagttgggccggttgcttgggtgggaaaggctttcccactcacgcaggtccagcaagggagttcaggcacagggccttggggaaggcctagattcaagctggtgtcagggtatggcctcactgtgcccatttcccaacctttgttggtctccacccataggtggggtaaggttgcctgataaacacagggtgacacaaaatcagaattaggtgatagaggctacatccaggagctgcccatggcaggattgtatctcctatcctgttgatggagtcaagagcacaacttttt

SEQ ID NO: 23212 - DNA, 601 bp, Human
aactgttcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgayggcccgatgtgcatgcaggacaatcagggtaggcctaaagacgttgggctccccctgcgtgggcagagggcacgtggagcagatgggcgggaggccaggccagtggctctcaagctggccccgcaggacctcctgcttggtaaaggtgctccccaggtgctgctaactgggcgcttttttgcccagcagtgaagatttaggctgcctgaggactctccatgctttttatctattttatatattttattgagcatttccacctcagatgttacttgtatccagtagttaaaagcagggaga

SEQ ID NO: 23213 - DNA, 601 bp, Human
attatcttcatatacctgtgaactgtccctaccgtgctcgagtggccaactaccagcgtgacggcccgatgtgcatgcaggacaatcagggtaggcctaaagacgttgggctccccctgcgtgggcagagggcacgtggagcagatgggcgggaggccaggccagtggctctcaagctggccccgcaggacctcctgcttggtaaaggtgctccccaggtgctgctaactgggcgcttttttgcccagcagtgaagatttaggctgcctgaggactctccatgctttttatctattttatrtattttattgagcatttccacctcagatgttacttgtatccagtagttaaaagcagggagaaagatctttcacactggctagagtacagtaacatccagcttgggagttaggttttgaagacacttcaccaaaatggacaattccttaactcactgtgaaatcaccaagacttagacccttggaagtgcgaaagccaagagttggagtcttctgtttctctttgcagttctgctgtggccctggaggagcaggtctagctagaatttggaggggagctagaattagcagggaaggctggg

SEQ ID NO: 23214 - DNA, 601 bp, Human
tttttttttggtgtcgtatacaaacagcctctggttctaattactttttctaataagtcaagcagaatgcttgattaaagttttttccttttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggwaaaagaagaaaaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttga

SEQ ID NO: 23215 - DNA, 601 bp, Human
aaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgayccacccactttggccccccaaagtgctgagattacaggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttg

SEQ ID NO: 23216 - DNA, 601 bp, Human
cccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgrgattacaggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctat

SEQ ID NO: 23217 - DNA, 601 bp, Human
ttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgagattacaggcatgagccaccgcgcctggcttgattgtaaaagtagagcwtttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctataatagtatggtgttcttccttcccctacacacacacttggtgtcttgat

SEQ ID NO: 23218 - DNA, 601 bp, Human
ggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctataatagtayggtgttcttccttcccctacacacacacttggtgtcttgatgaatgtcatacataggcacctcttgattatccactgtggataatctattacggcagtgagctggctaaaattccaaccccagattggtttgctcaaaccacttaatatgtttctgggccactcctgtttaggcagtgtgtgctcgggtaatgaaagcttctgctaatgtcagccaaagcatagttgagaaaataaatatgctaaaacgaaaaaaaagccttataatttatttcaaaagtcatagaaaatattttgattg

SEQ ID NO: 23219 - DNA, 601 bp, Human
tgctcaaaccacttaatatgtttctgggccactcctgtttaggcagtgtgtgctcgggtaatgaaagcttctgctaatgtcagccaaagcatagttgagaaaataaatatgctaaaacgaaaaaaaagccttataatttatttcaaaagtcatagaaaatattttgattgtatttgtcactgtttcttataagtccagataagtaagtgctgatatacaattaccacattttaaaaaattctttgtttattggtctgtggagggtatgaaagtgaagctacaatggaacaaagtcatcatygtcagtaaaggagagataccctgagaatcctaaaaacactttacggaatagcaaagtagagttctgtaatggaaatactgtatatgctgggctggaggagacaaaaaacccagagttccaaccccatatctaccactggctaccgtgtgaccttgcagcagtcaggtcccatcacagagctccatgcttgtgtctgtagattcaaggagcagaaccagaactttcagatttccctcaagaattttgtgatgcagtgtttgaattgagcccaagtccaaatgacacaatttttcaagtcaa

SEQ ID NO: 23220 - DNA, 601 bp, Human
tcataaagtgcggcagcctgtgcaagcatttagcagatggcagcgttccctaagaatcttcatactacctgtagctaaatgcgggaaattaaaaataatatgtgtgcgttgtgtttatatctgtgtatgtgtacgtgtgtatttgattaccacttgaatttatttctcatcacagtgattatttgcagacttacttgacttttcttattcctaagtgcatctgggtggttttgttttgaaggtggtgctccaaattactaccccaacagctttggtgctccggaacaacagccttctgccytggagcacagcatccaatattctggagaagtgcggagattcaacactgccaatgatgataacgttactcaggtaatgacttctctttatctgctatggaagtcacctgctaattctccttgtcaatgcctgcataatccccctccctgcaaatgccccaactgtctgatgtatcttaaattgaattcaaggaagactcatctgtaatagtaaattgggccccttactgggtggagttgaagggttatattactctggtcttttgcctcaaagcatgcagactccgtctcagtttcttcaa

SEQ ID NO: 23221 - DNA, 601 bp, Human
agaaattacattattgtgggatataaaccatttttagatgagcttaaaacatttcctgcataccttttatgtaactgcattatttttggtgatgcagatgacaccaagtatattacagtacattccctgcctctcaaagaattttgcctatgtgaggtcaatacaggtattaaaccagctcatacaacccctgcaaaaattaatgaggctattgcttacacatgaaaatttattatgtgctcattcttattgagagaatttcttatcactatataggatatagtgtggtttttaagtaatyacaatactattgttatagattcatagcataattctgtgatgatgtatcacatgggaaatacataagaaggtccagatttattctcttaaaaatgattcacttgggcttgcatctgtctatggcagactagcttgtatcttacttaccgtttcatggagaacattgaaaaggtaggtaaaatacataaagcacttgtttgaaggctttggagagctaacaaagcaacaaggatttaagggaccaagatcaaagatggaaaagaagtgcaggaaaaaaaagtgcagtgaagtaagcttgaca

SEQ ID NO: 23222 - DNA, 601 bp, Human
tttaagggaccaagatcaaagatggaaaagaagtgcaggaaaaaaaagtgcagtgaagtaagcttgacatttggtttcctttcctcttaaggtatttgttaatttgtaagcactggtccagaagctgagtggtgtttacagcagtctcatgagtctgaagggacaaaaattggaattcaaggtctgctaagaagcagagcctctagttatactcaaggctttcagttgaaatccttaaagggccatgcctaggaataagggcaaacatgaaataaacttgctttcacaatacaggaaacayaactttgcctctgctcagtctcagattggattaaggtgatctctttctacgccatctgtcagaagcaaacaaaattttctttggtggaaaatagaaactcaaatgattctagacctttttatatggaaatgttcagcattcaacaataaatgaccaggcacctaacacattaagaccttatgactgaaaatcaagagggagaaaaaaccccctacaaactgacagtagaaacaaacctaatggaggcttaaataatggaactgtcagatacaggttttaaaatgactgattaataggttt

SEQ ID NO: 23223 - DNA, 601 bp, Human
tggaactgtcagatacaggttttaaaatgactgattaataggtttgagaaaatagatgggctgggcgcggtggctcacgcctgtaatcccagcactttgggaggctgaggtgggcggatcacgaggtcaggagatcaagaccatcctggctaacacggtgaaaccccgtctctactaaaaatacaaaaaaaaaattagccgggcgtggtggcgggcgcctgtagtcccagctactcaggaggctgaggcaggagaatggcgtgaacccgggaggcggagcttgcagtgagccgagatcgcrccactgcactccagcctgggcgacagagcgagactccgtctcaaaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaa

SEQ ID NO: 23224 - DNA, 601 bp, Human
tatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcrcgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatag

SEQ ID NO: 23225 - DNA, 601 bp, Human
atcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcaygcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattataga

SEQ ID NO: 23226 - DNA, 601 bp, Human
tcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagytcctatttttcattttaatttatggatatttattttagaggtcaacccaataatctagcaaaatatcactattaatatgtcttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtatta

SEQ ID NO: 23227 - DNA, 601 bp, Human
agatagtaaatgtgcaatatcaaaatgtgagtcctgctgcaattctacttaaactttggatgataataaatatatcagccggtgtgatggcatgcacctgtagtcctagctacttaggaggttgagatgggaggatcgcttgagcccaggaatacagggccagcctggacaacatagggagaccctgtctctaaaatcagtcaatcagtcaatcagtctgtctttcttttttgcatttttatggtttaaaacctgcctaaaggcttaatgtcataatacctcgatcctccttcagatgcaractagaaatttgcatgatttctggaataagaactgcaatgcttccaaaaggcaggctagactttcatgctaaggtgctggggtatttctgatggccgctcatcgagctgagtgaagccctctcacttctggtttcctggcctgtcccagagctaagctttttgcaaatctagaaatccccctttttccttggcccctagttgctgcttctcagttcctaggggcagctgggctagcagctgtctgggctgtgtcccagagcctgggttccagtatcagcagagagcttgacaggcgctct

SEQ ID NO: 23228 - DNA, 601 bp, Human
aacccttggcattctcctttcacatatgctgaaactgtaaggcttttatgggttcccaatgccctgcctcctcttgctgtccactggggaattcctgcctgaagtgtgtggagttgtgctgcatgtaccagtgttcttgtatccttcacattaactttaggctgtgtctgggcccgtttctcaatgtaaatcactgtaatttgttaagcgcttactctgaggtcagctcttttcatgcagtaaatgcacctcacttctcagcatttttctcacagcatcctgtgaggtaggttgtgtgggttttttttttttaagatggagtcttgttctgtcacccaggctggactgcagtggcatgatctcggctcactgcaacctctgcctcctgggttcaagagattttcctgcctcagcctccccagtagcttggactacaggcatgccccaccatgcccgactaatttttgtgtttttagtagagatggggttttgccatgttaaccaggctggtcttgaactactgacctcaggtgatccacccatcttggcctcccaaagtgctgggatttcgggcgtgagccactgcgcctggcctaggttg

SEQ ID NO: 23229 - DNA, 601 bp, Human
tgcctgaagtgtgtggagttgtgctgcatgtaccagtgttcttgtatccttcacattaactttaggctgtgtctgggcccgtttctcaatgtaaatcactgtaatttgttaagcgcttactctgaggtcagctcttttcatgcagtaaatgcacctcacttctcagcatttttctcacagcatcctgtgaggtaggttgtgtgggttttttttttttaagatggagtcttgttctgtcacccaggctggactgcagtggcatgatctcggctcactgcaacctctgcctcctgggttcaaragattttcctgcctcagcctccccagtagcttggactacaggcatgccccaccatgcccgactaatttttgtgtttttagtagagatggggttttgccatgttaaccaggctggtcttgaactactgacctcaggtgatccacccatcttggcctcccaaagtgctgggatttcgggcgtgagccactgcgcctggcctaggttgtatgggtttttttccccgacaataagcaattctgtaattctttgacagtaactgtgtgtcctataactcaattcaattctaacagtagctcctgg

SEQ ID NO: 23230 - DNA, 601 bp, Human
tttttgtgtttttagtagagatggggttttgccatgttaaccaggctggtcttgaactactgacctcaggtgatccacccatcttggcctcccaaagtgctgggatttcgggcgtgagccactgcgcctggcctaggttgtatgggtttttttccccgacaataagcaattctgtaattctttgacagtaactgtgtgtcctataactcaattcaattctaacagtagctcctggagctagagtcagaacccaaagatttaggggtcatttcccactttagataacaaatgaggtaccctrgctatgcacacttctgcagattctgactgcaaatcaaaccctttcctcaggtttgataatttgctggaaagactcatagaactcaggaaaatgatttacttatgattaccaatttattataaagaatacaactcaggaatagacaaatggaagaggggcatgggggaaggcctcggagcttctgtgcctccctgagtggaccacccttctagctcctggatgtgtgcactaatccagacactccctgaccttgccagttgtgggtttttctggaggttttatgacataggcatgattgat

SEQ ID NO: 23231 - DNA, 601 bp, Human
ggggtcatttcccactttagataacaaatgaggtaccctggctatgcacacttctgcagattctgactgcaaatcaaaccctttcctcaggtttgataatttgctggaaagactcatagaactcaggaaaatgatttacttatgattaccaatttattataaagaatacaactcaggaatagacaaatggaagaggggcatgggggaaggcctcggagcttctgtgcctccctgagtggaccacccttctagctcctggatgtgtgcactaatccagacactccctgaccttgccagttgygggtttttctggaggttttatgacataggcatgattgatgaaattattggctatgggtgattgaatacaatctccagcccctctcccatccctggaggtttgggggtggggctagaagttctaaccttctgatcgcgtgcttgttcttcctggtgtgagcctccatcaggaatctatgtaggcccccatgaatcatcttagtagtatataaaagacagtacattcgaagggttttagatctgtgtcaggaatgggggacaaagaccaaatagtatttttaaaattatactgattaggtgt

SEQ ID NO: 23232 - DNA, 601 bp, Human
gggagtgatatagtagggagttagagtaatgcttgcatttattttcctttggccttaggtcaagaacttcactgaggtccaccctgactacgggagccacatccaggctcttctggacaagtacaatgctgagaagcctaaggtaagctgggagcagcctggccatgcagaggctgtgtgtgctgggttggagtaggcatgacttagttaccacttagcattacagtctgcaggggccattacctgccactgttagatttcttaggcagctgtgcagaaattcatttgagagataaagaaytcactggcaaaacacatactcttcattttagcgctgggcaatttaagacagttaaagtgaatgaattctgaattattattttcatttgcatacatattaaaactgagtaaatatcacgttgctgcccatgaggtgattaacctgctcatcttgttcttttaaaacagaatgcgattcacacctttgtgcagtccggatctcacttggcggcaagggagaaggcaaatctgtgaggccggggccctgcacctgtgcagcgaagcttagcgttcatccgtgtaacccgctcatcactggatg

SEQ ID NO: 23233 - DNA, 601 bp, Human
acaagtacaatgctgagaagcctaaggtaagctgggagcagcctggccatgcagaggctgtgtgtgctgggttggagtaggcatgacttagttaccacttagcattacagtctgcaggggccattacctgccactgttagatttcttaggcagctgtgcagaaattcatttgagagataaagaattcactggcaaaacacatactcttcattttagcgctgggcaatttaagacagttaaagtgaatgaattctgaattattattttcatttgcatacatattaaaactgagtaaatatcacgttgctgcccatgaggtgattaacctgctcatcttgttcttttaaaacagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaa

SEQ ID NO: 23234 - DNA, 601 bp, Human
tgtttccctggctgggactcttggggatctttttcaggttttctgcagtttttctgaattgagctttaaggcaactggatggattttgaactgattttaaaataaacgacaaattgcaaaaagaaaaaatggttatgccaagatccagtgtgtgcacccttcatcctccttcccccaatggtgccatcttacaaaaatactagaacatgatcaaaccaggagattgacattggcacaatactgtaaccagatacagacttactttaggcagagggcactaagttttttttttttttttttgttttttttagtatcattgtatagaattttaccccatgggtacaatgtattaactatgttctctttctctcctaaaagttgctgatcccacaccctttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacct

SEQ ID NO: 23235 - DNA, 601 bp, Human
gtatcattgtatagaattttaccccatgggtacaatgtattaactatgttctctttctctcctaaaagttgctgatcccacaccctttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacctctgtgctttktctcctgccagctgatatgtgccattttgcctcaggactttgtcctcacttctcccactcccatggccattcgtcctccctgtcgcactggtctttgcacacctggctgactctcatccttcaggtcttagctcaaacgtctcctgagagatgctctttatttgctccattcccctccgcgtgggagtccatcctgtaccctttctctgctctttcagagagatcttattcaggctggtggaggctttactaccaccagttcattaggcccttctaatacctgtcacctgtctgaaacac

SEQ ID NO: 23236 - DNA, 601 bp, Human
tttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacctctgtgctttttctcctgccagctgatatgtgccattttgcctcaggactttgtcctcacttctcccactcccatggccattcgtcctccctgtcscactggtctttgcacacctggctgactctcatccttcaggtcttagctcaaacgtctcctgagagatgctctttatttgctccattcccctccgcgtgggagtccatcctgtaccctttctctgctctttcagagagatcttattcaggctggtggaggctttactaccaccagttcattaggcccttctaatacctgtcacctgtctgaaacactccttaagctcccaaccacatggttgtcttgctgcctttccatctcttcctgatgcctttccccacaatctaagatatttccaga

SEQ ID NO: 23237 - DNA, 601 bp, Human
aacagcgcaccttctctttggggcttgatttggcccctgcttgcctgggatttctcctgcaggctcctgcttcctctccatgctgcacgtgcactgacctctgtgctttttctcctgccagctgatatgtgccattttgcctcaggactttgtcctcacttctcccactcccatggccattcgtcctccctgtcgcactggtctttgcacacctggctgactctcatccttcaggtcttagctcaaacgtctcctgagagatgctctttatttgctccattcccctccgcgtgggagtccrtcctgtaccctttctctgctctttcagagagatcttattcaggctggtggaggctttactaccaccagttcattaggcccttctaatacctgtcacctgtctgaaacactccttaagctcccaaccacatggttgtcttgctgcctttccatctcttcctgatgcctttccccacaatctaagatatttccagaggatccctatccttttccctaagtcgtttgggacacagaccccaccacccacccaccaggatcctgcaggtcaccatgccccacccctcataatcatttactaggt

SEQ ID NO: 23238 - DNA, 601 bp, Human
ccatctcttcctgatgcctttccccacaatctaagatatttccagaggatccctatccttttccctaagtcgtttgggacacagaccccaccacccacccaccaggatcctgcaggtcaccatgccccacccctcataatcatttactaggtcctaggagttgtgcccactgagttcctcctgaatccgtctcattgcagctctacagcaggccctcacctgtccctctggacaattgcaaaccctcacaaggcacctctggtcttgagtcttttcctcttttcctttcccagcatcctgygtactgtctgcatggtcatgcctctcccaaaatccttcaggaggaaagtccaagcccttagcatggttcacagagatgtccataatctgccgctgcttaactctgggcccattttaactccccttcaacgtgctgaaggtgctggacatgactatcacatgtctttggttgtaaactgctgtgatagttaccctaagtaatgggacaggagatgaacccacccattaaataacacagcaattaagcagccacttttagaaaaatttaaatgtgtggcttcgagttgggtacttgcatgta

SEQ ID NO: 23239 - DNA, 601 bp, Human
caaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgcyaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatata

SEQ ID NO: 23240 - DNA, 601 bp, Human
ctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatrtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacagattgtttagatgctaaataagctttgtctcaagtacaatcaacctaaaaggtcaagggaagggacagtacaacttgggggtgagcaaacccagaaagtaaagaaagagccagttagtcaatattttcaatgttgtagg

SEQ ID NO: 23241 - DNA, 601 bp, Human
tcacatgataggtatgtggctgtggtgtctcctaaaaacttggagttcaaaggtaatgccctctatatctacaaagtctcaagataccaacacataatagctgttcactaaatatcagttcattgacttttgagcaaagtcaaaatgtggcctttcactgaaggagtccgaggcctgggttcctacctccagtgggactgtgacctctgtacaaccccagggatcctgtcttatctctgcttttctaccagggaacctttttcccacctgatctaactccttttccctgcagcttgacatrtaagacgaccatattgcagctgtaccgcatggaatagcggctccaaggcccaccttcggtggtttgcacacccctctttgcactgttcagaaaagcaccccctccttcccgcccctccccctcctcactggtagggcccgcacaaagtccacagggctgaggctggcttcttgaactgagctctttgtgaggagccttcctttctggggctctgctgccatctagtggaagacatgcacaaggttgggggaggaattgccgagaatgtggagaggggcctgaatgacttcacctttgaac

SEQ ID NO: 23242 - DNA, 601 bp, Human
caaatgggcccgccttacaatctagcagccacgtcctaatgagcggccttaaaactggtctggagcccaacccccagccccctacaccaggtcagcctgtggaatttagattctcctcttctcttcctgccttcccctccaggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccacsggtaagatgaggcttgagccggggagggagatgggggagctcttttgggagatgtccggggagaggcaaaaggccgtaggaactttcattttagttcaggagtttggaggaggggtggtcttgagtagtctaaagtctgaagtttcattcctgggttgctttttctttatctgagctttatatattcgctttctctgctaaactcataaatggtttatgaggacaggtgtggttaaggcaaaaaaaattagtgcctgttaaaatattctttatgatggctaaagtgctctttgaagatta

SEQ ID NO: 23243 - DNA, 601 bp, Human
tctagctgtttgccccactgggcgcgggagggaacctggttggctttcggtgaggctttactttctgagcgctgggttctgatgccctcagttcatgtggaggtgttttgattttggccgcagcctttaacgttgcaattccgcctaccacgtggatcccacaattgatacatcattcctactggcccatttgttttgtagtttcctaataaaccaaaggcagtggtttgctgttgtcttattaaacagccttggccagtgtctactggttttttgtttttttttttcttggtagtggccrtggcagagaccctggaaccttactcatccaagggagagatgtcaggagttcatgttttgacaatcagaaaccttaggtaaaaagctgatcacttgggaagacctttcggtgtgcttcacctcaaatttgccaagagtagttaaatcgctaggtggactcacgtggtaacttttttcaggatgttgttacatgttactggtgagttctacggaacggatgattatataacgtacgatgtagtgcatatgccctgtgctcacagtcaaaaagtcaggctttgctgcatatcagtgagtgacc

SEQ ID NO: 23244 - DNA, 601 bp, Human
ggagaagagagatggggaaagcctgacctggccttccctttcttcttcagcgtcagagtgcgtatctctctccccctattggtgaacagaagcaaagccatcacccctgcaccccaagacctcggccaccatagccaaaatgatgggtgctaaatgtactgggcaggaccatgtattccgtggttttaaacttacttagctctgaactctttatttggtaaaatcctaccaagaagtgcagataccaagttgatgaaatggagcacttctcagggcccatgcccaggtgagggagcccagmgggacccccagaggctcccagggcatccttgggaggataagccttttgtgcttgctggtgccggggctgcggctgggacccaattcctttgattcctgagccagagcgccacctttggggctcttctcccacttccgacgtgaaaggctgccctgtcctcctgagtggtatatgggaggtgactttgaggagctggtcagcttccagtaagttacgaagagctctgcatccagagtctcaaagtctcatccggatcccaggcccaacactcacagtgagtgacatcagccagatcacttc

SEQ ID NO: 23245 - DNA, 601 bp, Human
atgatgggtgctaaatgtactgggcaggaccatgtattccgtggttttaaacttacttagctctgaactctttatttggtaaaatcctaccaagaagtgcagataccaagttgatgaaatggagcacttctcagggcccatgcccaggtgagggagcccagcgggacccccagaggctcccagggcatccttgggaggataagccttttgtgcttgctggtgccggggctgcggctgggacccaattcctttgattcctgagccagagcgccacctttggggctcttctcccacttccgaygtgaaaggctgccctgtcctcctgagtggtatatgggaggtgactttgaggagctggtcagcttccagtaagttacgaagagctctgcatccagagtctcaaagtctcatccggatcccaggcccaacactcacagtgagtgacatcagccagatcacttcatctcccaagacttcattgattcacctgtaaaaggagatgtttgaaacagatgaatttcaagctcctttttattaatacctcaccatcatcaccgccgtcataagcaagcatgcagcccacagcagagctgcccctggc

SEQ ID NO: 23246 - DNA, 601 bp, Human
aacagactgctgagaaatttgtacctggtttttatttgttaaaataatattacgtacaaattttacaaactcatctgtgtttctcccacctaacagaacagcttttattttccgtgcatccttccagttcatccataggcatatatgtatgtatttacccatggttgtaatcttcatcgtcgcatgcatgcatgcaatttggttttccgcttccttcttctgagtggatattgtgaccatttctccatcctgtcatagcgacaaagctgatggtttccaggaatggctgcattgggtaggyggagctttccacagttgagggtgggggttggctaattacagctaggaagctagtgcacagatgaaatgatgtttgatttttttgtttttctctctgttcagtatcccctaccagtagagagggggatgtccttgagagtggtcctggggcagccctggtgccacggggaagtagcgccgctctgtggagagggctgctttgtgaatttgccggctggtagacaccgtgatccattctattgtctcctcattgttcttctccttgggagtcattcccattccagatcctcaagtaagagca

SEQ ID NO: 23247 - DNA, 601 bp, Human
tcattctgcacttccctgtagcaagtcacatttttttctcttagcaataaaatggggccttcagtctcatgagtcataacatcgaaaccgagtcacccatctgattcggatgcaatgattaatcttcagtgcttagttagagccctatgttagggttagaatcctctgccctaatgttctgagggttcttgctgttgggccagaggttgggaactgggtggaactcagcccccactcgcccactccctgcattgctgcttctctcatttccttttttagatcaaaccttttttttttttttgggtgggggtcatattaatcctcaatgcctgtccagagactataacaagatcccatctgaattagcattatgcatagattttgcccgtttctcccatctccttgtactttccctccttctcacatctggagcccctggtctgtcctgcttgcatggcccatggggtaccttgtctgcactggtctcaggcattctctgctctgttcccaccatcacctctagaggagactatgactcgctcaccttgctccccccaccagggtcaagaatgttaactcagacatgcttaatatgactggg

SEQ ID NO: 23248 - DNA, 601 bp, Human
ttttttttttttttgggtgggggtcatattaatcctcaatgcctgtccagagactataacaagatcccatctgaattagcattatgcatagattttgcccgtttctcccatctccttgtactttccctccttctcacatctggagcccctggtctgtcctgcttgcatggcccatggggtaccttgtctgcactggtctcaggcattctctgctctgttcccaccatcacctctagaggagactatgactcgctcaccttgctccccccaccagggtcaagaatgttaactcagacatgcwtaatatgactgggatctggggattggggaccttgaatcctctgtgcattcattgtgtgcgcttagataagctgtcttccttccctgcctcagtctccttcgtttaatctggaacagccatggtgatggcaaataaacacaggctccttgtgaaagaactcgagggaggacatgcctgtagggcacggggtcactcgcgccgctgacctgctgccgtcctgtttctgagtctctgcagtctcgggagctccaggatccaaattcgttctgtgccctgaccttctgcctctcattccttgca

SEQ ID NO: 23249 - DNA, 601 bp, Human
cttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaratcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcagg

SEQ ID NO: 23250 - DNA, 601 bp, Human
tgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagttt

SEQ ID NO: 23251 - DNA, 601 bp, Human
catcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggtt

SEQ ID NO: 23252 - DNA, 601 bp, Human
ttgggaaccaaataacttgttatttaagctcctatcctttgatatcttcctactcttgatcttagaggaggtggtgggaagtgaaataacagcaggactaaccttgtctttgcagatctgcttttcctgcattgaggacgcccaagagatatcgggggcaggtttcatagaggagaattctcacagtttccatgataccttgatattgtatgattagtgcacagaatttctgtgccctgctgccaccttctggggaaggcacacatgaagcattcttgacactcaggaaatccaatcctcytagagctcccctcaggaagcttactatggcacctccagaatgtagctcacagcctgctatgccctggatctcaaaggggtctatgtagagggaaaagagagcaagttattaaacacaaataagaaaaaaaggcatgagaaaagaacctaggattttagattttggtggggataaagttatttggtgtaaaatgatgatgagctaaaaactaatgataacatttagacattttcagaaacaagagcattgagaaaaatgtgcatgccatgaagacaaaggtatgtgataaaggagtacagt

SEQ ID NO: 23253 - DNA, 601 bp, Human
tggattatctatttttactcctgttgggattggggtcagggaaatcaatcaatcaatctctccctctttcatctctcaagctctatccttccccagtgcctccctctatgcctgaagatcacttcctggcatttccagcctgggtccctgctatttcttactccagtagaggatgatgtcctggccctctaaactgctgtgcttcacccgacaggacaggccagccgcctccccatctgccacatccagggttgctcggagataccatgtccagttagcattgggcaggatgtcccctagytgagtgccctgctgctcctgctcaccccgcatccacatcacccacacgggctttgggtagaatcctgagacatggcacacaagctgcagacggccaggtccaggactggggccactggacagccaggcctcaggcttcactaaggcaggaaggagaaaaaaaagtgtcatgttataactcgagttcagaggttatgaactcagaaacctacaagcttggacagcgaccccattcactcctttgggaaccaaataacttgttatttaagctcctatcctttgatatcttcctactcttgat

SEQ ID NO: 23254 - DNA, 601 bp, Human
tgggatattctgatatgacctgttaaaaacagaagaacaaaagagctccacataaaagatgtttgtacacccatgctcatagtaatattattcatgatagttaaaagtgaaagcaacccaagtgtccatagatagacgaatggatgaacaaaatgtgttatacgcatatggtggaatattgttcagtttcaaaaaaggaaggaagccctttcatatgctacaatgaggatattacgctaaatgaaataagtcacaaaaagacaaatatttacaattccacttatataaggtacctagaatwgtagaattcatagagacagaatgtagagctgtcctaaccagggcctggagaagaggggaaatgggaacttgcagcgtaataggaatagagtttcagtcttgcaagacagaagagttttgaagattgcttgcacaacaatgtgaacacacttaacaccactgaactgtacacttaaaaatggtaaagatggtaaaccttatgttatgtgtattttaacagaattttttttaagtccacataaaacgaatgggagtttggggaaaggatatggtgaaaggattgaggataaacaatttttaa

SEQ ID NO: 23255 - DNA, 601 bp, Human
tcagggctagaaattcatccaggcagagacagagaagaaattacatccaaaaggctctgcatctctgcaaatacagtgattctggcataattatatttggttttctttgacaaatgatatttaaccagaagcagaaaaagaaaagttttaaattaggaagccaaagggagtcaccattaagtcatatgtattatatttcatttattttgagacacattttttctaacattttaatgtgtgtaaaatcagggtgaatcacactgttagtacagtctcataataaatttacagttttaagtamttttttgctgatgtttaaataataatttattttaaaatacatgaaaactctgatttcatcaaatttgaaaatcatttgaaatatgataagattgacttttgggctgatatcttgggcttcttggtacttattgcgaatgggagaggagacatgatgatggctcatgggatattctgatatgacctgttaaaaacagaagaacaaaagagctccacataaaagatgtttgtacacccatgctcatagtaatattattcatgatagttaaaagtgaaagcaacccaagtgtccatagataga

SEQ ID NO: 23256 - DNA, 601 bp, Human
acacaggataaggtacactgaaagcagacactgaatgcaaaggaaggcaaacaatgtaattgcttatgtggaaaacagaatttttcataaagagagacaacacttcctggagaatgtacagatggatatgaaaaaaatgatggagaataactgggctagagcagaaagttttctaattaaatctaaacactgagatgatataaactaaagcaaagagaaagatctttaaagatcttctgaaattcatttttgcggctttctctcatctcaggtattctatcttcttatagataaaaagggrtttacctcttccctgaagaagaacctgtcttctctaaaagacaaagcctcacttccttccctaacaaccattagatatcacatacatagagattagcagtatatttctctaagattatatatcatatatagagagattaccagtatatcttgtataactactattaatgtcatatatagagataccagagagtaaataggcaatcagatctgacttactttcttgtccactctccggatgcaaagagctgttctctgctacgaaacaattttcagagctcatctttattctcaagattcc

SEQ ID NO: 23257 - DNA, 601 bp, Human
aaaaactcaacaaattttacagaagtaaggtatagaaaaacaataggcaaaatcccagtaacaggaaataagctagatatgtggatagaatagacaaatagaagagaggaaaatttctaagatgattatattttgctgagagacaaaggaaaggaagaacaaattctaagttacatagtctttgaagccagagattggaaaggttaaatagaaggatgaaatagaggaaaagagtcctataaagaataccaaagcaggagattgcattttcgggaattcttttgtgacttttttttttagyaaattacaaatggacactgtaaattttcatctgctgatatagctattctctcaaagatggcaaacttgcccatttccagcaactagaggatgctgtcatgagaacacaggataaggtacactgaaagcagacactgaatgcaaaggaaggcaaacaatgtaattgcttatgtggaaaacagaatttttcataaagagagacaacacttcctggagaatgtacagatggatatgaaaaaaatgatggagaataactgggctagagcagaaagttttctaattaaatctaaacactgagatg

SEQ ID NO: 23258 - DNA, 601 bp, Human
tggctcgcctgattacctgaaaatttgcatgctttgcatttgttatccacactatattttatgttcttaaacacaggatggatttatgagaagtaactgatgtttttcggaagtaaactaatatagtagacacacgcttagaaaataatccctttccacaagattgttttagttctcctgtttcttacatatccctttgttaatagatcgctcttgctgacaagtagactaattcctaagtgctagtgctttagggtacctcattaactaaggagaaagagggataaatagaaaaactcamcaaattttacagaagtaaggtatagaaaaacaataggcaaaatcccagtaacaggaaataagctagatatgtggatagaatagacaaatagaagagaggaaaatttctaagatgattatattttgctgagagacaaaggaaaggaagaacaaattctaagttacatagtctttgaagccagagattggaaaggttaaatagaaggatgaaatagaggaaaagagtcctataaagaataccaaagcaggagattgcattttcgggaattcttttgtgacttttttttttagcaaattacaa

SEQ ID NO: 23259 - DNA, 601 bp, Human
tcaggtcctgcacattaatggagaagttgaaaatcaactcaatttgctactaattgaatcacccaaggataacgtccaaggatgactagggcagcctaaatcagacattcaaaagaaagttgaaacagtatcaggaaaagttaaaaatttctgtattaggtccttctttcacctatgctctctatttattgagtagttattattattattattattattattatttctttttggcggcacacctgtgccgtaagtaatggctcgcctgattacctgaaaatttgcatgctttgcatttgtwatccacactatattttatgttcttaaacacaggatggatttatgagaagtaactgatgtttttcggaagtaaactaatatagtagacacacgcttagaaaataatccctttccacaagattgttttagttctcctgtttcttacatatccctttgttaatagatcgctcttgctgacaagtagactaattcctaagtgctagtgctttagggtacctcattaactaaggagaaagagggataaatagaaaaactcaacaaattttacagaagtaaggtatagaaaaacaataggcaaaat

SEQ ID NO: 23260 - DNA, 601 bp, Human
tctgtctcctcagtgagcactaacacaccccagtgacccgtgggttccagagtctcagtcagcccatcggctcaacgagggagtaagctttgggatgactctcagatgatactttattcccattaatgagggctactgttttatttatttattttttgagacggagtctcgctctgtcgtccaggctggagtgcagtggtgtgatctcggctcactgcaagctccgcctcccgggttcacgccattctcctgcctcagcctcctaagtagctgggactacaggcgcccgccaccacgcccrgctaactttttgtatttttagtacagacggggtttcatcgtgttagccaggatggtctccatctcctgacctcgtgatccgcccacctcggcctcccaaagtgctgggattacaattgagggctattgttacccacagcttgacttatctcctaggtgacaaaacatttccctcaacagcacacttttgctttgatttcaggtcctgcacattaatggagaagttgaaaatcaactcaatttgctactaattgaatcacccaaggataacgtccaaggatgactagggcagcctaaatca

SEQ ID NO: 23261 - DNA, 601 bp, Human
acagctctgtctcctcagtgagcactaacacaccccagtgacccgtgggttccagagtctcagtcagcccatcggctcaacgagggagtaagctttgggatgactctcagatgatactttattcccattaatgagggctactgttttatttatttattttttgagacggagtctcgctctgtcgtccaggctggagtgcagtggtgtgatctcggctcactgcaagctccgcctcccgggttcacgccattctcctgcctcagcctcctaagtagctgggactacaggcgcccgccaccaygcccggctaactttttgtatttttagtacagacggggtttcatcgtgttagccaggatggtctccatctcctgacctcgtgatccgcccacctcggcctcccaaagtgctgggattacaattgagggctattgttacccacagcttgacttatctcctaggtgacaaaacatttccctcaacagcacacttttgctttgatttcaggtcctgcacattaatggagaagttgaaaatcaactcaatttgctactaattgaatcacccaaggataacgtccaaggatgactagggcagccta

SEQ ID NO: 23262 - DNA, 601 bp, Human
tattgcaacagctctgtctcctcagtgagcactaacacaccccagtgacccgtgggttccagagtctcagtcagcccatcggctcaacgagggagtaagctttgggatgactctcagatgatactttattcccattaatgagggctactgttttatttatttattttttgagacggagtctcgctctgtcgtccaggctggagtgcagtggtgtgatctcggctcactgcaagctccgcctcccgggttcacgccattctcctgcctcagcctcctaagtagctgggactacaggcgcccrccaccacgcccggctaactttttgtatttttagtacagacggggtttcatcgtgttagccaggatggtctccatctcctgacctcgtgatccgcccacctcggcctcccaaagtgctgggattacaattgagggctattgttacccacagcttgacttatctcctaggtgacaaaacatttccctcaacagcacacttttgctttgatttcaggtcctgcacattaatggagaagttgaaaatcaactcaatttgctactaattgaatcacccaaggataacgtccaaggatgactaggg

SEQ ID NO: 23263 - DNA, 601 bp, Human
ccgcctttgctacccaaggtaccaagttcggagctctgtctggtttcacttcacattatgtgagtcagtcgtgctgcttgaactcagtattgcaacagctctgtctcctcagtgagcactaacacaccccagtgacccgtgggttccagagtctcagtcagcccatcggctcaacgagggagtaagctttgggatgactctcagatgatactttattcccattaatgagggctactgttttatttatttattttttgagacggagtctcgctctgtcgtccaggctggagtgcagtggtgygatctcggctcactgcaagctccgcctcccgggttcacgccattctcctgcctcagcctcctaagtagctgggactacaggcgcccgccaccacgcccggctaactttttgtatttttagtacagacggggtttcatcgtgttagccaggatggtctccatctcctgacctcgtgatccgcccacctcggcctcccaaagtgctgggattacaattgagggctattgttacccacagcttgacttatctcctaggtgacaaaacatttccctcaacagcacacttttgctttgatttcag

SEQ ID NO: 23264 - DNA, 601 bp, Human
aaggagaaaagagaattttgcgacttagattttggattttaattttgcaggatgagctgtcaggagtcttaaaatgcggccccacaaggagtatacaggtccctattatgttctcaaaaaccaaaatgtaaaatggctgcttaagtaactgacaatgcaaaacagtttcaaaatagaaaacattctatttttcaatatggatgattttcataacttaaaaaagtttacataagacatatcttgaaatacacatatttttacccttaaaacatttatctaaaggtaaactggaccaagagawgttgcctttttttcacagtaatttactgggtactggtgtccacatcaacttttgctttatctggaagttatttttcccatcacagatcggcactcagattttgcaagagaagcctttacttcactgccgtctagctcgattttctcagcttctcaaagcaaatttttctttgttcaccggtatagaatcatcattggaagccgcctttgctacccaaggtaccaagttcggagctctgtctggtttcacttcacattatgtgagtcagtcgtgctgcttgaactcagtattgcaacagct

SEQ ID NO: 23265 - DNA, 601 bp, Human
gttgctggtcttgtggttataccactgtcataagtcgttaaactgtatacctacgagctgtgcattcatcgtatgtgaactaaacctcaatttaaaatgatatgtgaatgaacagtaaaaatttgaatttttcaaaagatgttaaaataatagaggaaatgtaacagtattatagaccaaatattcagcgaaagttatttcatttaccctctgtacaatggtgaaacaaagtaaaagccttttttttttccaacaagcagtgtttctatggaaggatttagaataaaaatatgatgttaaygataactgatagttacaaaaaactctaagaggatgtctgttctacactctaagtaaataactgaggaaggagaaaagagaattttgcgacttagattttggattttaattttgcaggatgagctgtcaggagtcttaaaatgcggccccacaaggagtatacaggtccctattatgttctcaaaaaccaaaatgtaaaatggctgcttaagtaactgacaatgcaaaacagtttcaaaatagaaaacattctatttttcaatatggatgattttcataacttaaaaaagtttacataaga

SEQ ID NO: 23266 - DNA, 601 bp, Human
aggtaatttaactggaatgggacacagggcaaactgtctagggtgatggaaagattcaaatgttgctggtcttgtggttataccactgtcataagtcgttaaactgtatacctacgagctgtgcattcatcgtatgtgaactaaacctcaatttaaaatgatatgtgaatgaacagtaaaaatttgaatttttcaaaagatgttaaaataatagaggaaatgtaacagtattatagaccaaatattcagcgaaagttatttcatttaccctctgtacaatggtgaaacaaagtaaaagccttttttttttccaacaagcagtgtttctatggaaggatttagaataaaaatatgatgttaacgataactgatagttacaaaaaactctaagaggatgtctgttctacactctaagtaaataactgaggaaggagaaaagagaattttgcgacttagattttggattttaattttgcaggatgagctgtcaggagtcttaaaatgcggccccacaaggagtatacaggtccctattatgttctcaaaaaccaaaatgtaaaatggctgcttaagtaactgacaatgcaaaacagtttcaaaa

SEQ ID NO: 23267 - DNA, 601 bp, Human
accaacaggaaaataagtgaacaaattatggtatatccatacaagggaattccgctcagcaattcaaaataagacaactgatacatgcaacaaaatgaaggaatctccaaaaaaaatgttgagtgaaaaaaaatccagccacagaagattgtatactacatatttgcatttacatgacgttaaataatagttggtctaagctctggtgtcaaaaatcagaacagtagttgcctttgtgtgtgtaggaaaggtaatttaactggaatgggacacagggcaaactgtctagggtgatggaaasattcaaatgttgctggtcttgtggttataccactgtcataagtcgttaaactgtatacctacgagctgtgcattcatcgtatgtgaactaaacctcaatttaaaatgatatgtgaatgaacagtaaaaatttgaatttttcaaaagatgttaaaataatagaggaaatgtaacagtattatagaccaaatattcagcgaaagttatttcatttaccctctgtacaatggtgaaacaaagtaaaagccttttttttttccaacaagcagtgtttctatggaaggatttagaataaaaatat

SEQ ID NO: 23268 - DNA, 601 bp, Human
tatggcccaacaaacctattcctatgtatatcctcaagaaaaatgaaaatatgttctcaaaatgccttgtgcaagaatgctcctagcagctttattcttaagagccaaattccagaaataatccaaatatccaccaacaggaaaataagtgaacaaattatggtatatccatacaagggaattccgctcagcaattcaaaataagacaactgatacatgcaacaaaatgaaggaatctccaaaaaaaatgttgagtgaaaaaaaatccagccacagaagattgtatactacatatttgcayttacatgacgttaaataatagttggtctaagctctggtgtcaaaaatcagaacagtagttgcctttgtgtgtgtaggaaaggtaatttaactggaatgggacacagggcaaactgtctagggtgatggaaagattcaaatgttgctggtcttgtggttataccactgtcataagtcgttaaactgtatacctacgagctgtgcattcatcgtatgtgaactaaacctcaatttaaaatgatatgtgaatgaacagtaaaaatttgaatttttcaaaagatgttaaaataatagaggaaat

SEQ ID NO: 23269 - DNA, 601 bp, Human
ggtgaagttgctgcagatgtggagcaactggaattttcagatattattggtgggagagtaaattggaaaaacactttggaaactgtttcttataaaattaaatatatgccttttctatggcccaacaaacctattcctatgtatatcctcaagaaaaatgaaaatatgttctcaaaatgccttgtgcaagaatgctcctagcagctttattcttaagagccaaattccagaaataatccaaatatccaccaacaggaaaataagtgaacaaattatggtatatccatacaagggaattccrctcagcaattcaaaataagacaactgatacatgcaacaaaatgaaggaatctccaaaaaaaatgttgagtgaaaaaaaatccagccacagaagattgtatactacatatttgcatttacatgacgttaaataatagttggtctaagctctggtgtcaaaaatcagaacagtagttgcctttgtgtgtgtaggaaaggtaatttaactggaatgggacacagggcaaactgtctagggtgatggaaagattcaaatgttgctggtcttgtggttataccactgtcataagtcgttaaactg

SEQ ID NO: 23270 - DNA, 601 bp, Human
ataaaaaattctagcataattccttaatctccttgtagttactgtttgagagaaatgatgtgaatgggataaatatggataatatcataaagtaaaatattgaattgctatataaatatctgacattaaaatgactgaacaaaattttaaacgtgacagtattttttggtgaagttgctgcagatgtggagcaactggaattttcagatattattggtgggagagtaaattggaaaaacactttggaaactgtttcttataaaattaaatatatgccttttctatggcccaacaaacctaytcctatgtatatcctcaagaaaaatgaaaatatgttctcaaaatgccttgtgcaagaatgctcctagcagctttattcttaagagccaaattccagaaataatccaaatatccaccaacaggaaaataagtgaacaaattatggtatatccatacaagggaattccgctcagcaattcaaaataagacaactgatacatgcaacaaaatgaaggaatctccaaaaaaaatgttgagtgaaaaaaaatccagccacagaagattgtatactacatatttgcatttacatgacgttaaataa

SEQ ID NO: 23271 - DNA, 601 bp, Human
gtgttgagaaatggggactggtggcatcatctggaagggagaaagttgatgatgagttcaggcagactatagaagtactataggaatatgcaacattcttttgaggcatttaaacttaatatttcctatctcattatatgaaatttccccgtctctttatagaaatttctaagttaatttacccccaattttgagtgaatttgaatagtttattgttggcttgaaatgaaacaattcaagcataatgatgagattataaagtgtctccccaaaatatttacctgacacatatgatttatayacttagtaactatgaaaattctaagtatataatcagtttgttttaatgatgataagaacgtttattaaatatgcacatgccccagaagacacataaaaaaattctagggcatggtggctcacacctgtaatctcagcattttgggaggccgaggtgagtggattgatcacctgagctcaggagttcaagaccatcatgagcaacatggtgaaaccctgtctccaccaaaaatacaaaaaattagctggtcatggtggcacgcacttgtgttcccagctacttgggagtctgaagtgggag

SEQ ID NO: 23272 - DNA, 601 bp, Human
ttctgaaaatttggactagatatttctttggactagaaaggataaagtgcattatacatttcaaataaggttttgaatctgaatgcagaggcggaagaatttgaagatgcagtatttatagcactaggctggaaagatggagagagtaactaacttttagggaaccaattcaaaatacagaaagacatatgactcagaatatctcaaaacaatggtaaacattcccatttgtaaaagatacaaatatatcttggtatagctggaggtattgaataccaaatcactactgactctctgggarcttttaaatataatcttaattattcagaactaccattctgtgtcctttgagataaaacacaaaagactggccacttcctgattaatctatggctttagatacgatttttttccataatcaatgaatgtgaagttcacatttttttctagctaaataggtatttattcagaattcaaatcagctcccttcattctagatgtaaacatcttttcaaatgcaattttattctacagtaatatataaatcatagatacttttaatacttataaaagtattacattaattattcaaggattgtgg

SEQ ID NO: 23273 - DNA, 601 bp, Human
ttgtgcctaatcatcattggatggagatatgaggatgaggggatgtacttttggtcataatgtcagaaaatgacagaaatatagaacaattctgaaaatttggactagatatttctttggactagaaaggataaagtgcattatacatttcaaataaggttttgaatctgaatgcagaggcggaagaatttgaagatgcagtatttatagcactaggctggaaagatggagagagtaactaacttttagggaaccaattcaaaatacagaaagacatatgactcagaatatctcaaaacartggtaaacattcccatttgtaaaagatacaaatatatcttggtatagctggaggtattgaataccaaatcactactgactctctgggaacttttaaatataatcttaattattcagaactaccattctgtgtcctttgagataaaacacaaaagactggccacttcctgattaatctatggctttagatacgatttttttccataatcaatgaatgtgaagttcacatttttttctagctaaataggtatttattcagaattcaaatcagctcccttcattctagatgtaaacatctttt

SEQ ID NO: 23274 - DNA, 601 bp, Human
tccatgggtgaccaggttcctttttcagtccaacccagtgttcctctctacctgcgtatcgttttagaaagttcttaaagaaagcacaaaggagtttgttacattaaacacccttctggggaagtagatagtaaatcctgtttctcaaaagctgcaacttgaggcatgacagcttatctgaccatgtactcattctatataggatcagcatatttggatttctggtctttgaagctaagcaatcaaatcaaatttaaaagattaaattaaatctcattttgacctcaggctgatcatatgkttctctgggatgacattttcctacatctgaaataggtacaatgtttgtttgtttgtttgttttctccacttagaaacggaaggaaagcactgattagccatatgaattaaaatagtagtattttatcttttttttattcttaccatgtccttttcagaatcaatgacagcaagagtagcaccatgttcagaacaagcattttgggctgaagtccagctcctcttcacagtagaaataaagtagcatttcctctggtagccaacccagtcctcagagcatgaagaaacatggctgtctgat

SEQ ID NO: 23275 - DNA, 601 bp, Human
gtcaaacaataaaaaaacttagaattattttcagctcattgttttcattcagttacatgagaatgaactcggagatggtgacctctgcttcttttaaattcttagtgggatacacaagtcaaataatcatagactaatctgtagagacaatggacaagaattgaaaaaaaataggatgtggagaaaaaatatggaagtaagaggaaagcacgccattcatttggttggcatggcaccagataagtgattcttggtcatttctgagttcatagatttttcaataaataatttcacaaaattrtatgcattcaacagccatgcatactagtgcatacagctttaaggggtttatggctcctgaagcccatctgtggatatggagccataggacaaatattaggaatcccttttctagaaacctgaattttaatctcgatactttatcagtattatgatcaacagcaaacttataaaatgatcttcaaacattaaatgtattttaactaaaggtaatgaaaatagagtatctaattctggggcaaattttctttcaggtgtatagaaactcataattaggcattgaaactattctttattctgt

SEQ ID NO: 23276 - DNA, 601 bp, Human
attatttctggattcaaaataatataaagtgcatccaaaggttgcatagtcattcttctcattcttgggcatggttattggtcaacctgtgatgcttctagctcatggcaataaaagcccacagtgcagattttcctggaatttcttcctttttttccatagttctgtttggaagaaaattcccaagacactataaaattttttttcacaaagtctctatggaagacttcggaccacagagcagcatccactgacacagatttccttgagttccattctataatagtcaataagtgaacaygtttccttattatttgtaaggtttgttacatatccagtataaattcttctcacattccatgctgctgacctctgtgtttttcagaaaaacacacttgtcagaccctgtaacgttgaacctgtcaaacaataaaaaaacttagaattattttcagctcattgttttcattcagttacatgagaatgaactcggagatggtgacctctgcttcttttaaattcttagtgggatacacaagtcaaataatcatagactaatctgtagagacaatggacaagaattgaaaaaaaataggatgtg

SEQ ID NO: 23277 - DNA, 601 bp, Human
aatcttagtttcataagcatttgtccatttataaatgctccctgagtttaagggattcaattagactaaaaacctatgttaccagccataattcctttgtttacattcagtatctagtaccaacatctaactccttccaatagtgcaaatgcatgaagggctctcactgttggtagtcattcagcaataaatagtaagtccacgcctagttatttcattatttctggattcaaaataatataaagtgcatccaaaggttgcatagtcattcttctcattcttgggcatggttattggtcamcctgtgatgcttctagctcatggcaataaaagcccacagtgcagattttcctggaatttcttcctttttttccatagttctgtttggaagaaaattcccaagacactataaaattttttttcacaaagtctctatggaagacttcggaccacagagcagcatccactgacacagatttccttgagttccattctataatagtcaataagtgaacacgtttccttattatttgtaaggtttgttacatatccagtataaattcttctcacattccatgctgctgacctctgtgtttttcag

SEQ ID NO: 23278 - DNA, 601 bp, Human
attctaggtctgaagattacagaatatttcctaatagagatttgccacatcacatattgcacattttccaacactattctatgtcttgcaaatattcctcatagtctttgcttatgtcttttctctgtaagacactgtataaaagattataaaggcaaagaaatatgtaccatcgaaaaggacctgtctacagctgaggaagtaaaaaaataaatacacgatcatcccattctttttggggaaaaataacaaagtaaattggcaaatttctctaaaaagagagaaatattacaaatcttartttcataagcatttgtccatttataaatgctccctgagtttaagggattcaattagactaaaaacctatgttaccagccataattcctttgtttacattcagtatctagtaccaacatctaactccttccaatagtgcaaatgcatgaagggctctcactgttggtagtcattcagcaataaatagtaagtccacgcctagttatttcattatttctggattcaaaataatataaagtgcatccaaaggttgcatagtcattcttctcattcttgggcatggttattggtcaacctgtga

SEQ ID NO: 23279 - DNA, 601 bp, Human
ttttactctacatgggatttttttctaagttatagtaactctgttttctgctttctcatatagtatatactttttaatgtattttgaaggaatgaactttcttggaaaccattgtgtttattctacttttatttcacatatataaaaacagcttataattgtactgaacacaaaatacaaacaaatacattttattgcacataaaaatattttaaatgaagtattgaagtattgcacgtaatagaattgatttaggaaagtcacaaacctattataagactagtattattctaggtctgargattacagaatatttcctaatagagatttgccacatcacatattgcacattttccaacactattctatgtcttgcaaatattcctcatagtctttgcttatgtcttttctctgtaagacactgtataaaagattataaaggcaaagaaatatgtaccatcgaaaaggacctgtctacagctgaggaagtaaaaaaataaatacacgatcatcccattctttttggggaaaaataacaaagtaaattggcaaatttctctaaaaagagagaaatattacaaatcttagtttcataagcatt

SEQ ID NO: 23280 - DNA, 601 bp, Human
attgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaargatgtcgtcgcagagacagcaagagacccacccccaggcccctggcagcgcagtggatccgggatcgctggagacgcggtgcacacacaaatcaggttcagatctgtggggttcatcctcccgggccccttttaagcgcttggagtcactaggaatgtaccaacggccctcggagggaggacgaggcggagagccacccaagaaaggtggcggaggcggggagaccctgcgggcacggctcacgcgcacatccccggcttccccgggctccgcgccttcccaagagccccgttgtctccg

SEQ ID NO: 23281 - DNA, 601 bp, Human
attcgacttaatcaccaagccggggctgcaaaaaagccagcttaccagggcacctcactcaagtacatctgggaagtaggggtctttaatttacattacagatcgtcagaagcaaggataagataaatcagatcatttgggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtraaaatgcttgctataaggtgcccggttgcaggcgaccgaaggcgcagtgatggagaactgacgcgggtgacttgtcttcttcaacatcacacacttctcccgatggctgatgtagtgctcccctgggagcaccctctgctagtccggccagacggttccttaaggtgtcaggagggcccgaacctgagtgcggtctctccgcatctccgcgcccggggttaacgatggcttgggagtgtgggcattgctcccgaggccaggggcaggaggactggtggtttagaagcagaggggtttgcg

SEQ ID NO: 23282 - DNA, 601 bp, Human
caaatcctaaaatacagttgaaaccgcccatgccaacaaaactttacgaaacatcccacatgttgaagagtgactaaaagaacctgctcccaagaaaaacaaacttacttctttccttattcttttctttcacttacccctttctcctaaccctaaacccaaaaaaccacaaagactgacgcactaactgctcagaaaaagtagaacctctcacacttcggggtgattaaattttacctctggccccggaggattggtagagagattcgacttaatcaccaagccggggctgcaaaaaagscagcttaccagggcacctcactcaagtacatctgggaagtaggggtctttaatttacattacagatcgtcagaagcaaggataagataaatcagatcatttgggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcaggcgac

SEQ ID NO: 23283 - DNA, 601 bp, Human
ctcctgtcttcccccaactgccccctcgggactacatccattatgttaatgagctgtacctcagatatctgtgaaaagaccgatcaacccagctggttgcacttcaaaagctttagagtttgtcaatcgagactagttcaaggtccttgaaaatacacttgttctaaagattaaagattaaaaactgttacaacctgtcctggtttaacagtggtttagagtgtaggctctggaacaacaatgctaaccccgggagcctggagccgctatcgatagaagacctagtgcaagtcattcaacktcttcattgcctgccattcctcatatgtgtcaagtgtctggaagagtacctgtcccataacaagtcttcaattacctggagcaaatgcaagaaaatttaaaagctagactctctgctagctttcacggctacagaagggctctaccatgaactaagctgataggagccaaaggaatttcctcaagtcacttgtatatgaaaaatgggatccttagtggtcttcactttttctatttcaaatcctaaaatacagttgaaaccgcccatgccaacaaaactttacgaaacatcccacatgtt

SEQ ID NO: 23284 - DNA, 601 bp, Human
cagaagtcttaggataatctttgttgcttctctgcagcttctttcaaagaattcacagcctggcccacacgggagcatattctgtcttgattcttctgcactggccctcccaaagtcagagaacagaatccttcacagcgctaggcacctatttaatgcaaaaaatactgtagaattgacttctctcccatctcctgtcttcccccaactgccccctcgggactacatccattatgttaatgagctgtacctcagatatctgtgaaaagaccgatcaacccagctggttgcacttcaaaasctttagagtttgtcaatcgagactagttcaaggtccttgaaaatacacttgttctaaagattaaagattaaaaactgttacaacctgtcctggtttaacagtggtttagagtgtaggctctggaacaacaatgctaaccccgggagcctggagccgctatcgatagaagacctagtgcaagtcattcaacgtcttcattgcctgccattcctcatatgtgtcaagtgtctggaagagtacctgtcccataacaagtcttcaattacctggagcaaatgcaagaaaatttaaaagctagac

SEQ ID NO: 23285 - DNA, 601 bp, Human
gtcatgttaaagaaaaggggtctttactccattttttgggagttttttttcccttcgtcatcggttaactcttgtccagcatgccccttccatcctgtcccattcctccccaccccgaggtgtccgaagagcatgatcctagagggagttacttagtaagtgctttttagcctcagttttccctactttgtagcctttatgacctaacaagaagctgtgtacacaaccttcaattcacagtaaactgagttcctgcagaaggatcctaattcttcctccagaagtcttaggataatctttsttgcttctctgcagcttctttcaaagaattcacagcctggcccacacgggagcatattctgtcttgattcttctgcactggccctcccaaagtcagagaacagaatccttcacagcgctaggcacctatttaatgcaaaaaatactgtagaattgacttctctcccatctcctgtcttcccccaactgccccctcgggactacatccattatgttaatgagctgtacctcagatatctgtgaaaagaccgatcaacccagctggttgcacttcaaaagctttagagtttgtcaatcgaga

SEQ ID NO: 23286 - DNA, 601 bp, Human
gctggttttaatatgtgtagtgtatgcctgaatgccctgtgctaattccattgataatttttgttgggattagggaacattgtgaacaagtaagtagaaaatgagggctgggtgtggtggctcatacctgtaatcccagcactttgggatgccgaggtgagtggatcacctgaggtcaggagttcgagaccagcctaaccaacatggtgaaaccccatctctactaaaaatacaaaattagccaggcatggtggtgcatacctgtaatcccagctactcaggaggctaaggcaggagaatygcttgaacccaggaggcagaagttgcagtgagctgagatcatgccatttcactccagcctgggcaacaagagtgaaccactgtctcaaaaaaaaaaaaaaaaaaaaaaaaaaatgagatttgttactacttgtaagacctgtggctagcctggtactatatttttcatatgctagaaaacatgctctaataaatatctgtgaatgaatagttattttacctgccatgtccttcaccccaacagagaatcatcagattaaattttccatttccttgatccacaagatttcgggtataccta

SEQ ID NO: 23287 - DNA, 601 bp, Human
aagcttacctattcttaaagatctgatctattttcacaagcactctgactccagctgaaagtaattattctgaaaggtgtgtgaatgctttacttctgaaattattctgaaagctttactgtgaatgtacagacaacagaattttcttggaaatctggtgtgccttatagatagcaaccctcacattatttgggtaaatgaatcagagcttcctgccacataggaaactaacatccttgtgttatgtgaatgagcgacaacttcccatacaatttgatctttgcaagtgacttgtatatargccaaatatcgaggccagtaagatttatggagaaaaaaacttgctttgccaaaaaaaaatcccccaaagctctataatactttatataggtggggtacatgctgatgaagaacataggtttttcaatcaaattgcttaggttcaaattctggttgccacttaaaagctgagtaaccttggacaaattgtttaatcttcctatgtgttggcaacctcctacgtaaaagggaataaaaaactatctatctgtctcatatacattttaatgagctttttggaaagttactgttccttttagga

SEQ ID NO: 23288 - DNA, 601 bp, Human
gagtcatcaaacaagatacatcactgtgaaatttcagaatactgaggatagagagaaggcaccaaaagagaagatcccaaaagtttctagaaagaaaatagaaagattcaaaaatcagaatgggaccaggtttttttaaaaaaaaacaaaaaaaacaaaaacagggtctcattctgctgtccatgctgaagtatagcagtgggatcttggctcattgtagcctccacctcccgggctcaagtgatcctcccacttagcttcccaagtatctgggactacaggcacctgccaccatgcccasctaatttttgtatttttggtagagatggggtttcaacatgttgtccaggctgttcttgaactcctgggctcaagcaattcttccatcttagcctcccaaagtgctgggattacaggtgtgagtcaccacacccggccagccctaggcttttgataagaacactagaaactaaaagacaaaggaattaccctcatggttctgagggaagatgtttatcaggtgataatccataacccagctaaattatcaatcaagttgtaggagttgaatatagagatatttaaatatatggggtctcaa

SEQ ID NO: 23289 - DNA, 601 bp, Human
acagttcaagaggtttaatatctaaataggagtttcagaaacagaattaaaaaaaaattcaaagaaataacctgttaatgttttcctgagtcgaaggacacgaattcccagatttaaaaacccactgagtacccagcacaatgaatgagtcatcaaacaagatacatcactgtgaaatttcagaatactgaggatagagagaaggcaccaaaagagaagatcccaaaagtttctagaaagaaaatagaaagattcaaaaatcagaatgggaccaggtttttttaaaaaaaaacaaaaaaaacaaaaacagggtctcattctgctgtccatgctgaagtatagcagtgggatcttggctcattgtagcctccacctcccgggctcaagtgatcctcccacttagcttcccaagtatctgggactacaggcacctgccaccatgcccagctaatttttgtatttttggtagagatggggtttcaacatgttgtccaggctgttcttgaactcctgggctcaagcaattcttccatcttagcctcccaaagtgctgggattacaggtgtgagtcaccacacccggccagccctaggcttttgat

SEQ ID NO: 23290 - DNA, 601 bp, Human
aaaaaaaaaaaagaggaacagttcaagaggtttaatatctaaataggagtttcagaaacagaattaaaaaaaaattcaaagaaataacctgttaatgttttcctgagtcgaaggacacgaattcccagatttaaaaacccactgagtacccagcacaatgaatgagtcatcaaacaagatacatcactgtgaaatttcagaatactgaggatagagagaaggcaccaaaagagaagatcccaaaagtttctagaaagaaaatagaaagattcaaaaatcagaatgggaccaggtttttttaaaaaaaaacaaaaaaaacaaaaacagggtctcattctgctgtccatgctgaagtatagcagtgggatcttggctcattgtagcctccacctcccgggctcaagtgatcctcccacttagcttcccaagtatctgggactacaggcacctgccaccatgcccagctaatttttgtatttttggtagagatggggtttcaacatgttgtccaggctgttcttgaactcctgggctcaagcaattcttccatcttagcctcccaaagtgctgggattacaggtgtgagtcaccacacccggcc

SEQ ID NO: 23291 - DNA, 601 bp, Human
gaagttcctgaagaaaaagtctctgccagactatcaaaaagtgaaatccagttgacaagctccactcatgttcagggttaccaattaatttttttgttcttggtttttaaatattagcacattgccaaggtcaccagacatttgagcaaggcctctagtatgaaagacagagggcagagcaaacaaaaaagcaacctgcaacagagactactcaggggaagtgttcaaaaacctatcattaatgttttcctagaaataagagaaaataccataaaagggaccataaaacaaaaagaggttraagaaacagaaaccagaaaagggttggcaggaaatgctgaggaagactcaaagaacaaaaggacaaagacagaaaatagaaaagaaagagaaaaaaaaaaaagaggaacagttcaagaggtttaatatctaaataggagtttcagaaacagaattaaaaaaaaattcaaagaaataacctgttaatgttttcctgagtcgaaggacacgaattcccagatttaaaaacccactgagtacccagcacaatgaatgagtcatcaaacaagatacatcactgtgaaatttcagaatactgagg

SEQ ID NO: 23292 - DNA, 601 bp, Human
tacaaagacaaaataggaaaagagaaaacactaacaaaaatttgaaagcttagaaagtaagatggatagctttacagagcagagaaagctaaatcctaagctatccatggagaaaaccaagaaataacctgatttatatcttgaaactccaaatagcacaggaattgacagcaccaggtacttctggaaatgagggtaaagataggctgtagatataagaactggtttaaagcttgtttatgaagtagagtctcaaaacccttttaccaattctctctcttctttcttttcagcagcagastaaggtctagtctctagaaagagtgtaagagatcaacttgggactgatggaaatcaggtgaaaaacaggtgaattaaacaaaagcttccatactgaatggtaaaaatccctgctttagtcatcacctagctgcgagaatgctgccagacaagatttttctttccaggcagaagataggaagcaacttctcagagaatctgattggctcaagaaaaaagctttaaagatattgtcgctggaagttcctgaagaaaaagtctctgccagactatcaaaaagtgaaatccagttgacaagctc

SEQ ID NO: 23293 - DNA, 601 bp, Human
gtgatgaacttctccccactcagaagatgaaactgaggctcagggaagctaagccctttgccaggctaggaaggtcaagggccagggctcccctgtctccctctatgccagaagggctggtcgctggggaaaggtgaaaagaaaggttctgtgaccgggcacggtggctcacgcctataatcccagcactttgggaggccgaggcaggcggatcacctgaggtcaggagttcaagaccagcctggccaacatgacaaaatcccgtctctactaaaaatacaaaaattagctgggcgagccrggcgcgctggctcgcgtctgtaatcccagcactttgggaggctgaggcgggtggatcatgaggtcaggagatcgagaccatcctggctaacacattgaaacctcgtctctaccataaatacaaaaagaaattagccgggtgtggcgtggtggcaggcgcctgtagtcccagctactcgggaggctgaggcaggagaatggcgtgaacctgggggtgaagcttgcagtgagccgagatcacgccactgcactccagcctgggcgggcgacagagcaagactctgtctcggaaaaaaaaaaa

SEQ ID NO: 23294 - DNA, 601 bp, Human
tcaagggccagggctcccctgtctccctctatgccagaagggctggtcgctggggaaaggtgaaaagaaaggttctgtgaccgggcacggtggctcacgcctataatcccagcactttgggaggccgaggcaggcggatcacctgaggtcaggagttcaagaccagcctggccaacatgacaaaatcccgtctctactaaaaatacaaaaattagctgggcgagccgggcgcgctggctcgcgtctgtaatcccagcactttgggaggctgaggcgggtggatcatgaggtcaggagatcragaccatcctggctaacacattgaaacctcgtctctaccataaatacaaaaagaaattagccgggtgtggcgtggtggcaggcgcctgtagtcccagctactcgggaggctgaggcaggagaatggcgtgaacctgggggtgaagcttgcagtgagccgagatcacgccactgcactccagcctgggcgggcgacagagcaagactctgtctcggaaaaaaaaaaaaaaaatagctgggcgtgatggcggctgcctataatcccagctactcgggaggttgaggggtggaggttgcagtg

SEQ ID NO: 23295 - DNA, 601 bp, Human
catggtgaaaccccgtctctactaaaaatagaaaaattagccgggcgtggtggcacgtgcctatagtcccagctactcaggaggctgaggcaggagaatcacttgaacccgggaggtggaggatgcagtgagccgagatcgcatcactgcagtccagcctgggtgacagagtgagactccacctctaaaaaaaaaaaaaaaagtcccctgatcttatcccacttctcctcctacagatacaaactggactctcaggacaaaacgacaccagccaaaccagcagcccctcagcatccagcarcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcagtggggtcctgc

SEQ ID NO: 23296 - DNA, 601 bp, Human
gtgaaaccccgtctctactaaaaatagaaaaattagccgggcgtggtggcacgtgcctatagtcccagctactcaggaggctgaggcaggagaatcacttgaacccgggaggtggaggatgcagtgagccgagatcgcatcactgcagtccagcctgggtgacagagtgagactccacctctaaaaaaaaaaaaaaaagtcccctgatcttatcccacttctcctcctacagatacaaactggactctcaggacaaaacgacaccagccaaaccagcagcccctcagcatccagcagcatragcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcagtggggtcctgcttgt

SEQ ID NO: 23297 - DNA, 601 bp, Human
ctggccgtgcaaaattttgaaacgtccctcggcaaaaaaaataaaaataaaaaaaaaaaatctgtccctggcctcttccctagttctgggtccagttgcagccaagtgaggggcagcgcgcgctcccaagtccccgtttcagagacgcgcacgcgcctggcgcccaacccccaatcccctgctgctcagtgaccccgcccacgggtttccgggccggcgtagctatttcaaggcgcgcgcctcgtggtggactcaccgctagcccgcagcgctcggcttcctggtaattcttcacctcttytctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgggtcgtcctttctgcccttgagcccctaacgcagcgccacgccaactaccgcttccccccaggcagacgcttgtgggtggccag

SEQ ID NO: 23298 - DNA, 601 bp, Human
ctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgggtcgtcctttctgcccttgagcccctaacgcagcgccacgccaactaccgcttccccccaggcagacgcttgtgggtrgccagagcatcttgactggattcggggacccttggggaccttcttccccgccaggctcgcgaagttaaagttcatctgctgagaacttctaactccacactttcttggttatcttggggactcaacactttgatcaagaacttttttattcctcccgcttaattttgtttgctttgagagagacttgggaactgcaatcgtttggttctccagtccgatctggtagcgttatttttaaaatttatttttattttttattactattttactagtgaagatagatgagctcagagactctcg

SEQ ID NO: 23299 - DNA, 601 bp, Human
cgtttctggaagcctgtaattttcaacattccccatttctccttttgttcagtggaaaaatttcttcagtgttgggatgctctggaaaggtactgtagttttgggggtctccctgcctgctgggctgcatagcatatctctcttttttgagacaaggtctcactgtgttgcccaggttggaatgcagttgtgcaatcatagctcactgcagcctccaactcctgggctcaagcaatccttccacctcagcttcagccgctcaaatagctgggactacaggcaatgcaccaccataaccagmgaatttttaaaaattatttttgtagagacagggtctcactatgttgcccaaactagtcttgaagttctgacctcagccccgcaaagtgctaggattacaggcgtgagccactgcttctgcttgcattatctcaaatttttagagcctaacttcacagtcttgcctcggagcaggaactgtttgaggcaacaagatggagcctctggtttcttcactaggcagactgtgctcaaactgggtagcatgaaaggaaagcagcacaattataattgaaattgggggattctttcccctattgaa

SEQ ID NO: 23300 - DNA, 601 bp, Human
ctgggactacaggcaatgcaccaccataaccagcgaatttttaaaaattatttttgtagagacagggtctcactatgttgcccaaactagtcttgaagttctgacctcagccccgcaaagtgctaggattacaggcgtgagccactgcttctgcttgcattatctcaaatttttagagcctaacttcacagtcttgcctcggagcaggaactgtttgaggcaacaagatggagcctctggtttcttcactaggcagactgtgctcaaactgggtagcatgaaaggaaagcagcacaattawaattgaaattgggggattctttcccctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggttagttttgttggaagttggatttacattttcaatgatttgatatctgaaaactcttctgattagtagaccctca

SEQ ID NO: 23301 - DNA, 601 bp, Human
aaaaccttactggaaaaataaattgaccaacattattgagagtattttttcaaagtgttccaaaagtaatggaccaatgattactttaaatgaaatcatgtaatggaccacagaattgcaaattactaataaagaaaagccattttgcttattgccatgtaataacatgttgcatgatacaagtagatacgtatgtttatgctgcaacaagtataggtgatactaattgggcaacttttaaacaagaccataaataactgaaatcaaagttcttagtatttatgcagcctgttggtttgcragggctgccataacaaagtaccacagactgggtggcttaaggaaggttgttttttcacagttttggaggctagaagtccaagattgaggtgttgtcaggtttggtttcttccaaggccacactccttggcttgcagatgtctgcttgcttactgggctcctaaacagtcttttctgattgtcctaatgtcctcttcttataagggcatcagtcatattggattggggcccacccatatgacctaattttaccttaatgacctctttaaagctctgtctccaaatacagtcatatggctgt

SEQ ID NO: 23302 - DNA, 601 bp, Human
catagttgaatgtttatggaagtcttagatagtgagtcactctgaaaccacagactcttttttaatagtaataatatggtgagttctataattcctagcatctagcacacaggtatgataaatgttttaattaagtgaataatcagcttcctgaatttttctactttgtaaatatgctctttgtgtgttgaatctatttacatatatatccaagcatttggcacaaggtaaaccaatgtggctcagattttaatgttattgtgaatcacttggggatcttgtttaaaaaaaaaaaaaaaaaggagattctgattcaggtgatctgggctgagtacttacagtatgcatttctaataaacttctgggtgttgctactgatattggttcaagaactaaattctgagtaacaagtataaaccgaatgtccataaagtataatttcttttagtatcatatggttataatgcttgcattttgtatatatgttgcatacaggttttgcttttctcttttttcttattaaaaaggttataaaggtacactgtagaaactgtagggagtaggggaaagcttggcatctcatgccaccattcagaggtaa

SEQ ID NO: 23303 - DNA, 601 bp, Human
ggtaaccacctgaggggttcttcctgcctgctgcataaagaaaaaccatggcaatatagtagagaaagagcttaagagacactaggctggccatgccacgtgggggatggagttcatattcaaattatcttgtccaaagctcataggtaggggtttttcaaaggcagcttgggggaaggggtgggggtggccaggtaacagatgcttgctgctgattggttggggtgggtgaaatcacagggagttgaagctgtcctcctgtgggctgaattgcttctaggtggggccataggagtggggytgctgggtccaggtagaaccacgggtgtcagacatgcaaaaataaaataaaataaaataagataaggtaagataaaataaaataaaataaaataataaataaaataaatataaaatttccctgaaaagatatttcaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagct

SEQ ID NO: 23304 - DNA, 601 bp, Human
aaagctcataggtaggggtttttcaaaggcagcttgggggaaggggtgggggtggccaggtaacagatgcttgctgctgattggttggggtgggtgaaatcacagggagttgaagctgtcctcctgtgggctgaattgcttctaggtggggccataggagtggggttgctgggtccaggtagaaccacgggtgtcagacatgcaaaaataaaataaaataaaataagataaggtaagataaaataaaataaaataaaataataaataaaataaatataaaatttccctgaaaagatatttyaaaaagccagtcttagattctacaataatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttag

SEQ ID NO: 23305 - DNA, 601 bp, Human
ctgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaatttgccacctaaaaaaaaatctcaaaatcctctctatgctttgatgtccagcaaaaaaaaaaaaaaaaaaaaaaaagttatcagtatagctctattactctcaaccagaggtggcatttttcatctttacccataagccccatggtatatttcttagtttgggaaattatatcataatactttgaatctgtctagtcagaaatttagataatttaaaaaaaaattatttttctgaaagtatagctggatctagcttaggatctacatctatctaatatagttccttaacatttgttaaatggccacggataagtcctgtaatgccatactttgctttaggatcatgtgactaaggggtaaggaattggaaagcaatggggagctagcagaatttgaaaaattatatag

SEQ ID NO: 23306 - DNA, 601 bp, Human
ggtaaggaattggaaagcaatggggagctagcagaatttgaaaaattatataggtaggttatttttccttaatacattgaaatagcctcaaattctcagagaatacaatgtttaatcctctaatatctgtagagttcatggctcaaatttgtattatttgaataaactactaatagattaataattactcaactaaaacactttgaaatgtgagagttcccttatctccctcgcaggcatatgacagaggtgtggcttctcacacctttggttgcccttgccctaccacccaaacccctakggggagcatgcagaggggcaggtgcagaggccatggggggtgcttttgggctctggccccacagcagtgtctaggagtggatgttggagactcctgaagcccaagtgggcatgtgttacagtgtgctctttcagcttagccgtctgcagatggcttgtgttaatcaggtcattagaccccatgccttattgcaagggcaggggtccaatgtgacagcctaagttcttgctcagtgtaccagaagaattggatcacacgtgggctggaaggatgagcacaaggttttattgagtggtggag

SEQ ID NO: 23307 - DNA, 601 bp, Human
aaaaggcaccttttttggtgtgaaaacagaaatgcctgtcttctcttagggccttaggtcttcaggcttgagggtggggcctttgctgagggaccaccctcttctacccagtatttccctgtctcctgtccatatcaacattactaactttttcatctgcagactaataatgctaaggtgtggcatttttcaactgtgagactatgtgaaggtttttcctgtccaactgatggcatcctcccataattctacccctttcttaaaagaatcttttgcagtatttctccaagtttattctagrgaatttcttgtctgtgaaatgctctagttaatcaaaattggaaaacggagcatatcatatccccttctcaaattcaccaaagtgaagtcctaatgtgtcttaatgtatctgcatgagacaggaagctgagatctattcaacaacaaaaatccaaacaagcatcaagaggaggagtgttagcacttgagcctagggagactgtggctcctgcctgaaagatgggagcctcagtcacagctgctttaccaagtgtcatatgctatgtttctgaggactcctgctaaagctcccttctccctc

SEQ ID NO: 23308 - DNA, 601 bp, Human
ctgctttaccaagtgtcatatgctatgtttctgaggactcctgctaaagctcccttctccctccagccaaccacttttgttttagacaagggctgggtttatgaaggactgttttcatgactaaagctttatagaaggtttaagataaggagatggaattgagtgaagtaggaaatatgaaagcagatattataatctggcttcctgatttttcactagcatttttgtttataaattagttctgttctaagaatccaatgacgtaatagaaactctcaaagattcttaacttgagatatarggagtctttgaaactgctgaaattacagacagcatttattgtttatgagcatttctgaatctagagctttcactagatttgtaaagaatgtgggccaaaagattaagagccaatcctgtatcttgtactcaaaatgtttgtaattctcacctttttatcccccagactcctcttgctctctcttcattttcacagtgttactggaaaggggtcctgatccagaccccaagagagggctcttggatcttgtgcaagaaagaatttagggcgagtcctcaatgcaaagtgaaagcaagttta

SEQ ID NO: 23309 - DNA, 601 bp, Human
ttttcacagtgttactggaaaggggtcctgatccagaccccaagagagggctcttggatcttgtgcaagaaagaatttagggcgagtcctcaatgcaaagtgaaagcaagtttattaagaaagtaaaggaataaaagaatggctactccatagacagagcagccctgagggcagctggttgtccatttttatggttatttcttgattgtatgctaaacaagggatggattattcatgcctcccctttttagaccatagagggtaacttcctgacattgtcatggcattcttttttttttttgacagagtctcactgtgttgtccaggctggagtgcggtaaagcaatcttggctcactgcaacctctgcctcctgggtttaaatgattctcctgcctcagcctcccaagtagctgggattacaggcatgacccaccatgcccagccaatttttgtatttttagttgaaacagggttttgccatgttggccaggctggtcttgaactcctgacttcaggtgatctgcctaccttggcctcccaaagtgctgcaattacagatgtgagccaccaaacctggcctgtcatggcattcttaaact

SEQ ID NO: 23310 - DNA, 601 bp, Human
agggtgcagagagcttccagatagctgaacaagtggaagttcctggagggtggcgtgttcagggagggcatggaagctgtgtgccccttcccccataccttgccctactcatttcttcatctgtttcatttgtagtatcttttataataaaccactaaacattagttagtatttctctgagttctgtgagtcactctagcaaattaattgaacccaaggagggtgtcataggatccccacattatagctggttggccagaagcacaggtaaacaacctagggctttcaattggcatgagargtagggggcagttttgtgggacggagccctcagcctgtgagatctgatgccatctctaagtacacagtgtcaaaactggattggaggacacccagctagtattcactgtgaaattggttgcttgcttgatttgtggggaaaaacccacatgcatttgatcacagaagtcttttgtgttgacagttgatagtgttcagtgagagaattaaaaaaaaattgagtttcttcttcaacatactctctcaatgtgaaaccacagaaactatttccattcaaagatggaaatggtttgtttgcatc

SEQ ID NO: 23311 - DNA, 601 bp, Human
ttgaatcactcataaaacaggtgctctgggtctgaatctagatcctagctagtctggtagctgaaatcatagaattatagtagagtttaggaaatcatcctcaaaggaaagattatatgttgatatcaaatgtatatttcctttctaggcccaaacctgcaccactgactgctgaaatacagcaaaagattttgcatttgccaacatcttgggactggagaaatgttcatggtatcaattttgtcagtcctgttcgaaaccaaggtaaaaaaataagcctaagttttttgttaatttgttyggaactatttattgaacagttgctctgtgtgatggatttcggggatacctagatggaatgggcatgatcccctttttacagaaatagaaaataggtggcctatgaattattctttccttttatatccatgacaaactttggtaaaaaattttcttttctactgagcttagcatttattcagtactcttctcaatatattttccaggtagctagtgacaatcagagtgatatgtaagacaaactcatttgtcctcctagtaggaaagattctagtagaagcaaagaattgtgtaccattct

SEQ ID NO: 23312 - DNA, 601 bp, Human
ctttctaggcccaaacctgcaccactgactgctgaaatacagcaaaagattttgcatttgccaacatcttgggactggagaaatgttcatggtatcaattttgtcagtcctgttcgaaaccaaggtaaaaaaataagcctaagttttttgttaatttgttcggaactatttattgaacagttgctctgtgtgatggatttcggggatacctagatggaatgggcatgatcccctttttacagaaatagaaaataggtggcctatgaattattctttccttttatatccatgacaaactttrgtaaaaaattttcttttctactgagcttagcatttattcagtactcttctcaatatattttccaggtagctagtgacaatcagagtgatatgtaagacaaactcatttgtcctcctagtaggaaagattctagtagaagcaaagaattgtgtaccattctgcaagtggtttgttggaatctttctttgatacctgttcctgtattcccccacccccattaatttagtcattaattactacatgaacccgtaaaataaatccttaaattattttcctggtagattttttgagctgtgtaag

SEQ ID NO: 23313 - DNA, 601 bp, Human
tgttctgaatgttgagagccccaagtgggtcttataacagccagtcagcaacatttctgtttttcatctgacaccaagggtctcgtctctttgcttttctaccagttattctgggctcttcagctctaaagaaagtataggtcctgaaatctttccctaccttctcaatttcctggggagggcttctttggaaagtgggattggaaataagataaatttgaagataattgagaaatgaatggaaagtgaaattgaagggtccatgttaagagattgcaagttatgctatcaccaaatagaytttttgtgcctgagaggattaattcatagtgcatattatgtgttgactttatcattgaggtcctggcacatgatagcattggcatgatataatttgagctactgatactatagtgttgcttctggtgttgttaccagaacatctaaaatatattaggatttttttaatggcagaggaaatgaagactaatatgacatagtccttgtcctagtgatttacagtttagcaagacatacaagcaaaacattaaagtaaagcatgataactactttaataaagcattttttaaattcattggta

SEQ ID NO: 23314 - DNA, 601 bp, Human
atttattaatactttgaggtatgagagggaagagaagcttagaaatacggcagaatgggctttctttgttcttctcccagctatgctgtttttatttattattgtatttttaagagagaagggaagtgtctctcctgggtcacattaattaggaaatacagagtgttttcataatgcgtaaagtctagtccatttaagtcttgtttcaaaatgctatttatattatttgagcaggaaggcagagaccttaaactgctccacccaattcattttacacaaaagattaaaaagaaaaaaacartgtcaaaaggtcaagtgcccagtgttgcacaactaatgataggcaaaacaagagaggaggggaaaaaaaagaatcctgactcccgactcctagttcagtgtgttcttcactgttagaaggtgctgctgaacatagttataccatatgaagatcacactatctatttgagattgtagaaatttgattactgcagagctctggctgggctagattcacttcttattctttattgcattgcagtattcttaagagataaatggctcttttagaatcagattggccttggctgttgaaatgagg

SEQ ID NO: 23315 - DNA, 601 bp, Human
tgaggtatgagagggaagagaagcttagaaatacggcagaatgggctttctttgttcttctcccagctatgctgtttttatttattattgtatttttaagagagaagggaagtgtctctcctgggtcacattaattaggaaatacagagtgttttcataatgcgtaaagtctagtccatttaagtcttgtttcaaaatgctatttatattatttgagcaggaaggcagagaccttaaactgctccacccaattcattttacacaaaagattaaaaagaaaaaaacagtgtcaaaaggtcargtgcccagtgttgcacaactaatgataggcaaaacaagagaggaggggaaaaaaaagaatcctgactcccgactcctagttcagtgtgttcttcactgttagaaggtgctgctgaacatagttataccatatgaagatcacactatctatttgagattgtagaaatttgattactgcagagctctggctgggctagattcacttcttattctttattgcattgcagtattcttaagagataaatggctcttttagaatcagattggccttggctgttgaaatgaggcattaattaccttg

SEQ ID NO: 23316 - DNA, 601 bp, Human
gaagatcacactatctatttgagattgtagaaatttgattactgcagagctctggctgggctagattcacttcttattctttattgcattgcagtattcttaagagataaatggctcttttagaatcagattggccttggctgttgaaatgaggcattaattaccttggtagctgacacattcttacaggtcaggggcttgatgaagtttatcttcttcccttgttcctgtgattgctctgtaaatagaacacattcagagcccttgaatgcacttgcagcctgtgcctcccacagtgatygatggtcagataatgggagtttaatgaccagtactgagagagattatttccatggctgctatgggccaagaaagctgggtggtcagaaagggaccttttccagactctcctgggttgtgttatttctttgacattggtttcctttcatgaggcgccaaggtgtatttgtaagttgtccagtgttgcacagctaatgaggggcaaaacaagaaaggaggaaaaaaaaagtatcctcactcctagttcagtgtgttcttcactgttggaaggtactgctgaacacagttatatgttcagtgt

SEQ ID NO: 23317 - DNA, 601 bp, Human
ccagtactgagagagattatttccatggctgctatgggccaagaaagctgggtggtcagaaagggaccttttccagactctcctgggttgtgttatttctttgacattggtttcctttcatgaggcgccaaggtgtatttgtaagttgtccagtgttgcacagctaatgaggggcaaaacaagaaaggaggaaaaaaaaagtatcctcactcctagttcagtgtgttcttcactgttggaaggtactgctgaacacagttatatgttcagtgtacaatgtacaatgttctttgacattccrtcatttgaaggatgggtcctatggatagtatcatctgcatggttttgaaaacaaaagatataagctaattttgccctgtctagtgactacgagacagggagagaaaatctgaatatttgttaaagtagacacagacccataaattgaaaaggacactaatcctgccttaggagacagtaaggcacttgtccctgctatctattagctgtgtgtccttggacagctcattgcttctttctgagccaccgttacacgttatctatcaagtgagcaggttgtacactagatgaattcacagga

SEQ ID NO: 23318 - DNA, 601 bp, Human
gtcatttgaaggatgggtcctatggatagtatcatctgcatggttttgaaaacaaaagatataagctaattttgccctgtctagtgactacgagacagggagagaaaatctgaatatttgttaaagtagacacagacccataaattgaaaaggacactaatcctgccttaggagacagtaaggcacttgtccctgctatctattagctgtgtgtccttggacagctcattgcttctttctgagccaccgttacacgttatctatcaagtgagcaggttgtacactagatgaattcacaggwccttcttccaagtgcttttctaatcttcataatttagataatctctcagtagcaaaacagtgtacaatatggtcaatctgagatttttagggggagaattttagggaacatcagaaatggcagtagttaaaaggaaataggactcacaggctgacttctctctataacttcacatggtagaagggatgagagttctctctggagccttttgtattaggtcactaatcccaaaggccccacctcctaagaccatcacttttgggattggggttttaacatgattttagagggacataaacc

SEQ ID NO: 23319 - DNA, 601 bp, Human
caagtgagcaggttgtacactagatgaattcacaggaccttcttccaagtgcttttctaatcttcataatttagataatctctcagtagcaaaacagtgtacaatatggtcaatctgagatttttagggggagaattttagggaacatcagaaatggcagtagttaaaaggaaataggactcacaggctgacttctctctataacttcacatggtagaagggatgagagttctctctggagccttttgtattaggtcactaatcccaaaggccccacctcctaagaccatcacttttgggwttggggttttaacatgattttagagggacataaaccttcatctcattgcattagagatatttgaaagctcagctcacgtgtattcctccacagctcacatgtattcctccatcacccaacctgatggctttgaacgttgtagacataaatcctttcatcattatcaagaatattgccaaaagcttctcagaaattatgaggggtttttttagtttctaaaatattctcaaagaaagtcccatgtactaatgtttgccttttgatgaaaaaggatggaatcttaatgattgccttaataag

SEQ ID NO: 23320 - DNA, 601 bp, Human
ctcatggaatttactgtaccatccagcaaaatgtcaatagttactatatattgagtgagctctgcttgttacatatattgcctaacaatgctcaaaactctgagaagtagtaagtataatccctatttatgggcggggaacaggaactaagaaatttttctaataatttgaaggtctcacagcttttagcattggagtttcacttctaatcatcgtctccaaaacccaacttttattaaaactatactaacactggtttctctctgggagaattttaaaattctgtacttagggctgggcrcagtggcttatgcctataaccctatcactttgggaggctgagatgggtgaatctcttgagtcctagagtttgagaccagcctgggcaacacggcgaaaccccttctctattaaaaatacaaaaaattagctgggcgtggtggtgtgtgcttgtagtcccagctattcaggaggcggaggtgtaagaatcacctgagcccaggaggtcaaggctgcagtgagccgatatcatgccactgcactccagcctgggcaaacggagtgaggccctgttatgaaaaaaaaaaaatctgtacttagg

SEQ ID NO: 23321 - DNA, 601 bp, Human
tggaatttactgtaccatccagcaaaatgtcaatagttactatatattgagtgagctctgcttgttacatatattgcctaacaatgctcaaaactctgagaagtagtaagtataatccctatttatgggcggggaacaggaactaagaaatttttctaataatttgaaggtctcacagcttttagcattggagtttcacttctaatcatcgtctccaaaacccaacttttattaaaactatactaacactggtttctctctgggagaattttaaaattctgtacttagggctgggcacagkggcttatgcctataaccctatcactttgggaggctgagatgggtgaatctcttgagtcctagagtttgagaccagcctgggcaacacggcgaaaccccttctctattaaaaatacaaaaaattagctgggcgtggtggtgtgtgcttgtagtcccagctattcaggaggcggaggtgtaagaatcacctgagcccaggaggtcaaggctgcagtgagccgatatcatgccactgcactccagcctgggcaaacggagtgaggccctgttatgaaaaaaaaaaaatctgtacttaggcttt

SEQ ID NO: 23322 - DNA, 601 bp, Human
tactgcttatttttattttatacactgtttttatatgctgtttctgtgtattgcccagcttggcagaatatataaaactcaacagtgaagaacactgcctggcagttccctttctaggagatgactgcagtgagaatggtttctccatttatttctgtggttgaagaaatcttttattcttctactagacgtgatcaaaagaaacatttgtggtaacagcacctaaagatggggtgtatgaaaactgttgggagagtactgctgagctgccgcgtggtcttgagcatgacacagtaatacyggtcctggacttaatacaatgccctgcacaactctcacctctaggaaaattatctgaaaggaaaaataactttattctaaggaaaacctagaacctcacaagaaaaattttaaatttttggtccgtgttaatatgcatcagatttgtatcaaaatgataggggtggccctctgacacggaagtgggcaaaatggagacattttttctagactgagctatttctacactggaagaaaacttgtattccaagactactaagtgtgttaataaggagtagtcacataaaatttttgtctaaat

SEQ ID NO: 23323 - DNA, 601 bp, Human
aaaccttgagtgcctgcacagcaaacagaggatcagggttggcatcaggggaaggtagtgcaacctggcatctagttccttttaatttcactagaaaaagaaagcttcagaaaagcttatattaaaatagaaaattgtttcatttacggttttgtcatttaaaaaatatacctttcaaatctttatccaaatttggtagataagtcaataattttaaatttcactgaaattatatcgtttctaaaagagttggtcttattttttagggataaagcgtaccttactaatctctcacaggtcrcagttaatttcttaggtataaatctacatccttggaatgtatgtctttactcctagtatttagttctgtcatgcacacagaatggctaatggctgtgtagaaaggagttaacacaatagactgccacccgtagatgcgcctgttttcaaagttggagcctggctggtatctgagaagttgaatttctcaccccttcctaactgataagggtagcatctataattaactggttgtacaaagtgtggggtttctgtatacctgctttctttacaagaccggaagtttggtgtgtgctataca

SEQ ID NO: 23324 - DNA, 601 bp, Human
attaggagtgtgtatgcagtgactcatgcctgtaatcccagcactttggtaggccaaggcaggtggatcccttgagctccggagtttgagcctgggtaacataggaaatcccatctctaccaaaaatacaaaaacttaaccaggcattatcatgcctgtctgtggtcctagctatttgggaggccaaggtgggaggatcacttgagcccaaggtaaagaaggtgggggtgggggcagattttgtagtgagccaagattgtcccacttcacaccagcctgggtgacagagtgagactctgtytcaaataataataactatttataagttgagtcttgttaatttttctaacaaatgactgaatctgaggttgttgttgggaaactccatgctagtgattaaccagtaactgcctgggactgaagaggtccagggatacccaatctttattactaaccaggaaagacttcagcaaattgggatgggtttatcaccccacatatagaaccaacccaagacacgaggataatgtgatttttgtgaaggtcagtgctggtgcctgaactactgatagggatgtgctgggaagggaagagcgtggtc

SEQ ID NO: 23325 - DNA, 601 bp, Human
aatgaaatacctccagatttcttctttttgcttagtattgccttggctattgaggcccttttgtggttccatatgaattgggaatatggccatttttatactattgattctttctatccataagcatgggatgtgtttccatttgtttatgtatcatttctttttagtagtgttttgtatttttttgtagagatctttcatctctttggttaagcatattcttagggattttatttgcagctgttgtaaatggaattcttaatttgactctcaacatggttgttgttggtgaatagcagtrctactaatttctgtaaacggattttgtaacctgagactttactgaatttgtttgtcggaggagctttttggatgaggctttggggttttgtaggtatatgatcatattactggcaaacagcaatactttggcttatccttttccaatttggattccctttattttttttaccttgcctgattactctggctaggacttccagtactatgtttaatagaagtggtaaaaattgggcatccttgtcttattccagttttcaggggaatgctttcaatttttctccattcagtatgatgttgg

SEQ ID NO: 23326 - DNA, 601 bp, Human
ttatgtatcatttctttttagtagtgttttgtatttttttgtagagatctttcatctctttggttaagcatattcttagggattttatttgcagctgttgtaaatggaattcttaatttgactctcaacatggttgttgttggtgaatagcagtgctactaatttctgtaaacggattttgtaacctgagactttactgaatttgtttgtcggaggagctttttggatgaggctttggggttttgtaggtatatgatcatattactggcaaacagcaatactttggcttatccttttccartttggattccctttattttttttaccttgcctgattactctggctaggacttccagtactatgtttaatagaagtggtaaaaattgggcatccttgtcttattccagttttcaggggaatgctttcaatttttctccattcagtatgatgttggctatggatttgttatatatgcattttatgcctagtttgttgagggtttttatcataaatggatgttggattttattaattgcttttttgcatctattgaaatgatcctatggttttggtttttaattctctttgtgtggtatatca

SEQ ID NO: 23327 - DNA, 601 bp, Human
aataatttaggcaggattccctctttctctgtatttttgaatagtttcagtaggattggtaccagttcttctttgaacatctcctgtggagatagcaactttggctttcaagctattcccctccccatccaccttcaaggccaggtgccagccttctgcatttgtctgcagcacacttcctgctttcccccggggttctggccaagggggctcattcccacttgagataatattaatatcatgaaattcagttaggagcttctttcgatctgtgacatgtggctgaactccccaagttcargttggctgactttgctgatgtcccctgtgagataaaataagaaatggcttccctcagtccatgctggagactggtaatacctttgtgacacttgtcactgccgcttctactttatttctcacctctccctaaatcagctttgggcctgggtagggttaaggccttacccatggcctgaattctcagattccctggtggggaagagtattctggaggcagtttctccccttctcacactctgggcacttacagtttttcatctgtctcacagtgttggctgtagcctgccacttctttcaa

SEQ ID NO: 23328 - DNA, 601 bp, Human
gtttagatgtctgaatgctttttgtcatctctgttttcatagttcttgagcaggtactaaaaattaactggaaacaatgaaagtcatccaggttagggagaggaagttacccgtttatgagagttgcttgagagataagctgaaaggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacayttatttgcagctggaaatgggggaatgggctaactggctaaactactatcttgtccatcctgccttcacttcagtccttccacattgttatttggtgtttggactgtgctagaagaactgttttatacaggctgctattcaataaatttgtaaataccatacccacaccaaaggatttaacactgaaaagattaaggtaattttggaaaattctaaaagtcacttttcactcctgagatgtaggtggtcagaagaaatgaggaacactgtagaagccatatgcaagatgcacagatggca

SEQ ID NO: 23329 - DNA, 601 bp, Human
gaagttacccgtttatgagagttgcttgagagataagctgaaaggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacacttatttgcagctggaaatgggggaatgggctaactggctaaactactatcttgtccatcctgccttcacttcagtccttccacattgttatttggtgtttgractgtgctagaagaactgttttatacaggctgctattcaataaatttgtaaataccatacccacaccaaaggatttaacactgaaaagattaaggtaattttggaaaattctaaaagtcacttttcactcctgagatgtaggtggtcagaagaaatgaggaacactgtagaagccatatgcaagatgcacagatggcattgtgtttgttgtggactgttgatgttaacaggatggaagaagtcaaaactgaactttataaaatagggtataagaaaataaagatgtccctgtacttacag

SEQ ID NO: 23330 - DNA, 601 bp, Human
aggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacacttatttgcagctggaaatgggggaatgggctaactggctaaactactatcttgtccatcctgccttcacttcagtccttccacattgttatttggtgtttggactgtgctagaagaactgttttatacaggctgctattcaatraatttgtaaataccatacccacaccaaaggatttaacactgaaaagattaaggtaattttggaaaattctaaaagtcacttttcactcctgagatgtaggtggtcagaagaaatgaggaacactgtagaagccatatgcaagatgcacagatggcattgtgtttgttgtggactgttgatgttaacaggatggaagaagtcaaaactgaactttataaaatagggtataagaaaataaagatgtccctgtacttacaggtgctaagaaactagacttgaagaacttgtctctctcagaaa

SEQ ID NO: 23331 - DNA, 601 bp, Human
aagcataaaaaagaaagcatttcattttgggacacttatttgcagctggaaatgggggaatgggctaactggctaaactactatcttgtccatcctgccttcacttcagtccttccacattgttatttggtgtttggactgtgctagaagaactgttttatacaggctgctattcaataaatttgtaaataccatacccacaccaaaggatttaacactgaaaagattaaggtaattttggaaaattctaaaagtcacttttcactcctgagatgtaggtggtcagaagaaatgaggaacwctgtagaagccatatgcaagatgcacagatggcattgtgtttgttgtggactgttgatgttaacaggatggaagaagtcaaaactgaactttataaaatagggtataagaaaataaagatgtccctgtacttacaggtgctaagaaactagacttgaagaacttgtctctctcagaaattgagaaattgttagcaatggttgaactaagctcatcaactccttggcatttgcagcctacctgtgcaatcataggacatgaaataaaggaaggacttgagaaactccatgatgtgataatg

SEQ ID NO: 23332 - DNA, 601 bp, Human
gtaatgcttgaaatggtctcttctccctagcccacaaatattttggtactatcattttgggaagtcaagcaagtatagtaaattaaccagaacacaattgtggaaatttgatgcaaagttagtgaaataaaactttaaagagtgaaaaaaagaaagttaactatttatggagataactagttatggtggatgaaatcaacactgaggaaaatttagcagaacattgagctgaccttttgactgtccacatcttattctgatgcactgctttgctttctgtcatcaaatcaactgtttagawgcatttattctgcgtatggttctgttctcttactcttttactacttagagtcaatgagtacaggtctacagttgaaacatgtatttaaaatttatgtatttggtaatataatacaaaatcatgattttcaattaaaaaggaattaatgtggttttaatattagttttactcaatttttattatgacaactttcaaattttagagaaatttgaagggataatacaggacatctacatgttatcatctatttccaaaattgttgacactttgccaacctggcaagtatataggcatatatga

SEQ ID NO: 23333 - DNA, 601 bp, Human
ttttattcattgttggtttttgatgctcaaatctatgcaaatgttactgggattcctataaaactacttttctcttttaaacctgcccttatgagtctttaaagaaattcttacattctggcacaatttgatgttcaaagctcagaatcttaacctatcccaagtctagaattggccatgtgcacttctagtggtcaaaggttgttagaaactggctctggttcatagagttgctaatgctcagaaataacatttctatatatacttttagaccagcaatataaactgtatttttataaamtgattgttacttgacagtaatattctgttcaaatttaatgttatactttattcagcttattttaatctttatattaacatatctgttttgaattatctgatgcttttctctcttgatcatctaaaggtagaatgtcatccttacctcaaccagagcaaactgctggatttctgcaagtcaaaagacattgttctggttgcccacagtgctctgggaacccaacgacataaactatggtaataagagcatcaggaagtttacctaaaatgccattttgatgaaaaattttagttatagcat

SEQ ID NO: 23334 - DNA, 601 bp, Human
ttcttcattttctgaagtgaggagttgggttaggtgttctctaatcttcaaaaatcattgcagatttttcatgtccttgtttactcagtataaatttcatatatttattctcttagaattatttgttgagtgcctgttgaaatctttgggtattttattaggttgcatgtctttttctatgtgtagaagatcataattatactgagtaaacttattaaagaaaacctctcaacatagaggtttaatacaaaaccatttatttaactgacaattccatggtttgaaatttagcctaaagctycacctgaactcagtctcgtcctgtttctggctgggctttctcacgtgtgtgcagggcaatgaggcagctctacagaattaatccagaatccatattctggatattctttaacagcttcaaatgtattgttgaaatagcctctcccaaaatgtacccgtattttgattccctttatggtggttttaataagcaaaagtttctactcttaatgtagtcaaattctttatgacattttctcgtggttgctaatatcatgactttttctatattggaaacatgacaatatgttaatatattata

SEQ ID NO: 23335 - DNA, 601 bp, Human
gtttctactcttaatgtagtcaaattctttatgacattttctcgtggttgctaatatcatgactttttctatattggaaacatgacaatatgttaatatattatatagtaaaatattatgtagtaatacaaagtaatatattattgtctattaatatcttataaaagtattaatgtgcttttataaactgggatagtaatttgatttttaatatgtgaaataagagtacaaatgtacatatacataatcttcacttgatactaaaatgtcctactaagaattattgaaaagtccatatttsctcacttatcttgatttttcatcctaagtgtccataagtacttcactgacatttcccctctttcagagttaactttcctgtactgtttaagattatgttgaatagaaagtcttactaccataatagtaacagtatttttctgacttagtctatatataataatggcttggctagtcctgaatgagtgttctgttacataacattcagtaatatcaacttcaacaaaagggctaatattttgttctctggctgaaattgctgtgaaactgcagatcaatttggtgagaactgattgagact

SEQ ID NO: 23336 - DNA, 601 bp, Human
atgctgcagacaaagaggatctcaacagatactagagatgaaataaagttaaactggtgtgtacatgactggttcatgtacttataagattcggaagaatctggagaaaaattttgaaacttataatttagacagtttgatggtgatacaatttggatatttgtctccttctaatctcatgttaaaatgtgatccccagtgatggaagtggggtctggtgggaggtgtttgtgtcatgggggcaaatatagaaatatagaaatccaacaatatccatctgtattagtctgttttgtgctgytgtaaaaaaaatacttgatgctgggcaatttatacagaaaagagctatatttggctcacaatttgcaggctgtacaaaaagcatagcaccagcatctcattctggagaggcttcaggaagctttaagttccaacattaggtcattcctttgcacccatacctgatcataggctgttagaagcagtcacactatctcttgaatgttttcctgcttagaaatttcttccaccagatacccttagtcatcactaagttcagacttccacaaagtcctggaatggacacgatgcagtcaagttc

SEQ ID NO: 23337 - DNA, 601 bp, Human
taaccaatgcctaacaagttccagactaccccttatcttcccattttcttctgaaccctcctgacacttccaaactgtgctaattatccagttctaaagccactaccacattttcagacatttttagcaatgtcccactcctggtaacaattttccatattagtccattgtgcgctgctataaagtacccgaggccagataaaatatgccgaaagttgttttgacttaccattttgcagactgtacaaaaatcatggcaccagcatttagttttggtgagggctcaggaagcatttactcrtggtagaaggtgacagaggaggaaacatatcaaataacaagagatgaagagggaaaaaaagaaaatgtcaggctcctttttaaaccagatttcatgtgaactaatgcagtgaacactcattaccatggggagggcacccagccattcatgagggatgcccccagggcacaaacacctcccaccaggacccacttccatcattggggaattacattttaacatgagattaggaggggacaaatatccaaattgtatcaccatcaaactgtctaaattatacatttcaaaatttctctagat

SEQ ID NO: 23338 - DNA, 601 bp, Human
tggggaattacattttaacatgagattaggaggggacaaatatccaaattgtatcaccatcaaactgtctaaattatacatttcaaaatttctctagattcttctgaatctaagtacatgaaccaatcatgtgcacataaggtcaacttcgttccatctttagtttctgttgagatcttgtcttcagttttgtgcagtttcaatatgtaatatctaggaatagatttatattttatctgatattctttaatcacttgagagtttagagatggtctttcataacttttggaaacttatcaartattttacatattgcctctacaccctactgtgtgatatacttggctattccaagttgacaattatgcaatctaagaataaacattttctacttctttggtaggtttttgaattccagttgacatcagaggatatgaaagttctagatggtctaaacagaaattatcgatatgttgtcatggatttgtaagtaactttggaaaatgggtttcccagtttatttttagaggaggaatgtcagatgggtgttgaaagtgacctcaataccagggagacagaggccagtgcaagtgagaggtga

SEQ ID NO: 23339 - DNA, 601 bp, Human
aaaaaaaacacattataaactcatgttcatgaaagacattccacaaatagtccgaaaataaacttcttaacattcacactaatggcagcttcatataaattcactttgctaccagctttttaatagagtcatttcatccatatttatgtactatcctttctcttttcagtcttatggaccatcctgattatccattttcagatgaatattagcatagagggtgttgcacgacatctagcagaaggccctgtgtgtggatggtgatgcagaggatgtctctatgctggtgactggacacacrgcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgaca

SEQ ID NO: 23340 - DNA, 601 bp, Human
gtacaacttatggatcctttttgtttgtggtcgtgacttactgataatgtaatccaaaatacattttttattttgtatttatttatttatttttgagacggagtctcagtcttctgcccatgctggagtatagtggtgtgatattggctcactgcaccctccgcctcctggattcaagcgatgctcctgcctcagcctcctgagtagctgagactacaaacgtacgccaccatgcctggctagtttttatacaaaatacgttttttaaaaaacaattttttttttggaggtcgggggaccrtcgcccattctgttgcccaaactggagtgcagtggtgcaatcttggctcactgcaacctctgcctcccaggttcaagcgattcttgtactcagcctcctgagtagctggaattataggtgtgtgccatcatgccaagctaatttttgtatttttagtagagatgaagtttcgccatgttggcgaggctagtctcagactcctggcctcaagtgattggctgacctcagcctcccaaagtagaaaatcttcttgaaaaataaaattccaaatctcaaaaggccctatataattttggtgtt

SEQ ID NO: 23341 - DNA, 601 bp, Human
ttttttttttggaggtcgggggaccgtcgcccattctgttgcccaaactggagtgcagtggtgcaatcttggctcactgcaacctctgcctcccaggttcaagcgattcttgtactcagcctcctgagtagctggaattataggtgtgtgccatcatgccaagctaatttttgtatttttagtagagatgaagtttcgccatgttggcgaggctagtctcagactcctggcctcaagtgattggctgacctcagcctcccaaagtagaaaatcttcttgaaaaataaaattccaaatctcraaaggccctatataattttggtgttggaaatttacttgtcaatgaaaatgactatttacacaaattataagcttccatattaatatatatgtgtgtgaacctgaaattcaaattttattatattgtttatgaaaggtacagcctctgagattcatcagatggtatttacctttagggcatatctaaaaataaaatacagtacatgaaatccagtgctttaatccagtgattcttaaactttttgctctcagatcccctttaaactcttaaaagatattgaagagctccaaggaggctttg

SEQ ID NO: 23342 - DNA, 601 bp, Human
ccgcagcaaacctggaatcagccatttctcaaggagctctctgattccattgaaggaaaatataatataggtacaatctaggcactaggtgatacttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacrccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttgg

SEQ ID NO: 23343 - DNA, 601 bp, Human
cttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctgsctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttag

SEQ ID NO: 23344 - DNA, 601 bp, Human
tacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttg

SEQ ID NO: 23345 - DNA, 601 bp, Human
tgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttgttttattatacatatatgaagtatttccayggttccaaagttaaatgaacaaaacaggcatgttcaaagaagtctagtttctatctctgtcccatccaacccattgtcttcttccccttataagtaataatttacatttttaacttgtggtttatcttctgatttttaaaaatataagcataaatatttatattcctgtcttttagcatgcttttagccatcttgcttttttcctgtataatgctaaatatatctcattctttttaattgctgcagaatttctcattacataggtatactgcaatttatttatctgatgctatgttgatg

SEQ ID NO: 23346 - DNA, 601 bp, Human
caatgagaacacatggacacaggaaggggaacatcacacactggggactgttgtggggtcggggagtggggagggatagcattaggagatatacctaatgctaaatgacgagttaatggatgcagcacaccatcatggcacatgtatacatatgtaacaaacctgcacattgtgcacatgtaccctaaaacttaaagtataataataaaaaaaaaaaaagaaatagactgggtcattgaattccagctgtagccctccttcagaacagttgagcactgaagtcctgggctgaaaattgactttttttttttttttgagatggagtctagctctgtcacccaggctggagtgcagtggcacgatctctgctcactgccacctccgcctcccggtttcaagtgattctcctgcctcagcttcccaagtagctgggattacaggcgttcgccaccacacccagctaatttctgtatttttagtagagaaggggtttcactgtgttggccagactggtcttgaacttctgacctcgtgatccacctgcttcggactcccaaagtgctgggattacaagcgtgagccaccacacctggccaaaaat

SEQ ID NO: 23347 - DNA, 601 bp, Human
atacatatgtaacaaacctgcacattgtgcacatgtaccctaaaacttaaagtataataataaaaaaaaaaaaagaaatagactgggtcattgaattccagctgtagccctccttcagaacagttgagcactgaagtcctgggctgaaaattgactttttttttttttttgagatggagtctagctctgtcacccaggctggagtgcagtggcacgatctctgctcactgccacctccgcctcccggtttcaagtgattctcctgcctcagcttcccaagtagctgggattacaggcgttygccaccacacccagctaatttctgtatttttagtagagaaggggtttcactgtgttggccagactggtcttgaacttctgacctcgtgatccacctgcttcggactcccaaagtgctgggattacaagcgtgagccaccacacctggccaaaaatatgggtttctaaagcaacagtcctagtacaacagaagagaggtgttgactagttagggatttaggtttagaagtacattcttagtaagagaggtgagacttaccttcttgtgttttagtatagtgagatctggatcaaatctatt

SEQ ID NO: 23348 - DNA, 601 bp, Human
gactctaccaatgggatcggagctctccaaacctgcatattaaaaggcctataagttttggggggtccctttgtccacatgattattctgtaatacattgtatttatggacatggtattattatacacagatcctgtcttttaaagaacattataatccacttaactgctaggaccagagaatgaccgataattcaaaccatattgtcttacagaagacatatataaaagatggttatgtgtaccaattgaggttcaaatttgattcaatttaaaacaatctaggccagattttatatagwttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaattttttaataaaaaataaaagcagatcttgggtaaagacatgtagtctggtttacaggtattaacaactgtctgtaatgtagtgattttgctccagacttaccttttccattattt

SEQ ID NO: 23349 - DNA, 601 bp, Human
ccgataattcaaaccatattgtcttacagaagacatatataaaagatggttatgtgtaccaattgaggttcaaatttgattcaatttaaaacaatctaggccagattttatatagtttgtggaccctttgcactcaaatctcaaggttcttattaaaatgcagatcttggctgggcacggtggctcacacctgtaatcccagcactttgggagcccaaggcaggtagatcatttgagctcagaagttcaagaccagtctggccaacatagcgaggcccagtctcattgaaagaaaaaaaawtttttaataaaaaataaaagcagatcttgggtaaagacatgtagtctggtttacaggtattaacaactgtctgtaatgtagtgattttgctccagacttaccttttccattatttagttctgaaattactgttctatgtatggtaaatgagaaaaattgctagattctagaactgtggcttctattcatagttggaaaaatgaagcataaacatttctaatttcagatcaacagcaaaaagaaagaatcagcatgggaaatgacaaaaagtttgtatgatgcgtggtcaggatggctagt

SEQ ID NO: 23350 - DNA, 601 bp, Human
gtataaactgttcttccctccttccctcaattttttttcaggtaccattggattttaaaaagcatttgtttctcttcttcaaaaaatctccttaaatataagactaggaggcagaggcttccaagtctagtcttggctctatcactttacgtgtttatccagcttggttgatctttctggactcagtttctatatctgtaaaataagtggtttggatcagatgatcaataaagtatcttttgatattaacatcgtaataaatagctaatatttcttgagtgcttcctatgtgttgtacacygttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcag

SEQ ID NO: 23351 - DNA, 601 bp, Human
gctaatatttcttgagtgcttcctatgtgttgtacactgttctaaaaacttgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggaccygaaaacaaatattaagcactgttataatcactttcagcttccatgatggaagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaa

SEQ ID NO: 23352 - DNA, 601 bp, Human
tgacatgtatttaaacctcaccggaatcctgtggtaccagtgctgtcattatcaccattttgcagatgaggagactgaagcagaagaaaagtaacttagtttgactgaggtcatacagtttagtaaatggctaaaccaggatttgaattaaagccttctagctcaagacctatccccttcatcaccctgctatacagcgtggccacaaagtcccaatgtgtgagattttaagaaagagctgttgaggacctgaaaacaaatattaagcactgttataatcactttcagcttccatgatggwagattatgttcagaagaccataaaaattaaaatttttgtggagaataaagtactgataattctaattggcatgcatagtaattttatggcctctgtgtatgtaacccactgatctctttatgtaagaaggacccagatttgaccataaatttgtgtattttttatattctcacaataaaataatcttgatatatggttttctgtaatttaagaaaatattattcctatgagtttcaataattatttctaatggacattaaattttaatgaaattgacatcatttataagtctgttaatta

SEQ ID NO: 23353 - DNA, 601 bp, Human
ttgcagcaagaaagaattaagtgcaatattgtttcaagtagcttttttattagttaactgcatagtcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagtaaaatcaacctacgtagagatacattgaagataatcagacatttttatttgtggcattacrgcatttaaatgattgatttactatgatctacaaagaacattttagaacttaggatgttacatgtatattttttacatgatgacatggatatattttttaaattttgttttagctgaactttagagctaaaaggtatacatttgcggtaagatgagtagtatgctgtttctcacctggcttaattgaattgagtttaatgatctggaaagttgcagcagaatgaaatctgagtggtgatgcaatttgtttccactgtttccaaaaagtggtttgtaggcagagattgaagtatagctgaga

SEQ ID NO: 23354 - DNA, 601 bp, Human
tcatataacaaatcctctggattgtggtgcaaatatatttgagctgtagtagaaaagaagtgatagttattgcagtaagatctgtgtaaagttactaagaagtcaagttattaaaactaatatattactaagattgggaagtttgaattatgaaagtattatcaaataatttagtaaaatcaacctacgtagagatacattgaagataatcagacatttttatttgtggcattacagcatttaaatgattgatttactatgatctacaaagaacattttagaacttaggatgttacatgtrtattttttacatgatgacatggatatattttttaaattttgttttagctgaactttagagctaaaaggtatacatttgcggtaagatgagtagtatgctgtttctcacctggcttaattgaattgagtttaatgatctggaaagttgcagcagaatgaaatctgagtggtgatgcaatttgtttccactgtttccaaaaagtggtttgtaggcagagattgaagtatagctgagatgtgttggtaacaagactttagggattaggaaaaagattaaatgtgctcagggttccttggtata

SEQ ID NO: 23355 - DNA, 601 bp, Human
ttactgtgaaggctgattttttttttctctcaccactaatttaacacatgactaggcaaattttcagactatttagttaaacatcaagagcctggaagaagtatcttgtgacctaatgttctttgacgggttagttgttactttgctgttatgaccctgaattttttttttttgagactgagtcttgtgctgtcgcccagactggagtgcagtggcgcaatctcagctcactgcaacctctgcgtcccaggctcaagcaattcttgtgtctcagcctcctgaggagttgcgattgcaggcmcctgtcaccatgccctgctaatttttgcatttttttgtttgttttttttttttagtagagatggggtttcaccatgttggccaggctggtctcaaactcctaacctcaagtgatcacccgcctcagcctcccaaagtgctgggattacaggtgtgagccaccacacgtggctatgaccctgattttgattcattcactttttataattaccttttgattagataagttaattattcttgaatttggccattttatgctttgagaaagtagttaatcacagtgggtcaacagtacaaactt

SEQ ID NO: 23356 - DNA, 601 bp, Human
gcctgactatggagttcatgatcttaaccatttacagcttaatttttattatttataatttctcttctggaaatgtaacaattgaccatttgaagaaatactttaggtagctttggatatttgctgtattaaagtagtgaaagtaatacagacacttggctgggcgcggtggctcacgcctataatcccagcattttggtaggttgaggcaggcagatcacctaaggtcaggaattcgagaccagtgttgccaacatggtgaaaccccgtctctactaaaaatacaaaaattagccgggcrtggtggcaggcgcctgtaatcccagctactcgggaggctgaggcaggagaatcacttgaacccaggaggtggaggttgcagtgagctgagacgacgccattgcactccagcctgagagacaagagagaaactctgtctcaaaaaaaataaaggaatacagactcttagaaaaataattacaaataaaaccctagtgaaattataggtatagttaggtatagttggcttacaggtgggaagtagaccattaccaactgatagactggggagctggagagaggacacggaagagtgtccttg

SEQ ID NO: 23357 - DNA, 601 bp, Human
aaaaactgtttttgtggatacacagtagctatatatagttttggggtatatgaagtattttgatagaggcatggagtgcataataatctcagggtaaatggagtatccatcacctcaagcatttatcccttgtgttacaaacaatccaattacactcttaattatttttaagtgtacaattaaattattgaatatagttcaaagacttcttcattcatgactagcacctaggctaaaaaaattcagacacctgggctcctgggatcaatcacgcatactgtgtctcttgtgctcactcccrctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggcagtcacagaggcccgaccacattcagaggagggacatacacttgctgggacaagtgtaagagaattcatgatcatgttttaaaaccacttttattagtttcctattgctgctgtaataaattacca

SEQ ID NO: 23358 - DNA, 601 bp, Human
tacaattaaattattgaatatagttcaaagacttcttcattcatgactagcacctaggctaaaaaaattcagacacctgggctcctgggatcaatcacgcatactgtgtctcttgtgctcactcccgctgtctctctctctttctctcgcttcctttttcctctctctctgtggttttctagggtggtggcctcagggaattggatttcttatattatagctcaggattcccaagagggctgtttttaatgtagccaaagaagtcttgcagcgtgacttgttttattctattcattgaggyagtcacagaggcccgaccacattcagaggagggacatacacttgctgggacaagtgtaagagaattcatgatcatgttttaaaaccacttttattagtttcctattgctgctgtaataaattaccacaacttaatggcttaaaagccacacaaatttaatatcttacagttctgcaaatcaaaagtctgaaacggatctcactgtgctaaaattaaggtgttcgtagggcattctggaggctgtaggagagagtcttgttttttgccttttctggctattaaaagctgccagcattcctt

SEQ ID NO: 23359 - DNA, 601 bp, Human
ctgaggcaagagaatcacttaaacccaggaggtggaggttgcaatgagccaagatcacaccactgcactccagcccaggcaacagggcaagacactgtctcaaaaaataataataagaagaaaataataatagtaatagaaaagcctaaacattttacctttttttcttagggaatcaagttaaaagagctgttaaagctctttttcctacaataagtaagtgttgggtaaatcccaactttctcacagtcagttgaactacaagaagctggaggcaattggcaggcctttgttaagtccyacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtagtttgttcgtttgtttgttttttgagacaggatctcgcctttttgcccagactagagggcagtgttgcagtcttggctcactgtaacctccacctcccaggttcaagcgattctcctgcctcagcctcc

SEQ ID NO: 23360 - DNA, 601 bp, Human
gaatcaagttaaaagagctgttaaagctctttttcctacaataagtaagtgttgggtaaatcccaactttctcacagtcagttgaactacaagaagctggaggcaattggcaggcctttgttaagtcccacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtattttgttcgtttgtttgttttttgagacaggatctcgcctttttgcccagactagagggcagtgttgcagtcttggctcactgtaacctccacctcccaggttcaagcgattctcctgcctcagcctcccaagtagctgggattacaggtgtgggccatcacacccggctaatttttgtgtttttagtagagatgtgattttgccatgttggccaggctggtctggaactcctgacctcaggtgatcctttgggaggccttggcctcccagagtgctaggattataggtgtgagccactga

SEQ ID NO: 23361 - DNA, 601 bp, Human
tgtatatcagtcaaaatattgggcaactctgataagtttgtccacttaacattgtaccacttaagatgaatagcatctaccatttccgtcatttgtaaatatataggaggacataatcacataatcttgaagtaaaagacagtgcttaaaactgaatcagttaagttttatgaaaaatacttcatattgtacttttaaaaatatatattttttaatttcaatagcttttgggttacaagtggttttggttacgtggatgaattctataatggtgaagtctaagattttactgcaactgtcrcccaagtagtatatattgtatccagcatattgtccttttttttttcttttttttttttcatttcaccatggactaatgaaaattttgttagggactgacattagggcacccttgagctaccttgagctaaaggaaataacccttgaatttttttctgtttggcctagagaatgtggtttgttttgtaactgaattcatgggattgttaaggtacaagattttgctttagttttatttgtactaggattttgctatattaatacaatgtgaaaagaatcaaaagtgttagaaataaatgca

SEQ ID NO: 23362 - DNA, 601 bp, Human
gtctaagtatggtaggaatataggggaagaaagagctgaagtacttcaggaagagtagaacatgagctttatttaaaagattagcagaatttaaggaaaaggtgactttgttgaagattataatgtgaagacaaaggaacgaggatgggaataaattttgtattcatgaggctttgaagaaattgactctagagagtatattttgggtacttttgggaaatgaagttggattagtgagaaggaacagattatgaaaagacaagaaacctgattaatgtcaggatgattttatatttgaagytggtcagatttatggcagtcctggctttgccatttttagtttgatgactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaa

SEQ ID NO: 23363 - DNA, 601 bp, Human
gactttgagaaagttccttcttgaagttttaattttctgtatataaaaagtaataacacctggtgatctgctaggtttgttttgaggattatatgagataaaatgcatgcaaaactgttataatagtgcctggtaaaataagtgcctagttttaaaaacaagtctttgtaaactgcttaggacatgcctggtatagggtaggtatgtaatacatagtaggtaggatctgtctccttgctatttttaggtaaaaaaacaaaaggaagagcttcagcttaatacagtatgaactgacgagccytggtaggtttttgagcaaaagagcaacacagtaaaagtagtacttaggaaagattaacaagggaacatggcttatacagtggtaatggggcctggagtcaaggaggtaagataaaatggtattataattaaggaatagccaggcacgatggcacatgcatgtaatgccagctactggagaggctgaggtgggaggatcatgggagtccaggagtttgagaccagcctgggcaactgagtgagaccccaaatcctaaaaaatacaaagtaaaaaaggaataaagtcatgagggcttggact

SEQ ID NO: 23364 - DNA, 601 bp, Human
ctcagattaaggccatttcaacaggaatgctgagactttaaaaaaaaaaaaagtctgaggctgggcgtggtggctcatgcctgtaatcccagcactttgggaagctgaagcaggtggatcacttgaggccaggagtttgagaccagcctggccaatgtggtgaaatcccgcctctactaaaatacaaaaaaaatacatgggtgtggtgacgcatgcctataattccagctacttgggaggctgaggcaggagaatcacttgaacctgggaggtggagattgcagtaagccccaccactgcwctccagcctgggcgaagagcaaaaccctgtctcaaaaaaaaaaaaagcctgaattatatcagcaaatgaaaactgtaatgttgttctctgtttcagaggcccttgaatgaatagcactaaaaatattttttaaaaaatgaagaaaatgaaaattgtaatgttccttatttaaaaggcccttgaatgagtagcatcaaaaatatttttaaatgggaggccagggtgggaggtttgtttggcaccaggagatcaagaccagcttgggtaacatagcaagacctttgtctctaccaaaaaaaa

SEQ ID NO: 23365 - DNA, 601 bp, Human
gctttgtcacccaggctggagtgtggtggtatgatcatggctgactgcagccctgaccttccgggctcaagtgatctttccacctcagcctcccaattacttgggaccaccagcatgcttggccgattttttttttttttttttttttgtagaagcaaggtttccctatgttgccaaggctggtcttgaactttagggctcatgtgatactcctgcctcggcctcccaaagtgttaggattacaagcctgagccaccatggccggccaaaatattttcactataacaaatatcatatctgkatatactcagttttaatactaactcaaagtagaaacataaagctgaatgactattttattttcagattctctccattgagtttccttctccgtcttgtgtgatctctgaacttttctccatctttgccacttcttgtctagcattttttttttatcagcagtttcattcagattttttttttagttctttcaacggtggagtggaagtaggcagcaggacagaagaacttgaagcagagcacactggagaggagaaattaacaaagcctttatgaataaaacaaccccccaatatcagtc

SEQ ID NO: 23366 - DNA, 601 bp, Human
tgggttatgccctgttaactcttacatcattagtttttagcccaaaaggaaacagcaaataatgttttatatgagccacattttgcgttgattttccttccactctgtaaaattactaaagcagcactctgactttattatgctcaaatcgctcttctccattaatgtgtgtttctccatcttttagggtttttactttataaatacagagattactgtgtaaaattctaaatttgccactgggtcgttatacatttgtaaccttcctcacagtatattttgtgatttggcagagtttacyaatatagatgatactaactgaaattaatcattctgtataattggatagaaaagcatgagtaagaattcaattggtattatatttaattaattgccaagattttcacatttcctgactacaacaataaaatcaaatgaattgatggcttaaaaaaaagaaatctcaaatgtttagtcaatgaagaacatctattgaatgagtgaatgttcattatatatagtgcattttctgagcttttttggagggggaagttgctcccatgctctgagaacttttaaggatcgatacattatttttaac

SEQ ID NO: 23367 - DNA, 601 bp, Human
gtttatattgccacattaatttccattataaaaccagtaaccatagttttgttttaattagcaatctaattattttcatgtatcctcattatgagaatttatgtccatcactttgcttgatgtgataacagtgacatgctaaatgagaaacaattgttatttagaaaaaaatgcacaaagtgaaagtccttttaatccctaatcataaatacattttattagcttactttaagaagtggcagtcacagctcctgaacattagggagtgtttcttttggtcagcattatttatttagtgcamattgcctttaattttaatttgaaattatagtaaaatccacgggagtttttaagtctcctcacagccttttgctaccttttcaccaaggtagatccagatgataactgctgtgttgtgacatcatagaaattagaaaaatattttcctctgaggaaagaacattgtaaatgaaactctacatatcagaggtctatagctatgtatcaatattaagtttcttttgtactttgctttgtagtcatcttcattccaaactttcataattattatttttactttaaaaagaaaaataacccacca

SEQ ID NO: 23368 - DNA, 601 bp, Human
aaaaaaaggaaaacattgataagtgtcctagaaacttggattcttttatagatttgttcttggggctctgatgtttgggattgacgttctgtgctgaccattttatatgcattttatcttaatagtatgtgctttcatgaagattctgatacaagtgggcaatccttaaattatctttgaaaaattggttaattttggttaaaaaagggaaagtggctgggtgcagtggctcacgcctgtaatccccagcactttgggaggccgggacgggtggatcacaaggtcaggagttgaagcccaktctggccaacatggtgaaaccctgtctctactgaaaataattggggcatggtggcacatgcctgtaatcccagctacttgggaagctgaggcaggagaattgcttgaaccggggacccaggaggcggaggttgcagtgagctgagatcgcgccactgcactccagcctgggctacagagcgagactctgtctcaaaaaataaataaataaataaatgaaaaagagaaaatattgagaggatttggtcatcattttactgctctcttcatgtgatggaaatcaattttccttctcaaatgg

SEQ ID NO: 23369 - DNA, 601 bp, Human
gagatgtactgtgattttactgaggtttcatcacaagaagggagtgtttcttgtgccattaaccatgtagtttgtaccatcactaaatgcttggaacagtacacatgcaccacaacaaaggctcatcaaacaggtaaagtctcgaaggaagcgagaacgaaatctctcattgtgtgccgtgtggctcaaaaccgaaaacaatgaagcttggttttaaaggataaagttttcttttttgttttcctctcagactttatggataatgtgaccgggtcttatgcaaattttctatttctaaaastactactatgatatacaagtgctgttgagcataattaaataaaatgctgctgctttgacagtaaagagaaggaagtattctgattagctgtatctggtattaattgcatgttaaaacactggaatttttaaaattgaaattagatcagtcattcttttcttttctcaagatatctcatggctgacactgaagaagaaatgtaattcataacttgcactaaatgtatattttttttcttaaaaatttaccattcttatttatatttttatggattaaaatttataaaatacagatcagtta

SEQ ID NO: 23370 - DNA, 601 bp, Human
gaacccccatgaaaaagcaatgatgcaattcatcaccaatgtggtgggaatctgttaaccagccattaaagacatgtacgtaccagacctgctagagccaccagagtagtctgaacctgggtcatgtttccattctcaaaaagatcatttgcttcgaatatgtcatgtggcttcataccataagcctgaatagctttaataaagttgccaatattctccaactataaagaagaagagttttataatttctggagctaaatattgacattcataatttctaagaattccaagtcttcataamcagttataagacgctgcccagaaagctgtttgacaaggattcaaccaaatacatactaagcatggctctctctggaacaggaaagagcaagaagagagtgtgtctctcactgtgggtcacatcacagtcttaatatttttaagcagttacgtgttttcagtttttatgggcaagatcttccttatatattttaaaaggattctgtatcagagctatccaggcctggaattttatttgtcaaaaggtatataattactcatactaataaataattcattatgtgttattttaatttcagaa

SEQ ID NO: 23371 - DNA, 601 bp, Human
aaaggccaacagagtttcacagaaggaacaacaaagaaatgatatgtccatagacaaaggggcccaaactagagataaaaagtatttaaggctgttcaataatatactgcatcatttgaaatgtgagtgttctaagtaagctatctagtacgatgcagctgatgtcagcagcctttccacaaagctactaattacagaagagacaggccccgccccacctggtctgaacccccatgaaaaagcaatgatgcaattcatcaccaatgtggtgggaatctgttaaccagccattaaagacatrtacgtaccagacctgctagagccaccagagtagtctgaacctgggtcatgtttccattctcaaaaagatcatttgcttcgaatatgtcatgtggcttcataccataagcctgaatagctttaataaagttgccaatattctccaactataaagaagaagagttttataatttctggagctaaatattgacattcataatttctaagaattccaagtcttcataaacagttataagacgctgcccagaaagctgtttgacaaggattcaaccaaatacatactaagcatggctctctctgg

SEQ ID NO: 23372 - DNA, 601 bp, Human
gaaacatgcacactaactgaaaaggccaacagagtttcacagaaggaacaacaaagaaatgatatgtccatagacaaaggggcccaaactagagataaaaagtatttaaggctgttcaataatatactgcatcatttgaaatgtgagtgttctaagtaagctatctagtacgatgcagctgatgtcagcagcctttccacaaagctactaattacagaagagacaggccccgccccacctggtctgaacccccatgaaaaagcaatgatgcaattcatcaccaatgtggtgggaatctgtyaaccagccattaaagacatgtacgtaccagacctgctagagccaccagagtagtctgaacctgggtcatgtttccattctcaaaaagatcatttgcttcgaatatgtcatgtggcttcataccataagcctgaatagctttaataaagttgccaatattctccaactataaagaagaagagttttataatttctggagctaaatattgacattcataatttctaagaattccaagtcttcataaacagttataagacgctgcccagaaagctgtttgacaaggattcaaccaaatacata

SEQ ID NO: 23373 - DNA, 601 bp, Human
cccagtactatagtacttctatctattcttaggagaggcttaatattttgcatggtgagaattaatcatattgaataagtaattgaataagcaacaccacattacttacctgcagaccaattacactttggccagcttttaattttccttcatcaaaacgtcttgtttgtttttctgcatacttaactccaatgtcaatggttgtatggaatccttttgttttagcctagacagaaacatgcacactaactgaaaaggccaacagagtttcacagaaggaacaacaaagaaatgatatgtycatagacaaaggggcccaaactagagataaaaagtatttaaggctgttcaataatatactgcatcatttgaaatgtgagtgttctaagtaagctatctagtacgatgcagctgatgtcagcagcctttccacaaagctactaattacagaagagacaggccccgccccacctggtctgaacccccatgaaaaagcaatgatgcaattcatcaccaatgtggtgggaatctgttaaccagccattaaagacatgtacgtaccagacctgctagagccaccagagtagtctgaacctgggtc

SEQ ID NO: 23374 - DNA, 601 bp, Human
aaatcctatctctactaaaactacaaaacttagccgggcatggtggctcattcccataatcccagctacttggcaggctgaggcaggagaattgcttgaacccaggaggtggaggttacagtgagccgagatcgcgtcactgcactccagcctgggcaaaagagtgagactctgtctcaaaaaaaaaaagataaaataaaaaatttaaaagtgtatttttcttttaaaaaaaaaaaaaaaagacaatatgattcaattaaaaattttcgtttcctggagaaataattgtcaagtcaggtgrcatacctgaggtttcctctaaaaaattatcactgtcttatgggctttataaatagatataaattgtataaactacaccccccccccagtactatagtacttctatctattcttaggagaggcttaatattttgcatggtgagaattaatcatattgaataagtaattgaataagcaacaccacattacttacctgcagaccaattacactttggccagcttttaattttccttcatcaaaacgtcttgtttgtttttctgcatacttaactccaatgtcaatggttgtatggaatccttt

SEQ ID NO: 23375 - DNA, 601 bp, Human
ttcactgtcaacatttgtgaatatccttttagctttttaacctatgtgtctatgtatatatctatagatgcacatatatacaaatacatacaaaaacatgtgcatttttaattttaaaaatccatactgaccacagtatttgatgatctgatttttttcccccataacctatcttttcaaactctagtgtataattttacattacactttgcttttatggagttgtaattcaaccaactgactactgttctgaaatttaggtttccagtttctcaccaccaatacaattttgtactgtgtaaaaataaatctaacttgcatagactcagtagaaaggggcactgtatcaagcaggtacagtggcttttggagagtaaagccaacagcatttggggaattagcaatgacgtttccatgaccagtgaagagaacaatgaagagaaggaaaacatctgaactacgtatttcagaagaatttaaactgacaaattctaacagggcttggctgctatatcatgatttggtactgtaaataagtgactttggcattaaggtcgtgtaaaattgcctaatttggtcaataacattaaggaatttataa

SEQ ID NO: 23376 - DNA, 601 bp, Human
actccaggaatgttttacataaaatgtgaaagcaaatgccaagtgttttctctgggagcttaacaagggctttttaaagtttcaaaatcaccaacattttctccagaaaggaaccacattttattcctgtaactcccatgtccttggacagagctggagaaaggtggaatgaggaatttgaactcagcaaagttcagggaaacaataattaatttttcttccccactgagaacagtatggcttcaggaccaaccattacaccctgttccactggttaggcacacttttctgatgttggatmttttttctttaaaaataagattaaagaaaatctttattactaatataaaatctgttcattgaagaaaattcagaaaacacatataagcaaaaaggaggggggaaaaatcattgtgataccaccatccattcactgtcaacatttgtgaatatccttttagctttttaacctatgtgtctatgtatatatctatagatgcacatatatacaaatacatacaaaaacatgtgcatttttaattttaaaaatccatactgaccacagtatttgatgatctgatttttttcccccataacctat

SEQ ID NO: 23377 - DNA, 601 bp, Human
ctaggccaagcaatatgctgttctactccaggaatgttttacataaaatgtgaaagcaaatgccaagtgttttctctgggagcttaacaagggctttttaaagtttcaaaatcaccaacattttctccagaaaggaaccacattttattcctgtaactcccatgtccttggacagagctggagaaaggtggaatgaggaatttgaactcagcaaagttcagggaaacaataattaatttttcttccccactgagaacagtatggcttcaggaccaaccattacaccctgttccactggttwggcacacttttctgatgttggatattttttctttaaaaataagattaaagaaaatctttattactaatataaaatctgttcattgaagaaaattcagaaaacacatataagcaaaaaggaggggggaaaaatcattgtgataccaccatccattcactgtcaacatttgtgaatatccttttagctttttaacctatgtgtctatgtatatatctatagatgcacatatatacaaatacatacaaaaacatgtgcatttttaattttaaaaatccatactgaccacagtatttgatgatc

SEQ ID NO: 23378 - DNA, 601 bp, Human
acaatatacacaacacaaacaaaactttccatgctaccaaaaagacagaaggggcacaaccgacaagttactgagctgaggctccagtcaactcttctatgtgtctacaaacaaatttcaagtgctaactttaaaaagaaaatttaaagtcactatagataaaaactcatacatagaagaattaaacacactttaacaggtggactgacacaccaaaagtcattacagtggcagaataatttcctctgctactctttccccagataaccaaattaagaggtaccagcttcggttatttcarcagaagtaatcctaggccaagcaatatgctgttctactccaggaatgttttacataaaatgtgaaagcaaatgccaagtgttttctctgggagcttaacaagggctttttaaagtttcaaaatcaccaacattttctccagaaaggaaccacattttattcctgtaactcccatgtccttggacagagctggagaaaggtggaatgaggaatttgaactcagcaaagttcagggaaacaataattaatttttcttccccactgagaacagtatggcttcaggaccaaccattacaccctg

SEQ ID NO: 23379 - DNA, 601 bp, Human
agactaattgtggtctggtcaaaaggtttgtcagtttgcattttgggatcataaagatgcctcctagtcccgtaagctgtcatacctgcctggctggcacatttgttggttcccatcttttaagttaaaaataaaattgcacaaattatcagatgtcaacaatatacacaacacaaacaaaactttccatgctaccaaaaagacagaaggggcacaaccgacaagttactgagctgaggctccagtcaactcttctatgtgtctacaaacaaatttcaagtgctaactttaaaaagaaaatttaaagtcactatagataaaaactcatacatagaagaattaaacacactttaacaggtggactgacacaccaaaagtcattacagtggcagaataatttcctctgctactctttccccagataaccaaattaagaggtaccagcttcggttatttcaacagaagtaatcctaggccaagcaatatgctgttctactccaggaatgttttacataaaatgtgaaagcaaatgccaagtgttttctctgggagcttaacaagggctttttaaagtttcaaaatcaccaacattttctccaga

SEQ ID NO: 23380 - DNA, 601 bp, Human
aaacaccactctgaaaagatcttgttcgctaggtaagagaatgagtacacatataatcacaaatgcacactgatcatgactttatttaaaaattagcaaacaatactgtagaaacattgatatgtaaatttctaaaatgctgcatcttaaatttagttggcaaagaccacatttagcaataagcatgagtttagtcttccatgtagaaaccagatacactaaactgtaaaaaaaaaaaaaaaaaaaaaaagtttcctattgtttgaaaataccagtttaatataagattgtaaaaatgcayagatttttgcataaaagaactggctgtacaagagtactcccctttcacagtattcctttttacttcatatgcgagttattgattatgctgtaggatttaactattacagcactaaaaggcaactattgagggaagaggcagaaaaaggaaaaaggaatgtacgtaaggcaatttttcttaaaagtacaataagcttaatagtgttttaggaagacaagataaaaattactcaaggctagcttggttctcactgaataaaaacaaaggactaaatactgagctccttctgtgtggatctaa

SEQ ID NO: 23381 - DNA, 601 bp, Human
cgtctggcctcccccaggacaggcagctcacgtgcacaaacacagagccatgcatgtgtcagcacagcacatgcagatgcgcaggtacatgtacataaggacacatatgtggtaccagtgtgcatacaaagctatctgcacacaggcatgctcacggaaacatatgctcgctgatatacccagacacaccagcttgcatatacccacatgcgcacagccagcctatgaccactcctcctgtaggtcttcctgttgggaagttctaatgcaagtctgactgcattccttccaactctaatgraatccaattttccttccctcaatcatggataggaaatgaaaacagaaaggaccccttaccccaatatatttggagataggactccagcccccttctccctgggacagaactgtgcccccagcctgcctattcatcccccatcctagtgatatacacatcccagctctcaaaccctatcctggtcttcctcctgccagccaatagaagggctgccagctgtggcgccatgtgggtgcatgtggaggcgtgaggatggatgtgatcctgtccccttccggctcctagtctctggtcgccact

SEQ ID NO: 23382 - DNA, 601 bp, Human
gctggccagagacaggggaaagacagaaggtaggtctgccaggtaccacctctcagcccaccctgcaagcccaggggtggagaccaggttgactcctggcaggggctgggatgcaatgacccacagacaggcccctgggcttaagccccacatctggagttgctgaggagtgtggctgaggtcagtgttgattctcagtggtcacatggatgcatttaccgcgtgggctgggtcacgggggccgcccccaggcgcaggatgagaggccccttggggttgcggatcttcttgatggcagacktcttcatgaggctgagtcggtggatgaggttgaagcctttgggggagacatcaggtgaagagctcagctgagcaggtggagaggggtacagatcactcccagaggaaggttgcagggacggcgcgatgagatggttgggtgctcaccagtcacgttggctggcaggctactactgtgttccaatttgagtccttcctgctgtgaaggtgggcattgtgcacctagaagagaaggggcaggggggcattaggtgcgctcaggccaaggttgctgcacggctggacgcctggggaacctggg

SEQ ID NO: 23383 - DNA, 601 bp, Human
cttcacgtctgatgggggcagggaggccatgagcaaagaatccccagaatgactatttcgctatcgcattgcaatttgaataagtgcttccaatgaacccagaataccctaggtgaataactggagcaagggtggaaggagagatactgaaaaaaagatggaaagggttcagcatgaccagagcagcaagagataaaaaagagcattttgagagctgaggttgaagaggcaagcaggggccaggccagggcttgtgggaatttggatttcacacacatgggtgcacacacacgcatgtgcrcacacacacacatgcacacacgcacatgactcttgccaggttcccgcccacatcctgtgttctcacagtgcccacaggatgcagacctgttcccacccactgctggccagagacaggggaaagacagaaggtaggtctgccaggtaccacctctcagcccaccctgcaagcccaggggtggagaccaggttgactcctggcaggggctgggatgcaatgacccacagacaggcccctgggcttaagccccacatctggagttgctgaggagtgtggctgaggtcagtgttgattctcagt

SEQ ID NO: 23384 - DNA, 601 bp, Human
gaaaatacagaggcactgcctgccttcatggagccttcacgtctgatgggggcagggaggccatgagcaaagaatccccagaatgactatttcgctatcgcattgcaatttgaataagtgcttccaatgaacccagaataccctaggtgaataactggagcaagggtggaaggagagatactgaaaaaaagatggaaagggttcagcatgaccagagcagcaagagataaaaaagagcattttgagagctgaggttgaagaggcaagcaggggccaggccagggcttgtgggaatttggayttcacacacatgggtgcacacacacgcatgtgcgcacacacacacatgcacacacgcacatgactcttgccaggttcccgcccacatcctgtgttctcacagtgcccacaggatgcagacctgttcccacccactgctggccagagacaggggaaagacagaaggtaggtctgccaggtaccacctctcagcccaccctgcaagcccaggggtggagaccaggttgactcctggcaggggctgggatgcaatgacccacagacaggcccctgggcttaagccccacatctggagttgctg

SEQ ID NO: 23385 - DNA, 601 bp, Human
gtcaaggagctatacatcctgaaagaatgaggtaggtactggtgcgctggggacaggcttgagggtaggcacaggatggagcagggagaccccagaagtcacaagccgggatgaaaggtgggctggactggtgctacccaatgccctaagaggcaatcagggcacaggggaggttcacctgtggatacccatttgcatcggtcacttgaaacagataccacgtcttctggtgggtgtgtttcttcagcagtagtgtcagcaccagggcaaactcctccgggagaccccgagggaatactcktctggagatggagcagggagggtgccctgaggctccaatgaggacccaaatgctgcccaccctgagccctcaggactgctgagcctacccaagacatccacaggcacacatcttccatcatatacattcattcactctccatacctttactgagtgccttccgcgagctaggtgcgggtctggctgctgggaataacagtggtgaaggctgggtgcggtggctcatgcctgtaatcccagcactttgggaggccgaggtgggcggatcacctgaggccaggagttggagaccagcctggg

SEQ ID NO: 23386 - DNA, 601 bp, Human
tcagcttgtgccaacgcaagtcgaagagctggggcactgggaagatgcaggacacaaagtcgccatcctggccctgggccctgagctccaggctccgctcttggctgttgacttccagggatatctgggtagaatttggaaagggaaaggacagagattcagagctccagagtcacaccatgggcacgttcagggaccttgaactcatttcacaggaggggaactgaggcccagaaagagaagaaagccggctggggtcaaggagctatacatcctgaaagaatgaggtaggtactggtgsgctggggacaggcttgagggtaggcacaggatggagcagggagaccccagaagtcacaagccgggatgaaaggtgggctggactggtgctacccaatgccctaagaggcaatcagggcacaggggaggttcacctgtggatacccatttgcatcggtcacttgaaacagataccacgtcttctggtgggtgtgtttcttcagcagtagtgtcagcaccagggcaaactcctccgggagaccccgagggaatactcgtctggagatggagcagggagggtgccctgaggctccaatgagga

SEQ ID NO: 23387 - DNA, 601 bp, Human
tggagatggcagtgggggttaagcccggctctgggagatgggcagggagcgagtgtgaaagtgtacaaagacccccttgtcctcacccaggaggctgccaagccagctctaggcaacgtccactcccggctcttgcccgctccaccctgcacaccctccattcactcacattgctgtcccgggcaccatggacacagggcggacactgaaagggaagagcaggcgaagaggtcaattctgagcccctggggtgagccctccccacctccatcaccaccaggcccacagaacatcacacatrtcttgagtggaatctgaggggagcctgaagataggaatcctataaaacaagcctcacccctcatttcccacccacccagccccacagccatttttcagatggggaaactgaagcccagagaggaatagcaatatgccccaggtcacacagcatgctggggcagagtacggcccagaatccaagggcaccgtggctgaaggctgggctctccccatgatgcccgtggccatttgctgccaactcagcaggagtgtcctccagggctacctaccccccaacccaacgagaggcagtggacag

SEQ ID NO: 23388 - DNA, 601 bp, Human
cgttaggcccacaggtatatgggttcaactccagccttcgtgtgccacacatatgcaaacatgtgtcccagagatgcatgtagccacacccacacataatcattctaacacaccctgtcagacatatgtgggcacagctgggcctcagtttcccctgaagtaaaatgatagcacccaccctgcaggctgactattgagagggttcaaaagggtaataagtgtgcataggtgtggcctaaggcctggtgcacagaagggcctcagaaaagggcagctcttagcatctttgcacacacacaamcccctgctttctttaccacgcatacacttaatcaccctacacacatacaggctcaggtggccctgatagaaacacacagccacagggtcacatgctgtgggaatggctggggatgctaaagaggacgggaatgtcccgttctccattaggactcaccttggggccagagggagcaagtgtgacctgaggggacagaggagagggcatcacacttccggtagagagagaaaaccaggggcccagagaagtcaagcaatttagacagggtcacacagcatggtagcaggaccagcagcctgt

SEQ ID NO: 23389 - DNA, 601 bp, Human
ccttctcgcctgttgagcctgggagtcctgagggtccctgagatgaggaagggagacagaggaagggagggtaaggctgggccctggacccaccatccctgccctatccctggtcccacactcaccagagctcctgactcccccttctctcccttcgggccttctgcacactgaacaggggaacacagtgttgagaggggcagagggtcacctgatgggctgccaagcgcacagtccctccccaggggctggccccatattggccctgaagcaggcatcacctccaagtcttacctgaagyggggcatccggggagattcgaacacagtcattgccctgggagtagggaacaagggatcaggggtgggaactcctggggaagtcccctagatgtgttgtgaggaggatcggcccgggaaccccatagtcctaagtatccctagaaaaggggggcttctacacccaaacccctagaaagaccctggccctcacccccctcccgtgatctgggccaagctgcaggctttctgccgggatgatgggatgatggctcacatcccacctcaccccagggcacagctggcaaaggtcctgccacggg

SEQ ID NO: 23390 - DNA, 601 bp, Human
tgatccgcgtgaccccagcagtcacagacagaaatttccagagctttctgcacatccaggcacaaggctctaaaatgagcttgggccctccagcaaagtccactttgatctttacaacacttaggtctgcccatccctatacctggaacacaggcggaggttgcagtgagcagctcagtgagcactgggatggggacaggacgctccccgccaaggggcctggccaagccgagcccagcctcctcctccaaaggcccggcctcctccctgggacttgcttcccctgtgggaagctgccccrgccccttctctctcctcctgtcaagcatggagctccccacgtgaccacactcccacctatgctcaccttgtctcccttggggcctggtgggccacctggatccccctgagggcagaaacagagtcacgtggaagtttccagggacctctcgctacagcgagatcttctaccctcaccctctcctccagccaggatccctgggacagagccttatcttccccccgttcattccctggccagggtgggagagcggtctctgagaaaagcacagcaggagaagcaagggggtactcaccgggg

SEQ ID NO: 23391 - DNA, 601 bp, Human
ccacaagattccagggtggcgcaaaactacatcctcgccgtaagccttaaaacatgactgtgccccactgacagacatggaaacttgggctaagagagaagctaattgatctggcacattcataaccatgtgtgtggtggaggcagagtttgaacccagctcacccctaagccaggttctttatgtactcactgcacatggacatcagaggaagaacgggtgggggtcccctgaggaaggtccagcacccctaggcctagggcccttgatgctcactgtcatttgcagaaagggggtcccrttcccaccccgatctgggcagccaggcctaggactcaccttctctcccttcacacctggcttcccctgttagaaaagaggcaatgggcatcagtgccagggcagagggctggtgtgccaactgagggccggaggacctagcccctccctccagaggccttggaagagccgaccctcccccgctggattggtgtcactcacaggtttcccaccagggccttcctttcctgggatccccgagctgccctgtggtcagaagaaaggataagcggggagccttctggccaatgcaatctcggtg

SEQ ID NO: 23392 - DNA, 601 bp, Human
aactgactcattcattcaccacaagattccagggtggcgcaaaactacatcctcgccgtaagccttaaaacatgactgtgccccactgacagacatggaaacttgggctaagagagaagctaattgatctggcacattcataaccatgtgtgtggtggaggcagagtttgaacccagctcacccctaagccaggttctttatgtactcactgcacatggacatcagaggaagaacgggtgggggtcccctgaggaaggtccagcacccctaggcctagggcccttgatgctcactgtcatktgcagaaagggggtcccattcccaccccgatctgggcagccaggcctaggactcaccttctctcccttcacacctggcttcccctgttagaaaagaggcaatgggcatcagtgccagggcagagggctggtgtgccaactgagggccggaggacctagcccctccctccagaggccttggaagagccgaccctcccccgctggattggtgtcactcacaggtttcccaccagggccttcctttcctgggatccccgagctgccctgtggtcagaagaaaggataagcggggagccttctg

SEQ ID NO: 23393 - DNA, 601 bp, Human
ttcaggcagtgttgggcacacttcacaggggtcaccctagcagaagggagaggcagtatgtggacagggtggggctgagaccccagggaaggcaaggggcctcttgcgcagaccagccctagacattgggtccaccagagccccacccccaacatcaaagtggacagcaggaatgccgctggggcttcctgttcaactgactcattcattcaccacaagattccagggtggcgcaaaactacatcctcgccgtaagccttaaaacatgactgtgccccactgacagacatggaaacttggrctaagagagaagctaattgatctggcacattcataaccatgtgtgtggtggaggcagagtttgaacccagctcacccctaagccaggttctttatgtactcactgcacatggacatcagaggaagaacgggtgggggtcccctgaggaaggtccagcacccctaggcctagggcccttgatgctcactgtcatttgcagaaagggggtcccattcccaccccgatctgggcagccaggcctaggactcaccttctctcccttcacacctggcttcccctgttagaaaagaggcaatgggc

SEQ ID NO: 23394 - DNA, 601 bp, Human
ttctatggttcagaccccttaccacagtaagagcctagactctctgcccataatctctctgtagccacgagaagtacccagcccctctgcccaattcctctctatgatcatgcccccaggtttctttgtgtgttgggggaggtccctcaatggtcaccctgggcactcaccctggctggtacaggatcaccaggctcccctttgggccctggctttccaggaagtccaacaaagttctggaacccttcaggcagtgttgggcacacttcacaggggtcaccctagcagaagggagaggcartatgtggacagggtggggctgagaccccagggaaggcaaggggcctcttgcgcagaccagccctagacattgggtccaccagagccccacccccaacatcaaagtggacagcaggaatgccgctggggcttcctgttcaactgactcattcattcaccacaagattccagggtggcgcaaaactacatcctcgccgtaagccttaaaacatgactgtgccccactgacagacatggaaacttgggctaagagagaagctaattgatctggcacattcataaccatgtgtgtggtggaggc

SEQ ID NO: 23395 - DNA, 601 bp, Human
taaggaattctcttacagaacatgagggctctcagaaataaattctttgactcaagtctgcaaaacactagtaaattaatttcactgtgaatttaccgtctgaatctcttgtttatattacccttattccccgcccgcaccactcctcccctgcctgcctgccaagaaactccagtgtccctgacatctaacccaggtctcaccttctctcctttcagccctggaaccccagctctaccctgaaaaacaaccaagacagagtctcagcatctccccactcccacctctccaaggctccccrggtcccagtgtccaaccagaaacagaacggtaagataggaattatgtccttcaggtagctggacagtttcttcagttagacaactgaagctagaggtgctaagaggaagttccagggcaaggagcctggggcagcacagggacggagggagggaccaggagacaggcctgggacacctgcctcttcccctccctcctgatccctgccctgagacttgggatctgaaaagccagggagatcaacagtatggcaaggatggctgaactgggctgggctgggagaaagtcgtcactcaccgga

SEQ ID NO: 23396 - DNA, 601 bp, Human
gcaggacaaacagcaatgcctgttgagcttgcacacgcagaactttctaaatcatcattttaaacagtggtgagtactatgaaggaaatcaacaaggtgatgagacagagtaagtggaggtggtcagagaggtgttaaccctgattattaccagaagaatgagaataaggtcatccaatgaaagaatgggggagggtagagaggaaaaacattctggatgcttctagtgggaaccacaagtacaaaatctgacgggtgggagtagtccggacatattccataatggaaagaagatccgcayggctaaagcagagtaaacccgaagagaaggggaagaagcggatgaatttgggaaggatgggggctggggcatccggggtcctgtgagatacagtggagctatgttagaaagtaagtcacagagggactctaaggagggaaatactgattcttctacaaagccacattaaactaccgggtgaaggctgggcacgatggctcacgcctgtaatcccagcattttgggaggccaaggagggtagatcgcttgaggtcaggaatttgagaccagcctggccaacatggcaaaaccccgtctcta

SEQ ID NO: 23397 - DNA, 601 bp, Human
ttctgcccactctgccatactctgtcccaggataaagggcagagacctgtgagggccgctcctgctggagacagaggctctgaccccgccacaccctccccactacccccaactgcccagggagtcaagagacccaggcaggacccctcccctctccttagccccgcctgcatcccccgtccagaggcccctgcctatatcccacctcacctgttttcctggcaagccaaagcctggaggcccaggttcccccttctctccggatgggccaggcaaggccaccacacggacatccccatcytgaaggttggacagggctgggcacggctcacagggctccccctgccaagcaaggacattgagttagggggtcccccaggccctagtgcacttgagcgaggtttggaatctagggctggggaatgtcactgggtctgacactgcacctctgctgggtgaggggttatcttgggaaagatgaagggagaacaggaaagaaacaaaggtggagctgagtcatcaggggtctccatgccttgctaaggagtcagactctgcccgacagacagcaaggagccccagagggttcgaagtcgagcaa

SEQ ID NO: 23398 - DNA, 601 bp, Human
gggaagggccggagggcaggcaactcacgggtttaccaggtcggcccacgccttcggggccctgctctcctttggggccgggctgcccaggccgtcctgccatgtctgtcactgtcccctgcaggctggggcaggcagtgcagccatcaccctggtcagagatgggtacagccaggagcccatgagccggggctggcacccaggccaggacgccctgcacccctctgaacactctgccccttgaatgctcccacgtcagcctgggaaatcaaaacaggcccctgacactcctagcagaggwgaagccccgaggagcctccgctcagtgactctgacagccgttaaggccccagctggccctgcagtccttccctcactggtgcgacacctgattttttttatgcaacaaactccccgaccccaaccaccccgcctgactaaccttttctccttttggccccgcggggccctgaactccaggctctcctgacagtcctggccgccctgtggtgcccggcgttccagggtctccaggattcccagcatcaccctgtaaggagtggggttcaaggaaagcaaggatggcccagccgggggcagg

SEQ ID NO: 23399 - DNA, 601 bp, Human
caccttcacacgtgggacttgaagcccctgaggacctggcccacatctctccttttgcctggggctccctgggacaggcaggaaccctggctgtccagctctgagggacaatagagaccggctgtgtgggcttgggcgagtccctgcctgctttggacgttggtgcactctcctatcagtgaatcccaaactggaactagaatttctccagggatccgcaaagacagaagaggatacggttcacctgggctatttttaacattaccaaaagcccaagacaaattacgcatttgcccaccgyctggcatggaacagactggctgaaaggtagcatgcctttgattttggctgcaattagattatctggtaaaattctagcgggttcatgtggagtagaagctgacgactatacaggtctttgatgattaaaaatgagaaaatgcacttatgattacttaatccgtgcaatttgttcaatagacatgtctcttaaaacgtgggagccactgggtgaatagtacaaagggaaggtctttccaattatactggaagtagttgctggtctggatctgtgccgtctgatacagtagtccatagccac

SEQ ID NO: 23400 - DNA, 601 bp, Human
gctaatcccctagaatatgggtcacaggcccttggaactcaccttctctcctcgtggtcctttttcaccctgcagggaagaaacacaggaaggtgagcagataggggtgccgaggcagggccggccatggcttcctgctgccccaaggcactgtactcactggtgttcctctgagtcccgtctgtccttgctgcccatcacggccctgaagagagagagcccagagtcagagggtgagactgggcagcggccagccatctggcctgctgcagaaaaggggtgtaggacaaacagaagcagygccaggttcccctggagcccagggccgagggcccacgttccagaggaggagactgaggtgccggacaaggaagaagactggcatttcctgagcacgtctcagtgccagccactgggccaagtacccgtcggggaacactgaatggaatccgctctcccagcccggcaggacggtattgttctggttttcaggtgtggaaactgagccctgaagaaacttcatgacagacccaacagccagctgcagccaggcgtgtgtagcctgaagtctctgctctctcctctctccctttagtgcttg

SEQ ID NO: 23401 - DNA, 601 bp, Human
cctctcaccactagtcctttccagctcacttcctgccccatcctctgactcagcccccatttgaaaatgcagctgccctcctaagggggccttggagttttccagtctcccataatcctggttgagtcccaggccagcaaccaggtgaagctggggatacgtggagcccctgaaaccagaaagctgggggtagcaaggagcccaggatgcctcctccacccccatcctccagtccaaggcagcttcatgtgcacaggctcccctggttcatggtgggaaggctggaggggctgctaatccyccagagtacgggtcacaggtgggaaggctggaggggctgctaatcccctagaatatgggtcacaggcccttggaactcaccttctctcctcgtggtcctttttcaccctgcagggaagaaacacaggaaggtgagcagataggggtgccgaggcagggccggccatggcttcctgctgccccaaggcactgtactcactggtgttcctctgagtcccgtctgtccttgctgcccatcacggccctgaagagagagagcccagagtcagagggtgagactgggcagcggccagccatctgg

SEQ ID NO: 23402 - DNA, 601 bp, Human
cctgggttcaagcgattctcctgcctcagcctcctgagtagctgggattacaggcatgcaccacaaaacccggttaattctttttgtatttttagtagagacggggtttcgccatgctggccaggctggtctcgaactcctgacctcaagtgatctgccgaccttggcctcccaaagtgctgggattacaggcgtgagccaccacgcctggcccgaacatgttaattattatgccttaaatcattattcatcccttgctcccctctccagggccagtgtgatagttcaagcctgatacttygtaattgttttcctgacctctcagaactaaatgttctacctgttgtcctactgcggaagcgaagtgcagccagaattgaaagctgggctcaatgacctactagttgcctcaggcatctttcttaacctcagtgcctcagcttcctcctctgtggaatggactgagatgaaatgagataactaagcactgggacaatacagccttggatgagtaagtgctgtacatccctgagcctgtttctatacctgaataaaggagctgcttggccctcctgcatcccacctggcatggggcaggtac

SEQ ID NO: 23403 - DNA, 601 bp, Human
cagtaagtacgtgttgagtgaatgcaccgctgctcagcctgctcctccctgcacaggatttccttggcgcactctgagatctggccttccttcaagtcccagctcccagcaatggaacatatcaccagcccccgagcaatttccaggcaggctctaccaggcctgggtcagacccggagccagccaccatccaggccccctggcacctctgtgcaccatcagggcttagagcagtgcctggcacagggaaaatgccttgaacatgtcaattattattttttatttattattattattattatttttgagatgtatcactctgtcgcccaggctggagtgcagtggtgcaatctcagctcatcgaaacctccgcttcctgggttcaagcgattctcctgcctcagcctcctgagtagctgggattacaggcatgcaccacaaaacccggttaattctttttgtatttttagtagagacggggtttcgccatgctggccaggctggtctcgaactcctgacctcaagtgatctgccgaccttggcctcccaaagtgctgggattacaggcgtgagccaccacgcctggcccgaacatgttaat

SEQ ID NO: 23404 - DNA, 601 bp, Human
gggcctgttacaagccaggcatcagctaggccctcttagacagatgcttggaatgcgtattccctgcaaactgctgctctctctgcgaggtgccacacagctgagcacttactaagagaatccccttaggagacacccccgccagctcacacttccctcctgggtaccctcttaccttaaggaggtgctgttcaattggtaaggatccctgcaagagacagatgtgtgggctcaagcaggtgaggggaaggaacatggagacttatgggatcagggagagccttgggacacgtcatgcacyttccagcctcagaagtgggagagaagagggacccccactgcagctaccgggccagcttcatagcctgagcagccctgggaagggcagggaaggggcatgcacagggagtcctggccagtacccaccagttctgcagtgagcccaggctgtcctggcaaaccgttgtttccaggcactccctgtagccaagaagagacacgagtgagtgggctccatctctctagcctgctggtcagcctgtttccttctcatcatccccgcctcctcttccccttgtcctgcagagctgagagccctggc

SEQ ID NO: 23405 - DNA, 601 bp, Human
ttccaataggaacttctgctcagtttgggaagccggcccaggccacagccctctggtagagcattaaggctgtgtacaggccctggcacaggccgaccctctgaccaggtccgaagtcccctttcttagactaccagaagtgcttctcaaatccatctcctccctggattctttctggattgactagagaacagctgaagctttcttccaggccacacccaatctcacagccccccaccactgcactttcaccccctctgctttgctttggaagctgctgggctctgccgcagggtgaccygggtgctacggggtctcattgccagctgctgcgggcaggcttcagggctgggttctgccgacagcatctgccatgtgggcaccttcacaggattcctttaagcactcattcagcaaatgttgcctgggggcctgttacaagccaggcatcagctaggccctcttagacagatgcttggaatgcgtattccctgcaaactgctgctctctctgcgaggtgccacacagctgagcacttactaagagaatccccttaggagacacccccgccagctcacacttccctcctgggtaccctctt

SEQ ID NO: 23406 - DNA, 601 bp, Human
ctgccctgaccaaggcccatcggggtcatgggatgtccagggcactaattagccagtgtcagaagagggtggccaggatgagggggggctctggaggccaacacatgggaaagacccctgaggatgctgggctagaggagagaaagtccaggaacataagggcctccttcaaaaacctgaaggcaacctggggaattactgtgctctcgtttctagaggtgactaagcaaagatgggctatgtgactcttgattccaataggaacttctgctcagtttgggaagccggcccaggccacagycctctggtagagcattaaggctgtgtacaggccctggcacaggccgaccctctgaccaggtccgaagtcccctttcttagactaccagaagtgcttctcaaatccatctcctccctggattctttctggattgactagagaacagctgaagctttcttccaggccacacccaatctcacagccccccaccactgcactttcaccccctctgctttgctttggaagctgctgggctctgccgcagggtgacccgggtgctacggggtctcattgccagctgctgcgggcaggcttcagggc

SEQ ID NO: 23407 - DNA, 601 bp, Human
acagcccccatgctctgccctgaccaaggcccatcggggtcatgggatgtccagggcactaattagccagtgtcagaagagggtggccaggatgagggggggctctggaggccaacacatgggaaagacccctgaggatgctgggctagaggagagaaagtccaggaacataagggcctccttcaaaaacctgaaggcaacctggggaattactgtgctctcgtttctagaggtgactaagcaaagatgggctatgtgactcttgattccaataggaacttctgctcagtttgggaagccrgcccaggccacagccctctggtagagcattaaggctgtgtacaggccctggcacaggccgaccctctgaccaggtccgaagtcccctttcttagactaccagaagtgcttctcaaatccatctcctccctggattctttctggattgactagagaacagctgaagctttcttccaggccacacccaatctcacagccccccaccactgcactttcaccccctctgctttgctttggaagctgctgggctctgccgcagggtgacccgggtgctacggggtctcattgccagctgctgcgg

SEQ ID NO: 23408 - DNA, 601 bp, Human
aacacggaggacggaggtgaaggcacgacaggagggagacaagcaaaagccacagagacctggctgacgggggggaggggaggtcgagcagcgctaggttcttacaggcaatccgggggagccaacagcaccaggaaaacctggggggccctggtgggagaaacaggcaggtcacatctcacaggcacagtaaccctgggacagcctggagggcacagtctggggcttgggggtcatggggagaggaggtcatgggagtattttcaaggcagctggaaaagagactccttgaaagtcttgrctcaaaagacaactgttcctccccttggctccaggaagaatggctcctccgttgacggagatgcggaatggctccagagtcagagggcttcctgagtcttccggagtctaactgaagatccggttgcagcagaagcccatttctttcagccttgcccaccatgcctgccacccgacctccacctgtcccccgagtggggggctccctggctgtaagacagctcccaccagccattttcttctccagagaaagcattttcagttctttcaatctttcctagtcacttctattttcctgcca

SEQ ID NO: 23409 - DNA, 601 bp, Human
gcttaagaggaaggttcacgagctcaggaggacttgggggagtgctgcaagatggtgcgagaaatggagaaggaagacagaacggggtaagagagagaagaggagagaaagaacgcaggagaggagggagaggagaaaacggaaaggagtcagagactgggaggatgtccaagctgccgggacctcagagaacccgtgtcgttagctaccgtgcctgaagggggacaacaaacacggaggacggaggtgaaggcacgacaggagggagacaagcaaaagccacagagacctggctgacggyggggaggggaggtcgagcagcgctaggttcttacaggcaatccgggggagccaacagcaccaggaaaacctggggggccctggtgggagaaacaggcaggtcacatctcacaggcacagtaaccctgggacagcctggagggcacagtctggggcttgggggtcatggggagaggaggtcatgggagtattttcaaggcagctggaaaagagactccttgaaagtcttggctcaaaagacaactgttcctccccttggctccaggaagaatggctcctccgttgacggagatgcggaatg

SEQ ID NO: 23410 - DNA, 601 bp, Human
ccgggcacagaggggcagggccgcacgacacccagaaacccaactggctgatatcacatgccccgccttggagcagactgggactggagccaaggaagaggaagcgaagaggaggcagctgagagtttcctctaggacgacggaaaaggcgcaggaagggctgcctttaaatccctgggtgcctctggacagccctgccaagcagcagggcagcaaacctgtgccagcctgcaatgtgaagccctaaagctttggcatctctgctgggctctgagccaggtgcctggcagggccccaagarctactttcagcaaatcttcaggcaacgccgaaggtggtgagaagcaggaggcagagcgagaaggcaggaatggaggggccccctagaggcaccagcttaagaggaaggttcacgagctcaggaggacttgggggagtgctgcaagatggtgcgagaaatggagaaggaagacagaacggggtaagagagagaagaggagagaaagaacgcaggagaggagggagaggagaaaacggaaaggagtcagagactgggaggatgtccaagctgccgggacctcagagaacccgtgtcgttagc

SEQ ID NO: 23411 - DNA, 601 bp, Human
tcacccaagcaagcagaaacagacaaggcccggccacagatgaggacgtggggacagatggaactgtgacgaggaggggccctgctccctgagcctccatcaccaggcctgggaggagaggagccaggccccaggaacacgaaacctgacaaacaggaggttagtttccgtgacccaggagggagcaacaatgaggctgggggtgatgtaaacacacctgtgacgatgacgaaggcagagcaattaacgacacctggcagaaggagccggccaaggtgccgggcacagaggggcagggccrcacgacacccagaaacccaactggctgatatcacatgccccgccttggagcagactgggactggagccaaggaagaggaagcgaagaggaggcagctgagagtttcctctaggacgacggaaaaggcgcaggaagggctgcctttaaatccctgggtgcctctggacagccctgccaagcagcagggcagcaaacctgtgccagcctgcaatgtgaagccctaaagctttggcatctctgctgggctctgagccaggtgcctggcagggccccaagaactactttcagcaaatcttcagg

SEQ ID NO: 23412 - DNA, 601 bp, Human
gactctgggagggtatctctcaggtgcccgtcgctggtatgccctgccatggtaactgactggcgtacacctttaggaaggtgatggatcagatgtgtgcttattctgaggggcaactgtcaggagaggtaccccagatggatgctgccaccaaagtgtatcatatcatcagatacccaacacttacctgtccaagtcccccaccccaagcaaaaatcactttcttggagggaggcaggggagagacacaggaaggctgcctccagagcagtccctgtcactttgtagggtgagagggcawgtcactttccacgagagctacagcccccacccctaattccttaccccagcctttgcaggtgccatgccattaagggcacctttcctgcccccttctccctcatcccctcaagagatgacgcccaaacctttccatgacataagacagatggctagacggacagatggccccttcacccaagcaagcagaaacagacaaggcccggccacagatgaggacgtggggacagatggaactgtgacgaggaggggccctgctccctgagcctccatcaccaggcctgggaggagaggagccagg

SEQ ID NO: 23413 - DNA, 601 bp, Human
gagaaaaatcatgagaaactgcaggagccggcggtccccacccagcccctgactccttccccctgccccactgccttctgttcccactccaggcaaatatggaggccatagtggctctcgtagtgtccctagaaggtgacccgtaatgggtgtgctccagcaggatgactggtggaggtgtgaaccccacatatgggtgcctctcaggaggatacccttcaagatagataactatagagatatgccctccagcagaggtgactctgggagggtatctctcaggtgcccgtcgctggtatgycctgccatggtaactgactggcgtacacctttaggaaggtgatggatcagatgtgtgcttattctgaggggcaactgtcaggagaggtaccccagatggatgctgccaccaaagtgtatcatatcatcagatacccaacacttacctgtccaagtcccccaccccaagcaaaaatcactttcttggagggaggcaggggagagacacaggaaggctgcctccagagcagtccctgtcactttgtagggtgagagggcatgtcactttccacgagagctacagcccccacccctaattcct

SEQ ID NO: 23414 - DNA, 601 bp, Human
gcagggagtcagggcacatggagatcggcctcctttgctcctgggggagtgtggaaacctcacactgagggaatcccggcagaagggcagagagtctcaaggagtccacctcccagcttccactcagcagccacccttcagagctcaagctctgcctccccagctcttcctccctttccagccctttccagcccctgccagcttcttcttaccggctcccccttgtctccagtcaggcccgtgagacctcgctctccttgaaggcccttggagagaaaaatcatgagaaactgcaggagcsggcggtccccacccagcccctgactccttccccctgccccactgccttctgttcccactccaggcaaatatggaggccatagtggctctcgtagtgtccctagaaggtgacccgtaatgggtgtgctccagcaggatgactggtggaggtgtgaaccccacatatgggtgcctctcaggaggatacccttcaagatagataactatagagatatgccctccagcagaggtgactctgggagggtatctctcaggtgcccgtcgctggtatgccctgccatggtaactgactggcgtacac

SEQ ID NO: 23415 - DNA, 601 bp, Human
agcagcttctgtgggggtggcacctctaagctgtctctccaatctcccaaacccctcacccccaggaggcagatctcagttcttgctgtgtctgggcctggcagagtgctctgagagtcaggcctgagcagagtggtgggaccaatccacactgccaagggggcctacagtggggagagggggctgcatggactttaggcaaaggaggaggctgaaatgcccggtaatggggagcccgccgagggttgcccagcctggctgtgtcctgaccaccagcccaaacctctggtacctggcaccyactccccagcaagggtccccttactcacaggcagtcctggggggcccgtggcacctgggtaacctggttgccctggaggaccctgcaaagaaaggcagacatgatggatagccccccaacatttctgttctcccctcgctgggtaagaggatggccaaagctaaaacctctggggctgccatctagcaggtgccagcctgccccagcattgcacactgggccatctccccaagccccaggtcccctcggtcgtgaccaccaccacagacctgggctggggaggcgaaccccagcctggcc

SEQ ID NO: 23416 - DNA, 601 bp, Human
gaaaaagtgggtgcccctgtcctcaaggagctcacagtccagtgagggtcatgggcccaacacaaccaggggcaatacaacagtctaagtgttctgtgtggaaaggggctcagggagctcaggagcggggagcagttccctctggctggggatcagggaaagtgtcacagaagtgtcaccagatgctagactctgaggatgtctgggattgggcaggtggaggagaaaagtgcatgccagagggaacctaagagaaggataaagacttgcaagtgggcacatgcctggcctggccagggcrtctgggggagcctgtgggatgggctggcaggcagaagaggctggaagagtcaccatgatgagtgggggccctgaacgctgtgctaaactttatcgaacagtcagtggtttttaagctgtacttctcagagcactggggcttctgggggagcctagaagctgggggcatgaagtggggactgaagagagggactctaggacccccaccgttgtcttagccagggaatctccgcttgtatttgttttatagattgaggtttttacatttgcttttatgtgataaaaagactctgggactaca

SEQ ID NO: 23417 - DNA, 601 bp, Human
tcagctgtcttgagtttctgcatacatcatgccttcaccatcctgcctttggtgagacctagctcgcctaacctgcttaaggccactaggagaactgggaagccaaggggctgtggtgccatcggggagctggggtagagggagacagaccgagggagggcatgggtgccccctgacaaagacggggatacttcggttctttccatcagggttcccttgactttggctcctctggcaaaaaggagaggaaggggtgcccgccctcccagcccatcatctcaccctcaagccaggcttgccrtccttcccatccaaaccatccagaccggcggggccctggaaacaggaaagaggcatttctacatgctggtgcgggagccctaggaggtgggaggcctggcccaacccctcaattctctccacccctcccctgactcccacctcagcacacacacacaggtgcacacacacacatgcaccacacacatgcgcatgcatcgcacacgtctgccacgctgaaagggcacacactcacctgaatcccaggaggtcccggtggcccaggggagccaggcaggcctgatgggcctcgaatcccttc

SEQ ID NO: 23418 - DNA, 601 bp, Human
atgtccacaccctcattcttcctgaagcccagcctggtttcctcagctgtcttgagtttctgcatacatcatgccttcaccatcctgcctttggtgagacctagctcgcctaacctgcttaaggccactaggagaactgggaagccaaggggctgtggtgccatcggggagctggggtagagggagacagaccgagggagggcatgggtgccccctgacaaagacggggatacttcggttctttccatcagggttcccttgactttggctcctctggcaaaaaggagaggaaggggtgccygccctcccagcccatcatctcaccctcaagccaggcttgccgtccttcccatccaaaccatccagaccggcggggccctggaaacaggaaagaggcatttctacatgctggtgcgggagccctaggaggtgggaggcctggcccaacccctcaattctctccacccctcccctgactcccacctcagcacacacacacaggtgcacacacacacatgcaccacacacatgcgcatgcatcgcacacgtctgccacgctgaaagggcacacactcacctgaatcccaggaggtcccggtgg

SEQ ID NO: 23419 - DNA, 601 bp, Human
cagagaagccctgacccagtctgccaggcaccagtggccccaggaggctctgatgctgggatggcctctctgcccaggataggctgccatgtatgcctgggggcaagccttcaggagagcagagataacctgcttggcagaggtcaccagcccttaccttaggtcctgggaggccaggatgtcctgttttccccttaaagccctgaaagaaaaagcagggagttctcatgtccctcatgtcagctgggggcctcttcccactcctccttcctcagttcaaacaattcaaaccaatccaaartcataacacggtccacggaggatctggatttgagctgttgcagccacccaggcagaagctgcaacttcgcagcttccaactccttcctgcagctcaacttaccggtggtcccatgagtccaggggggccagcaggaccagggtccccctagggaaagagacgaggaggattgagacaagagttttgcccagcttgtatccaactcatacctctgtcctcccctctctccagccctccccagctatcctaagatggagggaagaatccaagcctggctcagcctctgactggctgtggatc

SEQ ID NO: 23420 - DNA, 601 bp, Human
attgttgcttgataaatgtcctctccaagtcaccccatcttgggaaacacaccacctatttacccagttgcccaagtcaaatgcaggagtcacccctggttcttctctttctgtcactctgtctccccaaccccaatccagctcatcagcaagtcccccaagcctggcatggcacaggggctccacaattatttgttgactgaatgacctccatctgataagtgaacttgaatgtgcccagaaaataagaaaataacgaaaagcctggaaaccacagaaggagtggcccccgtgctcccayggctggggcagcccctatggcaagttctctcaggtcatgacagcctatgcaccaccaaccaccccgccaaaatgctaactcttatggagacagagacaaaagtggttcaactcacaacgtgtcccgggggaccgggtcttccctggggtcccatggcaccaggttcaccctgcaggagccagaaaaaggaaaaaatgacactgaaactgacttgcttgcaccatgtggctgtcggatgggagggggctgggcagaatacatggtaatgccaatggccaaaggagctgggccaattcccag

SEQ ID NO: 23421 - DNA, 601 bp, Human
ggctgcaacaaaatgccagtatcttcgcttttctctggagtcccatcagctcagtgccgtcacactgatcaaaggcactgcctggcagtcatctatgttagtgatgagtaaagtagacaggaaattcattgttgcttgataaatgtcctctccaagtcaccccatcttgggaaacacaccacctatttacccagttgcccaagtcaaatgcaggagtcacccctggttcttctctttctgtcactctgtctccccaaccccaatccagctcatcagcaagtcccccaagcctggcatggcrcaggggctccacaattatttgttgactgaatgacctccatctgataagtgaacttgaatgtgcccagaaaataagaaaataacgaaaagcctggaaaccacagaaggagtggcccccgtgctcccacggctggggcagcccctatggcaagttctctcaggtcatgacagcctatgcaccaccaaccaccccgccaaaatgctaactcttatggagacagagacaaaagtggttcaactcacaacgtgtcccgggggaccgggtcttccctggggtcccatggcaccaggttcaccctgc

SEQ ID NO: 23422 - DNA, 601 bp, Human
gcctctgttctattcatctccagtctcctggggtggaagtgtccagcacagagactgccacactgcaagacgaaggggctggacacacggaagagagaggcggaaccctgcaccccctcaacctcagccctactgagtctccaatggggccacgcttctgagtgcacctccccgtgtcatctgtaatgtgagggggaaccaggcttgatatggcattcccaatccagggcctctggaccccttgagatgcataaaaatagtgatgggggcctgagagttctttttttttttttttttttttggtcatgaactatttttaacatttccgaaagcctcctggaaattattatgcagccagccacaacagggctgcaacaaaatgccagtatcttcgcttttctctggagtcccatcagctcagtgccgtcacactgatcaaaggcactgcctggcagtcatctatgttagtgatgagtaaagtagacaggaaattcattgttgcttgataaatgtcctctccaagtcaccccatcttgggaaacacaccacctatttacccagttgcccaagtcaaatgcaggagtcacccctggttcttctc

SEQ ID NO: 23423 - DNA, 601 bp, Human
ctgctccaagttctgcatttttgccccctgcccactggccttcctgtgtctcctctctgtggctaaagccgtaacttgcagctgggcttcatccactcgtgagcttctcctctcaagcccagccagtgcccactcaccttgggaccaggaggtccatagaatccctgctttccagggggtccctagaggaaagcaaaagtcagaggtgaagtccgggcagcatctctgaggctccctggggaggcaggtgcagtgaagaggccccttccacagcctgaggcccccaggtgtgtccagcccrgctctgtgtgagaaaggagcgcagcctccctgcccagctggaagggaaaataatgtcctctggggcatggccttgtttaagcatgttggctgggcccccatcacagatgaagagaggcgagaagtcagaatgagagggccagtctgtggcatactggggggcctggaaagacctggtacccaggagatgtttgtttggaatttattattatcattattattgttgttgttgttgtttctttttgaccaggtacagggtttaaaaaaaaaaaaaaaaaggtaaaacaaatctcactcccat

SEQ ID NO: 23424 - DNA, 601 bp, Human
cagcaacctccgtagattctcaatccaaagtcctaaccacccagatatgatacaaaacattttgttcttaagtgcatttttctggggagagggtcctatcatccccacccttccgcacacagttaagagctgccctctatgggagccaggctctttcccacagaatgtcagcaggagcttggaagatgatccgagctccaccccacatgcctgctctatgggacagtgcccacagctgccagccttcccccttaccatggagccaggcacaccaggcaagccagggctccccgaaggcccyggagctccagggtggcctctctctcctgcagggcccggtggcccaacaggccccatggaaccactcttgccaggtccaccaggcatgccggctctccccttctctcctgcctggcccttctgtcctgcagctcctggatcaccctacaaagatagatacttagtgctgtcaaatttacatcatgatgtctcaccaatctgctcttttctctccaccctcccaccaggcccccagcgtctccctctagactgtggccacagcatcctgacaggtcactccacctcactgccccagagtggt

SEQ ID NO: 23425 - DNA, 601 bp, Human
agaagaaacagaaagaaaaggggtctctgctgctctggattcatggtctcaaatggtggtatttcctacctggggggccgggaagaccattttctcctgcaatgccaataccaatgtcccctttttcacctttggtaccaggcaatcctggaacaaaagaaataaataagtcctatccctgagcagaaaaatgacacagccagtcagattacttgaaacacacacacacacacacacacacacacatacatcccatattcacaacagacctcatggaatacttaggcctgccccaaagaaytacatgtgtcccttgggaactgtagggcagagctacctcttactcctggcaagccctgccgtccttctctgccaatctgaccagggagcccaggtgaccctggagcacctggcctgcccggagcaccatccttccctggaggccctggtcgtcccggagctgccgccatctccatggggaactgcatcctggaggtgtagtaagccattctctctgtaaaaaaaggacaaggacagggacaggtcagagggtcccccagggactcagaatgactgcagatgctgcatataggccaccagc

SEQ ID NO: 23426 - DNA, 601 bp, Human
accctttattttttaatttttatttttcggagactgagtctcattatgttgcttagactggtctcaaactcctgggctcaggcgatcctcccacctcagccccttgaatagctaggattacaggtatatgcccctgtacccaaaatgcccttttttgttcctgggactaaacgggaaaaggagggcaacagggagctctggctgcagcaccagaggaacccactggaagggaaagggcagatagttttgtttctttattatttaaaaaatattaacagcaattaaaaacaacaacaacaamaaaaaaaacattcacaacctgtcacagagtcctataagctttggccatttattcccaacggagtctttcatccaaaggcaggtggggaatttcagccaaaaggccccttcatggttttcatgggtgggtactgctgctccatcggcatggccccaaagcagtcagagggattacagtggccagccttgcctggctggcccatgggacccgggggcccagggatgccagggatgccttgctggcccattggtcctgttgcacccatcttgccatagcctggaggaccttgaggacctaggg

SEQ ID NO: 23427 - DNA, 601 bp, Human
cctagagaacaaggtctgtaatcttaaaaaagttagatatatctaaatttgatggctgcacgttttcttagtttattatgtataaacagtttatagtttatttcttagagtttttgcaagaatgagatccagtcttggacctcaatctaagaagattgagtgttctatgtcctgtgtctcattaacttctcacccaaggatagaattgatcccgggctaggcgcagtggctcatgcctgtaatcccagcactttgggaggccgaggtgggcagatgacgaggtcaggagatcgagaccatyctggctaacatggtgaaaccctgtctctactaaaaatacaaaaaattagccagatgtggtggcacacgcctgtaatcccagctactcgggaggctgaggcaggagggggaggttacaatgagccaagatcatgccactgcactccagcttgagcgacagagcaagactttgtctcaaaaaacaaaaaacaaacaaacaaacaaaagaattgatcccacaatttgaggctaaagaatatcacgtgaatccttataaaaaggatataggtaaaaaccgtggtattacagtggtttcataatt

SEQ ID NO: 23428 - DNA, 601 bp, Human
tagctcaagaaacatgttgtgaaatatcagatactaaggtaagttaattttctttgcatatgaagaatgaagaacgccaattatcttttagtggcatagtttgtagagtccaaatgtagggtagcactgagtgtgttctgttgaagccaggtgggtaatttattcctagtaaggaagcattcatagtgctttctcatggttactttcaacagttttaatcccagcatttcacccttaattttgagggtaatatatactcactttgaactcagtataacttaaagttatgcctttcttcctraactatgttctgacagcagcatcatttccagttacagaagttttaaatctgtgatcatactttattctcactcattttccttttctaccctgtcacccatcctggctagctttcctttgacatagacttttcatccttatcttccattttcctgttactgccaaagtgtacatttacctcgtgtctgggatatcaatcattattggatcaactgccttccctatgtcctgcccctttgctttgcagcataaccagaataagtctgagtcactgctttgtatattcattcactctcttcca

SEQ ID NO: 23429 - DNA, 601 bp, Human
tttggttagtaagaagcagttcttgcaggcaacctcagcaatccctagtttagtgggagccagtgtttggaacatgagaatgtttggaattgaccccatttcctaaagcctctttttggattttagtgcccagagcaggatggctttggaaatattgcatcatcatgggtaactgctcatgccagtaaaatgtcttcatatctgccagcaaagcaggaacttaaagaccagtgccagtgcattccaaacaaggtatgctagttttaattggtgcacactgaaagccactccagactatgarcccagctccttgaatgtggcctctgttcacagaatgtgtcttgccattcagtgtttgttgaagtaaatacctcagttactggggtgggttaagaaaaaggcattgaagataggacttcctggattcttacctggatagtttcaagcccatctgaacttccttccagggtgtgaactagaatgaatagaaaagtgaagggaggaactacctgtacaacaggcaagtactgagtacttagcatgtgccaggaataggctgaagttctgggaattcacagttgaagaaaacacagtgcctgct

SEQ ID NO: 23430 - DNA, 601 bp, Human
acggcacagatgttgcttatcattttagtgccagttgtctctatttctctctatactacaaaaggaagaatgagatttggaggttcagtaaattatgatttattttgttactaatgacttgttagaaattaaagctttctgtgaactgtgtattggttatattctttctacagggtttgaaaggtgacttgggtcctcatggtccacctggcccaaaaggagaaaaggtattgtgtttacccagccaagcccaacctttctttaagaaaactctgacaacctatgcagtgacttctcattsatactgtttatctcctaaaagcattctaaaattaaccaaaagctgttaccttaatagcatctgaataagaacagcctttttgttcatttaattagtttgaaaagactaaatgcacaattgctagttgacattagcttgtatttataagatttcccttttctcacccttgcttaacagcatgaggtattcaatcatcaaattagcaagtgtgacctgtattggaaaactttgccaataacactgagctgctgccataatggtgaggcaagtggcttttggaaagaagctagttttgtatct

SEQ ID NO: 23431 - DNA, 601 bp, Human
cccttgcttaacagcatgaggtattcaatcatcaaattagcaagtgtgacctgtattggaaaactttgccaataacactgagctgctgccataatggtgaggcaagtggcttttggaaagaagctagttttgtatctcagtcttaatttaactattccattttctgccactttttctcataaaataagttatttcataatgacatgttggcaatgatcttgaaaaggaaattaagaaataggaaaaagcaagggttgttttgaataaagtagttgggtgatcccagtttgatgaaaattgkatgtatatgtgttttgcaatgcattttgttctccatttttagcacatttagaaatccttgtctatcttcaatatttatctctgtgttaaaggtgatcctgcaaatgagtccccagtgactgatttaagccacttcagtgttcccttagcaactgttggctattttaattcaattgttccaaaaaacaatgaatacacaatgctaagttttaacttctgaggtggctatattggttgagaaaagagaaagtcctaaagatactcaatgtgagactacagcatcctggtaccccacgctata

SEQ ID NO: 23432 - DNA, 601 bp, Human
ttcagtatcttacaaatctagggttttatcctaataagttttttaaaaattttgttcaaagattgttaatgcaaaacattgtgttccaccatcaataatatcatagatctagcctctctgagggcagaaagaaattatttgatactttgaagctctgggtagcacaacaggtgatagacttcttatcaaaaccaataggtgttgcgccaaaatctcaagcaaatatttgcatactacagttcaagaatgagagtccccacctttcatggggaattacattcaatttccccacggtttttttaaatcacatttgggataggcggaatgctgacgtggaagtatccaaatggcaaaagcaagggagttttgttccagattctacaaggagcataatagagtggcagccaagagaagatctaggtgagatcattgattgattcatcattcaatgacaaatatttggggtctgatcactttgtgtgaggcattctgtccactgattaggataccttgtatacataatggttcatcattgatttcttgcaccacagaaagaattggagacacttccctttatgtctttcttttccatgttcttact

SEQ ID NO: 23433 - DNA, 601 bp, Human
aagcaactacccatgggagaatgagtaacagactactcataaactgcccctcctcattccgagctcagagagcccatggttcattttccggtcccaggatcctcacttgccctctggcccccatataggaactgatcttttcctctgctattttccttatgtcatctggagggagaagctcaggtatgagaaaccctctctcctcacagcacaaatccaaaaagggatggagaaggaaaaaaaaagcaaatgaggaagaaaaaaaaagcaaatgaggaatagagagacagcctaaggagtraggtcaggaagatggatatgagtgtgtttatgtggatttttgcatgcctacttatggatgcaaagaataaaaggtagatttctctctctatcacaaaaataatgtgcaaaacagctgctcccattctgcaagattgttcgcaaagaagcaacaatgctgagcatattcttcccctcaaggaaaatctgctcatgttccagtaaactgcacttcattgtttccagctctgggggttttaataaaaatttgataggctctgtcaactactgaagccatcagacccacagttccttactacac

SEQ ID NO: 23434 - DNA, 601 bp, Human
cagataactaagaggttcggctttgagccagccttaggccttattttcaagtgagcacagctttcctagcccacatattatgttttaacttgctagggctgccacaacaaaatatcacaaactgagtggcctaaacaacacaaatatatcatctcacagttctgggggccagaagtcaagatgaaggcgttgtcaggaccacgttatctccaaaggcactagggaggaatatcttccaggtctctctcctagcctctggtggttccttggccatcttcacttcaaactatagcaatagtgrtctgaatgggtacctctgtatattttgttgtctaaatatttctgtaccttttaagttttctatcagcacatgtatttttaatcagaaaaataaacttaatggaaaaaccacatgattagagattactggctcatttgcccaacagatatttattgaatgccaggggaggctttcatgaatggcatttcataatagttgagacttgattaatgactagtttctggccagacaaaaaggtgagggcaaagagtggtgatctggaggctgagatgggaatgaccttggtcagtttagggagct

SEQ ID NO: 23435 - DNA, 601 bp, Human
atcttatgtagagaatatgtgtgtcaggaaagcaagagtggattgtaaaaggccagttagagactcactgcaatcctggcaagacatgatggtgggctgcctgggtataggcaggttgactctgtctcttaagagaagagaaaacatttggggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcatgactcacacccatgattcaattacttcccactgggtccctcccacaacatgtgggaattgtgggagctacaattctagatgagatttgggtggggacacagccgaatcaagtggtattgagaatgacactcagagaggaagagttcaggttt

SEQ ID NO: 23436 - DNA, 601 bp, Human
ttggggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcctgactcacacccatgattcaattacttcccactgggtccctcccacaacatgtgggaattgtgggagctacaattctagatgagatttgggtggggacacagccgaatcaagtggtattgagaatgacactcagagaggaagagttcaggttttctttctttccttaattgttttcaattgtagaatggaattcctgctcaatttaacaagaaaaactccagagatacattagaaaaaactgattctttttctcccatttctgtactaaacaatgttagcagcgtgatgtaactctattt

SEQ ID NO: 23437 - DNA, 601 bp, Human
tggggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcawgactcacacccatgattcaattacttcccactgggtccctcccacaacatgtgggaattgtgggagctacaattctagatgagatttgggtggggacacagccgaatcaagtggtattgagaatgacactcagagaggaagagttcaggttttctttctttccttaattgttttcaattgtagaatggaattcctgctcaatttaacaagaaaaactccagagatacattagaaaaaactgattctttttctcccatttctgtactaaacaatgttagcagcgtgatgtaactctatttt

SEQ ID NO: 23438 - DNA, 601 bp, Human
ggggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcatgactcacacccatgattcaattacttcccactgggtccctcccacaacatgtgggaattgtgggagctacaattctagatgagatttgggtggggacacagccgaatcaagtggtattgagaatgacactcagagaggaagagttcaggttttctttctttccttaattgttttcaattgtagaatggaattcctgctcaatttaacaagaaaaactccagagatacattagaaaaaactgattctttttctcccatttctgtactaaacaatgttagcagcgtgatgtaactctattttg

SEQ ID NO: 23439 - DNA, 601 bp, Human
gggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcatgactcacacccatgattcaattacttcccactgggtccctcccacaacatgtgggaattgtgggagctacaattctagatgagatttgggtggggacacagccgaatcaagtggtattgagaatgacactcagagaggaagagttcaggttttctttctttccttaattgttttcaattgtagaatggaattcctgctcaatttaacaagaaaaactccagagatacattagaaaaaactgattctttttctcccatttctgtactaaacaatgttagcagcgtgatgtaactctattttgt

SEQ ID NO: 23440 - DNA, 601 bp, Human
agatccttgagaaagacgttcccagattgtaaaactaacaggaggcttttagaaagatttacatctcaaagggatagtgaaagaacttacaaatacagattttctaaagcgattggtctagaaaaagagagatcagggtatggaattaggaacaagcctgtccaaagttgattccagctgagggaaacattaaggctgtcttggtcagtggacgcaaaaagcactaactacccttttgagaaaattgtccagaaatgggaggaaagagagtaacttaagggaaatgtgtgctggggaactrtatgctctttgtgtgttaagtttaaagaaggtagaataggtaggtagtcagagagagaaagagaagtgttaaagaaattggccaattttagctacattttacttaactttaccaaattggccaatttcacctgatagcaataggtaacattaataaggaaaatctcctaagaaggcagaaggcatgggaatcagaggatttatagaggaaacagccatgataagagatgagacagctcattaactacacccagatgtgcatgcacatgggttggtacattcattggcaggaattagaagt

SEQ ID NO: 23441 - DNA, 601 bp, Human
gtgtgctggggaactatatgctctttgtgtgttaagtttaaagaaggtagaataggtaggtagtcagagagagaaagagaagtgttaaagaaattggccaattttagctacattttacttaactttaccaaattggccaatttcacctgatagcaataggtaacattaataaggaaaatctcctaagaaggcagaaggcatgggaatcagaggatttatagaggaaacagccatgataagagatgagacagctcattaactacacccagatgtgcatgcacatgggttggtacattcattrgcaggaattagaagtggtgactgaagcctggcgcagtcgctcatgcctgcaatcccagctcttacggaggcagaggcaggaggatagcttgagcccaggagttcaagacctgcctgggcaatatactgagacaccattctccacaaaaaggaaaaaaataaaataaaataagtggtgcctgagaacttgcatttttttcagtgtagttacaggcaaggtcacttgcccaaggactgtagagtctaatgtagtggtctgagaacaataaagaagacttgagaatagggagagcagatcaga

SEQ ID NO: 23442 - DNA, 601 bp, Human
tgtaatgaccttggattccatgtgaatgtgccattgtcagaaaaaaaatgcacattaaatctacaggcagagatgagtagtttgaaaatactctgagggaatgtggcctgtgagtgctactttcattcattcacctgtaaaaattctctagattgagggcaggggattttgacatgaatccaagaaaatatgacttctgtgtcttataaatcagtgcaaccaatccattcaaaaagtcgtacacccatcaccagaagttactgctaaaagatagtctcaccagaaactaggagcttcttayagattgatgattgaaaatgaaattttctgctaaataaataaataaaggcttgacattctgaaaaagacatccaaaaattgattatacagcaatgataagtcatttgtgtgagttagattttattgctagtacattaacattatttcctgtaacctaatagctaacagaaaccatacgccaccataaccaacgcattacattttaagcaatgacttctggacatatgcaggctaaggggaaaaaaaaggaaaagaaagccacaaagcttgtcacataggacagctgagcaaagaagagtgt

SEQ ID NO: 23443 - DNA, 601 bp, Human
gtcacataggacagctgagcaaagaagagtgttgtgacttttaaagtatttaaatgatgattcatttcttgaaacaaaacagctgggttctgttttgctgtgttcattaggaaacatatgttacttagacattcttaagacctcactgatgagaaatttgattctgtaaaacaggtgtgtttcaaactctaaggaccttttctattgctcaaaatcttttctaattgcttcagaatcttaagtagaattaggaaaagccagtggcataactgttccctcctctcactcaaataaataacayagaaaagtctacagggaacttgatgcagtacatgatataaagagacacataaaaaaacttttaaaaagcgtgattaacaggaaattgccaataaacaatgcataaaataaacaaaaattacaggtggtagctcgcacctgtaatcacagcactttgggaggccaaggcaggaagaacctttgagcccagaatttagaccggcctggacaatatagtgataccccatccctacaaaaattaaaaatattagctgggcatgctggcaaacacctgtggtcccagcttcccagggaggctgag

SEQ ID NO: 23444 - DNA, 601 bp, Human
ttctgttttgctgtgttcattaggaaacatatgttacttagacattcttaagacctcactgatgagaaatttgattctgtaaaacaggtgtgtttcaaactctaaggaccttttctattgctcaaaatcttttctaattgcttcagaatcttaagtagaattaggaaaagccagtggcataactgttccctcctctcactcaaataaataacacagaaaagtctacagggaacttgatgcagtacatgatataaagagacacataaaaaaacttttaaaaagcgtgattaacaggaaattrccaataaacaatgcataaaataaacaaaaattacaggtggtagctcgcacctgtaatcacagcactttgggaggccaaggcaggaagaacctttgagcccagaatttagaccggcctggacaatatagtgataccccatccctacaaaaattaaaaatattagctgggcatgctggcaaacacctgtggtcccagcttcccagggaggctgaggcaagaggatcacttggagccaggaggtagaggctgcagtcagctataatcacaccactgcaccccaacctgagcaacagagcaaga

SEQ ID NO: 23445 - DNA, 601 bp, Human
tcacagcactttgggaggccaaggcaggaagaacctttgagcccagaatttagaccggcctggacaatatagtgataccccatccctacaaaaattaaaaatattagctgggcatgctggcaaacacctgtggtcccagcttcccagggaggctgaggcaagaggatcacttggagccaggaggtagaggctgcagtcagctataatcacaccactgcaccccaacctgagcaacagagcaagaccttgtctcaaaacaaccaaccaaacacaaacatgagcatagcagttgctggaagggtgaaatcaactctacctatgtaagtctacttagtatctcttctgaatcaatacattagtttttaaaattataatgtaatttaatgtaatgtaagtcaccacagtgaaaatttaaagctccatcaagctgttctcagagatctctgttgcacctgtggcgaaccccagtgcttctgaatcctggctgcacattggaatcacgtggaaagctttgacaaaatacccacactcaggctccatccacagagactccgatttagggtaggggtcttatctctatttagaagtgtttcagatgact

SEQ ID NO: 23446 - DNA, 601 bp, Human
atagcagttgctggaagggtgaaatcaactctacctatgtaagtctacttagtatctcttctgaatcaatacattagtttttaaaattataatgtaatttaatgtaatgtaagtcaccacagtgaaaatttaaagctccatcaagctgttctcagagatctctgttgcacctgtggcgaaccccagtgcttctgaatcctggctgcacattggaatcacgtggaaagctttgacaaaatacccacactcaggctccatccacagagactccgatttagggtaggggtcttatctctatttrgaagtgtttcagatgactctaatacacaaccagggctaagaaccactgagtaataggaagagcatgagctttgggacaaaaagttgattgtggcattaacagctaggtcaccttgggaaggccacttcatttctctaagcatgcatttcctcattcacaccatgggcagaattgtatctacacaaagagttgatagaaggattaaaattaaataagaggaagttactcaaaagcgcaataactaaaacacatataaagccctcactaaagatttgttcttttctattcacccatctcaat

SEQ ID NO: 23447 - DNA, 601 bp, Human
caagtctaattgtttattttctctatcaaaccaacaacaatttgttcctaaatgtatcccccaacttctcccttgccttaccttgaatataatttactatgtctaggaaaaaaaatggcttctcttataatgtggtaagaataagactgatgatacacaggatgtttagatactaccatagaaaaaaacaatacttacgtagcttcctctgaattaggaaaaagcctgtatacagcacactaaactttaaatttgatggatattgcttcaaaaggcacattgaatatttaaattaagaacrtgagtgaattcagagaaaaaataagctacatatatataggtggtatgtagacatagcgaatattacacagttgggatgcggatgactgaactttgggaaacactgctgtagaatatttgtactgacaggtctgcaagttggcttcttatccatttggttccttggctctccaacagggccttactattactagctgaaagcctaatggtataaaaaattagtactgaggtgagtcagaaaagcaaacacttctttcctagtatcaactctcacagcacaaaatacttctatgaccaaata

SEQ ID NO: 23448 - DNA, 601 bp, Human
gatattccaggctaatggacttccatgcttctgaaagagttcaggttctggtcatgtcccggtcttcttggttccacccagggggtggaattgttggttccagctgttgttacaagtcaaagctttttctgttatgcgtgcctaggctgcatgacttgcagttttgggctctgttataccttaaaggtaacttgacattttgttatcaacagagtaggccctgtttgggctggttccacagttatactatcacatgaggttttaaaattttagtaaaattaagattaaattaaacaaaacrtattccataaatctagaagactaattaatacaaacatgatcttgtctatccattacagaaaatcacaagacatggattaggatatacatataaaaataagccaaagattttagggctgtagtaaatttatacttgaagcactttttggtagctgtttgaggcttcaaaatgaacaattaggcacatccacaggggtcaggattagagatgttcactgcagccttgtttataatagagaaaagctgattacaatcaaagtgcccatcggtggggctgagataaacgctggtttattaacat

SEQ ID NO: 23449 - DNA, 601 bp, Human
agtagcattataaaccctggaaacagctgagagactcgttttgcttcatataactgctgactctgcccacctaaacaaagaaaaaagtgcctgaaataaaatgagtctggattattgtgccagttaaacagtctgatgtctttgagatcacacacaaaaaaaattggttttggcacaccagaacaaaattataatttttctcctctagatagatattctttcctggaaaaataattaactttgtttcacattacatttaagtatcataatgaaatatatggatttctaaaagacataaagycattgtgaagtactgacaaacacattatcataaaaatagcctaagtagattcagaactttgcattgtctgttggatgctaatagataaattgtatagttagcaggagagcaagcaatcattctgtatctgacagtcacaataatgcttctctaaccatctgcaaaatctctcttctgctttgtcttgaaagggtgaaactggactaccaggatttccagggtctgttggccctaaaggacaaaaaggagaacctgtaagtattttagctttgaggacagaggaagaatatctaaaaaacg

SEQ ID NO: 23450 - DNA, 601 bp, Human
ccacatgatgcatggaggaccctgcagtaagattaataaaaattttactggaaaatcgaggatttttagagcagaaaggagaaactttcagtgagttagagcggtgcttctcaaatgtgaacatgcacttgaatcccactgattctaagtcagtaggtttggaagcaggaccagagagtctgtgtttctcataagctctcagtaatgctggtgttattggtccatggaccacactttaagcagcaagggttgaaggagttcatagttcctaggagtcataggccttttcctcctgcagggwtttcctctggctttctttctggctaactttcaagggcagtccatgtatctcatgaggactgcctttagccctgttttccttaaatagagcttcttttcctcctaactcttctccataccaggtccctattcatcccttaattatcccaccaccccatacatctttacttgccaccttcctctacccctacattaaaacaacgcaaattttacattattacggagagcagtttagctttttatggtctcaaactttctcttccagaacaggatgtagactttactttgcataataatcaga

SEQ ID NO: 23451 - DNA, 601 bp, Human
aaggcccaaacagaagagtagtattcattcaaaggtaaattctgaaccactgatcccgaatggtaactaaaatggcaaattttcccccaccataggacattcagaatatggtttgatgtgtaacacatcagagctaaaatatacttaagatcacctagttgaaccccatgattttatagataaagaaaggggagctctaaaagattaagtgacttgcctcaaatagtagccattggagccaggactaaatatcaagtatctagacaactaggctcccgggtttttctctttttttttttttcttttataaccagttactttagtcaatgtggccactaaactttacagtggctgtaaataagcaatgacatgagcagtgtcatataagcaaaaacaagcagggaaataagaatataaataaagccttgatctaatatatagaaatcaaccactattaagatagttcatcatgttgggtagatatgggtatatagttgtcccttggtatctgtgggggatgggttccaggactctcagaggataccaaaatctgaggatgctcaagtccctaatataaaatggcctatttttatttgcatat

SEQ ID NO: 23452 - DNA, 601 bp, Human
ttataactatgtcagctaagtagagaatgcagtgattgctaatgggacatgataattagtgtcaaaaatggcattgggggaaaaattattataatgaagaaatcaagaaagtattatttattagtagtaagtattttgaatcatgttttagaatgaactctccttgattttattgtgtcttccataatttccctttttattgtatgttaattagtagaaattcaattaaagtatcagagatgtccatttccatctgaatttaagcattacccttatagtaattattttatttacagggagracctggggtaataggatcacagggagtaaaggtaatttcctggcattcttcaatttcctctccaaccttaatgagattatgaaaattaaagaaacattgatctttccttccccccacgtgtttagggtgaacctggagatcccggaccccctggtttaataggaagcccaggactaaaggtatataagaaataactaagatttcttgggaaataatttgggaattgtagccattctgtgtaaaacatggtgctttggtatgccactcattttcttcacaaatgctctccaagactttatc

SEQ ID NO: 23453 - DNA, 601 bp, Human
tcacaatagcatccctaaaagccttaagagtaaacaatgtgagctaaatctacgaccttgagctatattctaaaaggaacagaattcaagtttcagtttctaaaccaaaattatgcaacgttgagttgcttgagtttcccaagtgggattccacaggagtgtcccaagagagcagcttttggaaaatgcaggagaaattaatgtggtgtactcccagacaatgggtagggcaagttaccaggtatcacctgctggtgagaacacataaattaaaagtatctggaaactatcttggtaatcrcaaagcacatttcagtattatacagataaagtgggaaagtgggatggtggaaagttggtcttcctatacatgaagatcacactattctttacaaatactcaggtacaatctatctttttttttcttttttagcaaagctaaagtatataccaccttttattttagggtcagcaaggatctgcaggctccatgggacccagaggaccgccaggagatgttgtatgtataatgtctttgatatttctggaattgaaattgagactaggacatgtttttaaaaacatcaacatgtgttcaagt

SEQ ID NO: 23454 - DNA, 601 bp, Human
tcacattctattctccatgctcaccgcttgagcctctcctgtctactagtcggtgcacatattctgcttggtactttgaacacccagtttatagagcaaagcttttgatcactcccctatgccaagtaatgggccactgtagataaacctagtggacagatcttatgaaaagagagataatcctggtggcacaagtggagccacaatgctcaaaaactgagactaagtgatagtggccagagctataaaaagaacaaaatctaaagggaaagagccactgtttctaaaacatagtaaaaayatatttttctagttgccctagagttctttggaatcattatgtgatgctgccaaccaccatccttcctcgatggcaataatatgggtgagacgttcggttcaattcgactttagtttctttcctatggcatccaggtggcttcacttgaaacaacaaaccacgtagaatcactaatatttttccaggtcttaaaggccaaaatcaatccaactccttctattaataggttatatgttaaaattctgttctcttgacagagattcacagatatagggaaatgttattgtaagagatgttctc

SEQ ID NO: 23455 - DNA, 601 bp, Human
aggcatgaattaggtactcaataaatattattgagtgagttggtgagtgagtgagtgagtgagtgaatgaatgaagtttgactggctatgatgacaacttaaaacaatggaaaccactacctcctcacttcccaccatgaacctgagcatcaaagtaagaatcttaccttgttttctacagggagatccgggtgggatcataggccctcccgggcttccaggtccaaaaggtgaggctggtcctccagggaaaagcctgccaggggaaccagtaagtattagcccttttgttaatatttttcttgcaagttcattaattactacttgtgggttcctagtttcagatcacaagtatgggaataagtttaggtctgcaaaaaaaggaaaaaagaacttaaaacagaactaccatttgacctagcaatcccactactgggtttcttttcccaaaagaaaataaatagttctacaaaaaagacagatgtattcgtatgttcattgcaactctattcatagtagcaatgagatggattcaacctacatgcccatctacaatagactagataaagaaaatgtgatacatacaaccatggaatactat

SEQ ID NO: 23456 - DNA, 601 bp, Human
tgggtagtgggatcattcacacaataaacctgagcaacatgcaatttactcatgtaataaacctgtacatatacccctgaacctaaaataaaagtcaggggaaaaaagaaatattcatctattcatcttattgtttcttttttttttttttttgagacagggtcttaatctgtcacccaggctagagtgcagtggtacaattatggatcactgcagcctccacctccgggattcaagtgatcctcccaccccagcctcctgaatagtggtgacaacaggcacacaccaccaagcctggctratttttatattttttgtatagatggggtttcaccatgttgtccatgctggtcttgaactcctgagctcaagtgatctacccatctcggcctcccaaagtgctgggattacaggcatcttactctataaatcagagataaaacctcttaaaagtttgataagcaaagggctttcttctgaagaaaatatacatgcatacaacattttgcatatgattttggaagattcctaggtcccctgaatcctaggcatgaattctgtagagatctatggatcccagtcaggtacactggttttaaaa

SEQ ID NO: 23457 - DNA, 601 bp, Human
ttcatctattcatcttattgtttcttttttttttttttttgagacagggtcttaatctgtcacccaggctagagtgcagtggtacaattatggatcactgcagcctccacctccgggattcaagtgatcctcccaccccagcctcctgaatagtggtgacaacaggcacacaccaccaagcctggctaatttttatattttttgtatagatggggtttcaccatgttgtccatgctggtcttgaactcctgagctcaagtgatctacccatctcggcctcccaaagtgctgggattacagrcatcttactctataaatcagagataaaacctcttaaaagtttgataagcaaagggctttcttctgaagaaaatatacatgcatacaacattttgcatatgattttggaagattcctaggtcccctgaatcctaggcatgaattctgtagagatctatggatcccagtcaggtacactggttttaaaacataaacgttcctagggcagtattgtaaaacagaaaaactacctgaaatttctcttccagaggttttgcagatatcatcatggtttgtcatttgcagaaaatgtctttgtgac

SEQ ID NO: 23458 - DNA, 601 bp, Human
tagaaaattggtctgtgtggtgtaatacaaaaacaaactaattgttttcatattatgctcttaacattcaacataaatacaattctgacaccagctgtgtggggttttttttcccctactcatcaattccccaatggacatcaactgaatgttctattagtcaattcatgtctgacactatctacctggattaagagtcagatcccacaggttaagggctcagtcccacaaaactgacccctacttcagaggccaactgcatatctggaccttcatgacttctgtccaaccagctataaaytgggagcttccatgacccccacctcaggttctatagtttgctagagtggtccacagaatcaagtaacgctttcttacgtttactggtttatgatatcagtaaaggatatgataaacgatacagttgaacagtcagaagagatacaaagggagaggtctggaagggtccctgagtgtaggagcttcagtccccacggagttggggtgtgtcactctcctggcacatgggtgttttcgccagcctggaagctctctaaactccatattttgggattttatagaggcttcatcatgtcagcaa

SEQ ID NO: 23459 - DNA, 601 bp, Human
tggattaagagtcagatcccacaggttaagggctcagtcccacaaaactgacccctacttcagaggccaactgcatatctggaccttcatgacttctgtccaaccagctataaactgggagcttccatgacccccacctcaggttctatagtttgctagagtggtccacagaatcaagtaacgctttcttacgtttactggtttatgatatcagtaaaggatatgataaacgatacagttgaacagtcagaagagatacaaagggagaggtctggaagggtccctgagtgtaggagcttcrgtccccacggagttggggtgtgtcactctcctggcacatgggtgttttcgccagcctggaagctctctaaactccatattttgggattttatagaggcttcatcatgtcagcaagattgataattaactatatttccagcccctctcccctcttcagagaacgcggggtgggctgaaaggcaagcttctaactgtggcttggtctttctggtgatcagctcctatccaggagcccaccgagagtcacctcattggaacaaaaggctctcctatcacccaagaaacccaagggattaggag

SEQ ID NO: 23460 - DNA, 601 bp, Human
aagttttattttaggttaaaccttgctttgagcaacagtgaaacccctttaaatagcctcagactcggcagttataatttgagaggccatatggtacatgacattgtattaagagtcttgtataataaaatccaaatctggcttctcagttctaagcctcacaaatcctttctacctcccacagtgtttgggccttatgtgcctttataagctatgtgtggaggcatattttggcattactttaacgccactgttgagtgaatcacttgtgcatttttctgggaatcttgcaaaaatgttrcttgggtttacacagtgtctctctgaaagaacatctcaagacgtgtggccaaaaggtagcccaagttccttcagtgtttgtcttgcctatcacttaagccaactgtaggttctttgaacttccatgagaaataactttaaggcaaacttatctggtacttttcatatttctcaacagcctgatagtgtgttcgccagaggaatgatttccttttaataaataatttatctttatgtattatttaaaaccaatgatataccagggacagcataaaggttgccatgaaaatataaaataggg

SEQ ID NO: 23461 - DNA, 601 bp, Human
ttctttgaacttccatgagaaataactttaaggcaaacttatctggtacttttcatatttctcaacagcctgatagtgtgttcgccagaggaatgatttccttttaataaataatttatctttatgtattatttaaaaccaatgatataccagggacagcataaaggttgccatgaaaatataaaatagggatgcacagtcaaaactatgatatgtgtgtttgcacattcaagagagaagaatagtgaacatttttcaaaatttgttctgaattctatcagtgccatgtgcacatttcttkatacgaaacataatgttaagccagtgattctaaagtgagacaccagaagcttcatggcattttgaggaaaaatgtctacattatactgtatgtttatattgtattgtgttcatatataaatgcatgtatttggttttatcttcttaaccacagattgcacttcctctcttgggagacatcggtgctttgctcaaggtactctattgctatgtaagaaattatgtgttaatttccaggaaaaattagaaagaaaaatatttagcagaaattgagtcaattgcttagctggaactaaaattc

SEQ ID NO: 23462 - DNA, 601 bp, Human
aaacatgtatcttatatatcttgtgccatttatcctaattctttcactctcttcttctttaccagcctctcattttgggtggggcaggggtggagggcagctggtaggatagttatgaattggctacagggaaggaattatgtcattagcactctggagtagattattctctcctctggaggaacatctttctcttaatgggtgttgactcaccctggctcactactgtgaaacctaatctttctcgctatatctggcctggtcagtcccaagatgaaaatcagtgctgctctataaatarccacttacaaggctgaattttgatgtcataggattttacaaaattccacagttgacaagtgccctaatacctgttactctgttcaataaaaatcacctctacctattatcgtctcagggaattaatcttgctacctctttttttttttatctctaacacttccctgtattttatcagtaaaacaggtagggggggatgataatggcacatatgtaagggtatgtatttgcatgtttctgcctgatatgctaagattgagtgaggccacatgaaaatcaggcccttgacttcatactcaaa

SEQ ID NO: 23463 - DNA, 601 bp, Human
gggcaggggtggagggcagctggtaggatagttatgaattggctacagggaaggaattatgtcattagcactctggagtagattattctctcctctggaggaacatctttctcttaatgggtgttgactcaccctggctcactactgtgaaacctaatctttctcgctatatctggcctggtcagtcccaagatgaaaatcagtgctgctctataaatagccacttacaaggctgaattttgatgtcataggattttacaaaattccacagttgacaagtgccctaatacctgttactctsttcaataaaaatcacctctacctattatcgtctcagggaattaatcttgctacctctttttttttttatctctaacacttccctgtattttatcagtaaaacaggtagggggggatgataatggcacatatgtaagggtatgtatttgcatgtttctgcctgatatgctaagattgagtgaggccacatgaaaatcaggcccttgacttcatactcaaacacagtgtgttgtatctgtctttgtatgaatggacgttgtgtatgtgtacacacacacacgcacacacacacagactacag

SEQ ID NO: 23464 - DNA, 601 bp, Human
tcactactgtgaaacctaatctttctcgctatatctggcctggtcagtcccaagatgaaaatcagtgctgctctataaatagccacttacaaggctgaattttgatgtcataggattttacaaaattccacagttgacaagtgccctaatacctgttactctgttcaataaaaatcacctctacctattatcgtctcagggaattaatcttgctacctctttttttttttatctctaacacttccctgtattttatcagtaaaacaggtagggggggatgataatggcacatatgtaaggktatgtatttgcatgtttctgcctgatatgctaagattgagtgaggccacatgaaaatcaggcccttgacttcatactcaaacacagtgtgttgtatctgtctttgtatgaatggacgttgtgtatgtgtacacacacacacgcacacacacacagactacagttatatatatataatttagtttgtatttctagcatttagcccagtgatttacacaattatttgcacaatagtaagcaggcagaaatatttgtttaattgaattcaaaagactcgagttccggcatatacatttgtaag

SEQ ID NO: 23465 - DNA, 601 bp, Human
atcagcatatcaatccctctttgaacgactttgtgtattggttaataattgatgcatctttattctttccatgagaaaatcttaagacatttttccaagaatgttaacaaaactcagttatttaaatttgccattctggtaaccctaacccaaagaaaatgaagtcagtttcaaatgactcttaaaaattatgtttatcataatgattatcattttttaatgtttcacttaaacagtctattgaataatctattctaaaatgttgctccatattgatatgccaaggttttgctccatattgagatgccatgtttgtgtctgcagataattatctttttcatactttttgaaatatggaaatcattttgtttttcttaagttctcaagtgtctctttatcttcatagtttttcaggtgtcagtaatagttctataaatatatatatttaactcccctgccaacacattaccacctgtgaaataatccaggtggtaaaattcatctgggaaacattgcatataaccctagttcccttttatatattcagactctaagaaagaccaccatgaagagagctttttcacccagcattttttttatg

SEQ ID NO: 23466 - DNA, 601 bp, Human
cattctggtaaccctaacccaaagaaaatgaagtcagtttcaaatgactcttaaaaattatgtttatcataatgattatcattttttaatgtttcacttaaacagtctattgaataatctattctaaaatgttgctccatattgatatgccaaggttttgctccatattgagatgccatgtttgtgtctgcagataattatctttttcatactttttgaaatatggaaatcattttgtttttcttaagttctcaagtgtctctttatcttcatagtttttcaggtgtcagtaatagttctmtaaatatatatatttaactcccctgccaacacattaccacctgtgaaataatccaggtggtaaaattcatctgggaaacattgcatataaccctagttcccttttatatattcagactctaagaaagaccaccatgaagagagctttttcacccagcattttttttatgtactttaagttctggggtacatgtgcagaacgtgcagctttgttacatagttatacacgtgccatggtggtttgctgcacccatcaacccgtcatctacattaggtatttctcctaatgctatccctcccc

SEQ ID NO: 23467 - DNA, 601 bp, Human
ccccacaggccccagtgtgtgatgttcccctccctgtgtccatgtgttctcattgttcagctcccacttatgagtgagaacatacggtgtttggttttctattcttgtcttagtttgctgagaatgatggtttccagcttcatccatgtccctgcaaaggacatgaactcatccttttttatggctgcatagttttccatggtgtatatgtgccacattttctttatccagtctatcattgatgggcttttgggttggttccaagtctttgctgttgtgaacagtgctgcaataaacatamgtgtgcatgtgtctttatagtagaatgatttataatcctttgggtatatacccagtaatgggattgctgtaacccagcatttttgagatgatttgcctcatgtattcatcagggttctctagagggacagaactaatagtatatatgtatatatgaaaggaagcttattaaggagaattgactcatgtgattacaaggtaaagtctgacaataggctgtctgcaagtcgaagagcaaggaagccagtagcagatcagtccaagtctcaaaacctcaaaagtagggaagctgacagcgcag

SEQ ID NO: 23468 - DNA, 601 bp, Human
catgaactcatccttttttatggctgcatagttttccatggtgtatatgtgccacattttctttatccagtctatcattgatgggcttttgggttggttccaagtctttgctgttgtgaacagtgctgcaataaacatacgtgtgcatgtgtctttatagtagaatgatttataatcctttgggtatatacccagtaatgggattgctgtaacccagcatttttgagatgatttgcctcatgtattcatcagggttctctagagggacagaactaatagtatatatgtatatatgaaaggragcttattaaggagaattgactcatgtgattacaaggtaaagtctgacaataggctgtctgcaagtcgaagagcaaggaagccagtagcagatcagtccaagtctcaaaacctcaaaagtagggaagctgacagcgcagccttcagtctgtggccgaaggcctgagagcccctggcaaaccactagtgtaagtctgagagtccaaagctgaagaatttggagtcttatgtttgagggcaggaagcatccagcacaggagaaagatgaaagccagaagactcagcaagtcaaccccttcca

SEQ ID NO: 23469 - DNA, 601 bp, Human
ttggagtcttatgtttgagggcaggaagcatccagcacaggagaaagatgaaagccagaagactcagcaagtcaaccccttccaccttctgcctgctttattctagccgagctggcacctgattagatggtgctcacccagattgagggtaggtctgcctctcccagtccaccaactcaaatgttaatctcctttggcaacaccctcacagatgcacctgggaacaatactttgcatccttcaatccaatcaagttgacactcagtattaaccatcacaccttgtaagcttttcagtatcrtgcaaaattagtgttccaaggagcccatgtttgaaaatcagatttacattgctattcattaggtcaaaaatattgaatttgaatagccatgggctttcttgccagcttcttatcaataacaagcttcacttctttttcatgtttaaagattcttccctttagggaaaaggatggaagaatggaaacttaagttgtcctaccttctgtcaactgttaaactatctcccccactcagtggcccttattctgtgcctttcttggtcatattcttattccaacaatttatttaaaaataagcct

SEQ ID NO: 23470 - DNA, 601 bp, Human
aaggtgagaagcctggctgaatgtttacgatccctgtgggttacatgtagtgcatcctctcagttctgttcttcctctgtcttctagggtgatatagggccacggggtcctccaggaatcccaggaagagagggaccaaaggtaagaaattctctcctccactttcccctgtgggaacctcaatttagtatgaaaaaaagaacccgatttgaaaatagacaacttttaaaatacatactatatatatatatgtatgtatgtatatggagagagagagagagagagaaagtgatgtaaaagycacttgcaaatgttgccatttatttgttccctgaccctgtccaaattacatgccccaagtgttcttagaagagatttttttcatttccaaaagataagaaaaatgattgcatgtgctagctgaatgtattgtctttttagggaagcaaaggagagcggggctaccctgggatacctggggagaaaggcgatgaggtaacagattcttttctgattatatagtcctaatattgattctctttacgtggctcaacagagtaaaaatgttaatttttctatagctcagatctgatgctataac

SEQ ID NO: 23471 - DNA, 601 bp, Human
cagagcttccctgggtaccactaaactctgattaaacttcagcaaccttggattgtctgtgtctttgctcagctttcaaattcttgggagaaaaaaaaactgtcagaaaaatcttcttgttctagtttacatcagctgctcacccgttggactaaggttccaagtccaatgtgcttttgagataatggtataattttctgactgtaagccatggtgatgctcaggacatcatttttttcttacataattcacattaactcttagaaaaaccaattagaatgatgaattgctgttagtttawacagttttgatactactaattcttaatgaaagtaagtaagccatctggcatatattaaccttgatgttattgtagaaaatcataactatataaagaaaatctatttttctaggtggagttatattttacattaccagtaatcatcatgtactattgtttctaattaatattgcttgtaatctagaaaactttgaggtttgattttttcccaagttaaaaattgaataccaagtatattcaatatttattttcatccataaataaaacattatcttcaaaataagttattgtgcttttgct

SEQ ID NO: 23472 - DNA, 601 bp, Human
actcagtaaaggagactaaatcctgaaagaatggaatcattcagtctagaacttgatgtatcacatggttatctgaaataacaaaagcatattttaaaatagttttttctcataatagaagtgatctcagtccactattgaaaattgggaaaatacaaaaatgcactaaaagataaaatttctccctattcccactacccaggagggacttctggcaatagtaatgtcatggtccacaactctattagtccattttcacactgctataaagaactttcctgagactgggtaatttataaargaaagaggtttaattgacccacagctccacgtggctggggaggcctcaggaaacttacaatcatgacagaaggtgaagaggaggcaagcacctttacgaggcagcaggagagagagcaaaggaggaacttccaaacacttacaaaaccatcagatctcctgagaacttactcactatcatgagaacagcatggggaaaaccacccccatgatccaatcacctccctctctctacatgtggggattacagtttgagatgagatttgggtagagactcagagccaaatcatatcaacaacac

SEQ ID NO: 23473 - DNA, 601 bp, Human
cattgccttttgttctctgtgcctctatgtagattgtccagatattgcctggaaaagtagcctcatccaagctctcagattttcatttagtattacttaaggctactcagtgtcctggggacttgcctcagaattccaccagaccagaaagcagtctgcgattaagctagtgtgtttgaaatagaaattgcatataaaagagcattctattttttatttataattttttggcactaacctttagaagagatagtcaaatggcaccacaaactgagaatttattttctaaaggaaaaaaaaagtgtgctaaggattatcagatttcatttatttttgttcctatgtataaattaaaatacctctattttagtcaaggctttcactgcccctcaaacacaccatcaaagccttcgtgtctttcactgtcttgttttcctagaacagaatctcttttgctttatacttgccaaacccaatctctcattcaaacagtttaattctagagtcatcagataaaatatagtgcatgcagttaaatttgaatttcagataaacaaataattgtttaatataagttcatcccaaatattgtgtttttatt

SEQ ID NO: 23474 - DNA, 601 bp, Human
ggaaaagtagcctcatccaagctctcagattttcatttagtattacttaaggctactcagtgtcctggggacttgcctcagaattccaccagaccagaaagcagtctgcgattaagctagtgtgtttgaaatagaaattgcatataaaagagcattctattttttatttataattttttggcactaacctttagaagagatagtcaaatggcaccacaaactgagaatttattttctaaaggaaaaaaaaagtgtgctaaggattatcagatttcatttatttttgttcctatgtataaawtaaaatacctctattttagtcaaggctttcactgcccctcaaacacaccatcaaagccttcgtgtctttcactgtcttgttttcctagaacagaatctcttttgctttatacttgccaaacccaatctctcattcaaacagtttaattctagagtcatcagataaaatatagtgcatgcagttaaatttgaatttcagataaacaaataattgtttaatataagttcatcccaaatattgtgtttttatttgctaaatctggcaacccagcacatgcttcaacttctccacctcatcctt

SEQ ID NO: 23475 - DNA, 601 bp, Human
cctattcatgaaggctccaccctcatgacctaatcacctcccaaaggccccacctccaaaagctccagacagcagactggctctcaggaccaagattctggtaaccaaagagcttgcagagacagtcgagaagttctgtccctagacggtcatgggggaaatttactgaagaaccaggatagcttgtttcctggggagatcagttattggacagatgggttgccatggtcagaaaggaggaccagcattagatgagtctcagacaggacaccacacagttttacatgtttaccccatttargatctaaactggctctattgtactagtccaggcagatccagcaagtaagtggaataagcctagctatttagatcggggaagtaagaatcaagagtccacatgagccactcaagcagcttccacccactcgtcaggacacaagttccctgaccaacgtggaacataatgacatcaaggagcaaaggaatcccaacacattttgaaggaaacaatgactttattctagatagtctctgcacatttttttctgattttatcccaaggagcttgcccaaccccactagccttttttctctgttc

SEQ ID NO: 23476 - DNA, 601 bp, Human
tcggggaagtaagaatcaagagtccacatgagccactcaagcagcttccacccactcgtcaggacacaagttccctgaccaacgtggaacataatgacatcaaggagcaaaggaatcccaacacattttgaaggaaacaatgactttattctagatagtctctgcacatttttttctgattttatcccaaggagcttgcccaaccccactagccttttttctctgttctctatggaaattattcagtcatagacttgcctttgaagttaatgggaattccacactgagatgagctttggggcacaaatgagagtgaatatatgacttttaattgtgccgggggaaaaaaaagacttttcagtaggcacatatttttccttgtttgttgactcattagaactatgacataattctttgaaggacactgccagttgtcagcagaatgtgacatgtcttagagagatagccacatcaaagcagtttgggaaaagaaacaatatgcttgttctttgttatatattctcaggcagaagcattgcaagaaaaactttacagtttatttttattgataaacatgaacaaaagattttatgatactttc

SEQ ID NO: 23477 - DNA, 601 bp, Human
gtaaaggagagcccagctgaataagactacaaggctgaaacaacatggcaagtcatatcgatttcagaagatggctctgtgattaatttcagaagatagtttgtaaacctggggtagaaacgtctacgccgctgatatgtctatatatcccttgcagggcagcgacggaccccctgggaaacccggaccacctggaccacctgtgagttgttctaggcttaaaatttaaaattcatgtgtttacttaagacttttataactcagaggtaagactacatttagatgttttcaaagataaaaktcttctgaatttcgtgtataaatataaatgatagccaatgtagctttaaagagacctgatttgttctccttttggttcagcctcaatgtgcaatgctcagattggcatactgcgggtctccccatcttggatttaggaatctgggtttgtgctccgactctccacttcctggctcggggcccctgggaaagtcatttaaccttaatgtgcttcattcacagaaaggagaagggccagaaaaatagatcctttccgctgatgcgagttggtagaaaatctgatattatgctatatgtgttc

SEQ ID NO: 23478 - DNA, 601 bp, Human
atggctctgtgattaatttcagaagatagtttgtaaacctggggtagaaacgtctacgccgctgatatgtctatatatcccttgcagggcagcgacggaccccctgggaaacccggaccacctggaccacctgtgagttgttctaggcttaaaatttaaaattcatgtgtttacttaagacttttataactcagaggtaagactacatttagatgttttcaaagataaaagtcttctgaatttcgtgtataaatataaatgatagccaatgtagctttaaagagacctgatttgttctccytttggttcagcctcaatgtgcaatgctcagattggcatactgcgggtctccccatcttggatttaggaatctgggtttgtgctccgactctccacttcctggctcggggcccctgggaaagtcatttaaccttaatgtgcttcattcacagaaaggagaagggccagaaaaatagatcctttccgctgatgcgagttggtagaaaatctgatattatgctatatgtgttcattcccattcatgatgtctgagatgcaaggaaactctatttatgtagctcttagtgaacaaaaagtacaa

SEQ ID NO: 23479 - DNA, 601 bp, Human
tagatgttttcaaagataaaagtcttctgaatttcgtgtataaatataaatgatagccaatgtagctttaaagagacctgatttgttctccttttggttcagcctcaatgtgcaatgctcagattggcatactgcgggtctccccatcttggatttaggaatctgggtttgtgctccgactctccacttcctggctcggggcccctgggaaagtcatttaaccttaatgtgcttcattcacagaaaggagaagggccagaaaaatagatcctttccgctgatgcgagttggtagaaaatckgatattatgctatatgtgttcattcccattcatgatgtctgagatgcaaggaaactctatttatgtagctcttagtgaacaaaaagtacaagaggcatcgatgttttcattattgtgattgagacagatgcacgctccgtcagggaaacggtggagaggagaggagcctctctccgtggcaagtctgccctcatgtggggccacgctcgaatcgcagccgagccgagctgagatatcacgcaaaacacccttttctaccccacctcacaggaatactttaagaaaccaaactcaccatag

SEQ ID NO: 23480 - DNA, 601 bp, Human
atctcacctctttcctaagggtattccatttaatgaacgaaacggcatgagcagtttatataaaattaaggtatttatatttgtaattatttaaaatccagttatagactgctgtaaattcgtctcatctttctctttttcttttcttttcattttcttttgaagggaggtgtgaatgttcccagttacccagggccacccggtcctcctgtaagtacagttgtttatcatcaaacacactttagctgaacaaccacaatgaaaaacaaacaataaaaacctcttaagttcactgaaaaaygcatgttatgaatacagccaaattttacagcagaaggaaataagtaaaaccaattataataaaattgagaaaatgtatgcagccaaaataatggaaaacagcatttttcatggtggtgtcacttttttcattgcaaatctaagaactaagtcaatgtccaagcaatcatttttatgaaatttccatcaagttatatttattcatcttattcttcaaattcaaactgtaattaaagcaaaacttgctaatattcgtatgtgtattaaggcaaattggacaacagtgtttcttattctgtaa

SEQ ID NO: 23481 - DNA, 601 bp, Human
tattatcttctgaggcgctccatttcattcctttggtattcagtttataaatgatgtttaattaaatatttaattattgctactttcaaacaaatgttgattgattgagcacctctgtcttaaggactgttgagaatgtaaacaaggagaatcaaagagtgtgtttcctttgtcagcaacctagggcctcttatacagaactttatgcagaacagaatctgaacttttttttttgatcagttgtcaagttacatattaggggacattttaaaagatttctgaaacatagaaagcatatcarttcatatgctcactcactaagtattctgtaataagggcaatgttataaataataatgaagttatatccctggtaatatttttgaagcagattggaattatgtatgcaaaaacacacttacagagaacacaatttgaaagctcttgtttctttgtgattatgtctaaagcatccggtgtcctaagaaaatatttgcagtgaacattaatttattaacaagaaggcatcaaacaactccccactttatctcttttttaacttaaagccctaatgcaagcttgtccaacccatggcccatggg

SEQ ID NO: 23482 - DNA, 601 bp, Human
cacctaaaaacatgtccagtaatttgtctaaaattgtctagcaagcatgtgatggtagaattatctttgttcatgatatgttagaaaataaataaaagattgctcttttaccacaggaagtttgagaaacactaataaaaaggcttaacagctattgtaaggcctttatctttcaatctttgtaaaatgcagagccatcggtgatttctgagtagtggcatgagggaacttgcagccagagagttgcaagggtggaagtagggaagccagttagaagatatccagtaatccaggtgccagktgatgctggctcagatcagagcagaaacagtggagatagtgagaatgcctggatttggatatattttgaaggtagcactgataggattttcagattgattgcattattagagaataaagaggagtcaaacacgaacttcagttttatgacctgagcagtttgcaaaatagggcggacatcatctgaaatgaggacagctatgagcaaggcctattttgaaggggtggaattatcaggagtttaattttgtacgtgagaccaaatttggagatatctgttagacagcaaagtgaaggtatt

SEQ ID NO: 23483 - DNA, 601 bp, Human
caagactatgtgtgctggcaaggcacagtggctcacgcctgtaatcccagcactttgggaggccaaggcgggcagatcacctgaggtcaggagttcaagaccagcctggccaacgtggtgacaccccatctccaccaaaaattagccaagcgtggtggcaggcacctgtaatcctagctactcaggaggctgaggcagaagaatcacttgaacccaggaggcagaggttgcagtgagccgagatcgtgccattgtactccagcctgggtgatagagccagactccgtctcaaaaaaaaaaaacaaaaaaaacaggactacatgtgcttttccagccatgttcagacattcaggtaaagacacagaataggaggggagttggatttcaacaatgttctgcttttgacggtgagtactggacggaagaatgggaaaagacccttactggcttactggtatacacaagggaatgattctaacaagtaaccatggaattttaactaggcaagagagagggagaggccattgagggagtgaaagataacaaatttgtaccatcaatggattagggtttaggggttcaaggtactcaaagagtgaat

SEQ ID NO: 23484 - DNA, 601 bp, Human
aagactatgtgtgctggcaaggcacagtggctcacgcctgtaatcccagcactttgggaggccaaggcgggcagatcacctgaggtcaggagttcaagaccagcctggccaacgtggtgacaccccatctccaccaaaaattagccaagcgtggtggcaggcacctgtaatcctagctactcaggaggctgaggcagaagaatcacttgaacccaggaggcagaggttgcagtgagccgagatcgtgccattgtactccagcctgggtgatagagccagactccgtctcaaaaaaaaaaamcaaaaaaaacaggactacatgtgcttttccagccatgttcagacattcaggtaaagacacagaataggaggggagttggatttcaacaatgttctgcttttgacggtgagtactggacggaagaatgggaaaagacccttactggcttactggtatacacaagggaatgattctaacaagtaaccatggaattttaactaggcaagagagagggagaggccattgagggagtgaaagataacaaatttgtaccatcaatggattagggtttaggggttcaaggtactcaaagagtgaatt

SEQ ID NO: 23485 - DNA, 601 bp, Human
aaattattatttgagaattaatttcataactaaagacttcattgatgtcattaaagtagcaatgtttttaaatcccaacagggagatcgaggcccagcaggtcccccaggaatagcagggatgtcggtgagttcagattacttcacatcattttcacaggtaaacggttctatctccatgatacacctgtggccagggatcaagacaggcaggagagcataccataactcccatggcattaggttcctgacaattctagtttcataaataatgccacctgtattttccacctccacaatcstctatttcttttgttttgttttgttttttgtcctcttttattttcttcccaagtcactttcatggaggggagaggaaacacagttactatacattaatttatgagcacagctttggaaagtttattgtgtttctctattcttgtcatatttcaaggtttctcagtcttcaaaagacagagttcttatcctcaggcatgtacttcaagttccttgtattaatgcaatctgcctgagttattccttagcccagtgttattagcagagctttattgctgctaatgtttcctcataaactagcc

SEQ ID NO: 23486 - DNA, 601 bp, Human
tagcagggatgtcggtgagttcagattacttcacatcattttcacaggtaaacggttctatctccatgatacacctgtggccagggatcaagacaggcaggagagcataccataactcccatggcattaggttcctgacaattctagtttcataaataatgccacctgtattttccacctccacaatcctctatttcttttgttttgttttgttttttgtcctcttttattttcttcccaagtcactttcatggaggggagaggaaacacagttactatacattaatttatgagcacagcwttggaaagtttattgtgtttctctattcttgtcatatttcaaggtttctcagtcttcaaaagacagagttcttatcctcaggcatgtacttcaagttccttgtattaatgcaatctgcctgagttattccttagcccagtgttattagcagagctttattgctgctaatgtttcctcataaactagcccttcaatcctctcaatcatttttgttgctctctggtgtcaaatgttttaatctcatcaaggccttttcaaatgaataggaagtgttccaggaaaggttgaaattatttctct

SEQ ID NO: 23487 - DNA, 601 bp, Human
tcacaggtaaacggttctatctccatgatacacctgtggccagggatcaagacaggcaggagagcataccataactcccatggcattaggttcctgacaattctagtttcataaataatgccacctgtattttccacctccacaatcctctatttcttttgttttgttttgttttttgtcctcttttattttcttcccaagtcactttcatggaggggagaggaaacacagttactatacattaatttatgagcacagctttggaaagtttattgtgtttctctattcttgtcatatttcmaggtttctcagtcttcaaaagacagagttcttatcctcaggcatgtacttcaagttccttgtattaatgcaatctgcctgagttattccttagcccagtgttattagcagagctttattgctgctaatgtttcctcataaactagcccttcaatcctctcaatcatttttgttgctctctggtgtcaaatgttttaatctcatcaaggccttttcaaatgaataggaagtgttccaggaaaggttgaaattatttctctgagccctagagatcattctgatcttcattcatgatgctcta

SEQ ID NO: 23488 - DNA, 601 bp, Human
atctgtttcttttcctgtcaacaaaacatggcttttcaaatcaaacatgattttttcaggttgtcatactatgaacttaaaagccctcttgtgaatctcaaagcctagaaaaaaacttatttgatgctttgtgcccatttctccactcccaaagtaaagaagagctgccaggaaaataagcacaagagggatgtccaataatgatgatactttgggctaatattttcaaaaatattctcctctcctactctccaccatccacacaaatatatattcgaagaactgcaccccagtctgaaamttatggcctgcggagttgactatatgttccccagtctctgtccccttagaaatgccactttatttatttatttatttatttattgagatggagtctcactccgtcacccaggctggagtgaaatgtcatgatctcagctcactgcaacctccgcctcctgggttcaagtgattctcctgcctcgggctcccgagtagctgggattacaggcacgtcccaccatgcctgggtaatttttgtattatttttagtagagacagggtttcgccacgttggccaggctagtcttgaactcctgac

SEQ ID NO: 23489 - DNA, 601 bp, Human
ggagtggggtagaggaagacagaacagtaagaaaacatcaccatcatctccacgagaagtaatgacagtggaaacagccatgagtagaggaacttaggatgtacattgaagagagagccagcaagcaacaaaacttgctgatggactaatctagagaagtgtgagggaaagagaccaatcacagctgtggtgtagggtctgagcaactatgtgagagtgctgctgtttggtgaaatggggcagactgaaggtaggtggatttgggagggagagccaagagttctgtttgacatgttcatgwtggagcactagcaggtattcaggtggagatgtcaagtacacagtggagacttaggagaggccaagattggtgagaccaattagggtatctaaacctgagcctggaaaagtggagtcactgtggataggaagggaagagagtgcttcaactgttaggaagacaacccaacaaagaaggctgtgaaactgcagccagagagacaggaagaaaatcgggcaagtgaggtttccttgatgtcaagtgaactgttttaagagaaaggagaaagcagtaaggagtgatcaacatacaggtaagtaa

SEQ ID NO: 23490 - DNA, 601 bp, Human
cattggtgggagagatcaccacatgttagtatcttggtaagaatgatccagttgagagaggaaaatttgatgacacaggagagtgaagactactttgagtagaactggtatactcacaagtgggaattggtcttaactaggaacaggggcagttcacccttcctaactgtggagtgtgggggtgccaaagttggggtgcaaatccatgaagattgacgcaactggtggagggatggtgagaggggtctcttttgtttgttagtgaaagaagaatggaggttgtccaagtgtgaggagtggrgaggtgatgctgaagtttggaagagacaggaaaatgtgtgaaagagtacttttggagagatagaaagggagtcaaattgggaaatacagagggatggcctggtaatgctgagggtgctgcttgcaatctgctgttgaacatttgggttggaacaagcgagcaaagatacgtggttttcttcagccaatcagctgctcagatgcagatgtgaggtaggcagaatgtacccaggaaaggggctctgccaggtgaatgagatgagggtagagaggagcaaatacatatgagttattgtaaaaa

SEQ ID NO: 23491 - DNA, 601 bp, Human
tccaactgaaaaataacaattgttctctgactgacactttatttcatagtaggatcatgctctggccatgttatgaaatttccccagcagcaactgagaccatttactgagaatgatactctgtgctggaaaacctgttagaaggtaacaaaaatgccatactccagccacctatgccatgaggcaccttcttatttctcaggatgacctaatagaagaataagaaaggaaaataatctttgttgactatttatagaggaccatgcatttttcatgttatttcacttaattcttagttttraggttatttattttcctcactagtgaagagattgatgctattgaggttaagtaaattgcccaaaaaggttaatgggactagtaagtgacagtgtcagaatccgaactcaggactgtcagattctatttatttgttttccattttaccacctttctttaccaagctctcagtagaaatatgattaaggaactgtcctcgaaaccttatgcttttgttgtgtttaactatgttaatgcagagttagaaatattaatcctttttttctttatagggaataaatggaaaagatggaataccagg

SEQ ID NO: 23492 - DNA, 601 bp, Human
tcaaagtgtgctaatattttttcttgtcatctcagaaatttctccaaatgtgagctggagtgacagacctgtatgcagatatatttttataactaagacagtagcattgataccaggcctaagtgcttttatttctttctacatggcttatttccatatctgattctatgatcacacaaatctctgtaactgttcatttatttctgttaatttttaagtcaagagaaattgagtttgcccttctgcagagtagtcatagttaaaagaataatataatgagatacaggaccacttcaagcakcattccgtcatatttggtgtgaggatcacttcctggagttatgcaactgaatatttgaaaatttatgactgaagcaactgccatgatctctctctctctctctctctcattctctcttgcacaaacacatacagtagtagacacattccaggataaaaaacagcatcaagcaaacttcatatcacatttaggcacatctaatataatattttactaattaattatgacatcttattcaactgattcttgtttttttgttttgttttgttttgagacagagtttctctcttgttgcccagg

SEQ ID NO: 23493 - DNA, 601 bp, Human
tcctggagttatgcaactgaatatttgaaaatttatgactgaagcaactgccatgatctctctctctctctctctctcattctctcttgcacaaacacatacagtagtagacacattccaggataaaaaacagcatcaagcaaacttcatatcacatttaggcacatctaatataatattttactaattaattatgacatcttattcaactgattcttgtttttttgttttgttttgttttgagacagagtttctctcttgttgcccaggctagagtgcaatggtgtgatctcaactcacygcaacctccgcctcccgggttcaagcgattctcctgcctcagcctcctgagtagctgggattacaggcatgtgccaccacgcctggctaatttttttgtatttttagtagagacagggtttctccatgttggtcaggctggtctcgaactcctgacctcaggtgatctgcccacctcggcctcccaaagtgctgtgattacaggcgtgagccaccgcgcctggcccaactgattcttccatagttcatttatactattgagtaaatgatgtcagtgacatcctccccccagtcacctgct

SEQ ID NO: 23494 - DNA, 601 bp, Human
gcaatcttcctttatcattgcaaaggagacccagacctcaagtgacagctggtattgactcaaaactgccatcatcctagatgggcaaccaagcacacctaacattctctctatcttttatgtattaagtactgccaaggtgccaggcattgctctgagcactttacttgggttaattcatttagttctgaaaatcgccctatctaatggatactattaatatgcccactttgtaggagaggaggctaggacacagagagtttaagttatttatacaaggcccaacagctaataagtgccrgtatgaatccagaacttttgctctcaactacagctgatgctagaagagattattctttgttattattttttccttaacagggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggtaagtagtgctaagacgctttagggctcctggcttgtaccgaccatgt

SEQ ID NO: 23495 - DNA, 601 bp, Human
cacacagacaggatagaggaattttcagtgaagagcgatgaggaacctacccaagaatgtttataataaattaaggctcactatctaagtaggctctgcttcattcttaaattcacattgcatggtgattttccgtagagcttccaactctctcatctgaccatcttctgttatggtctttgttcatgtttatatctcagagtggggcttattgcctttgtcacaaccgccaatcttcatcatattgtctttaatgccacacatatacccctggataataatcaccaactataaagagtartaaaatactttgaaattctaaccatcaagaaaaaaataatagctcctttaaaaatatcaaggcactataataaaacattactgttataaatgttaaattctttgtcaaatgcatgtggatttacttgtcaacaggtggaaaattcagctgacattatttgcctgcttccttttaccagatcccaattaagaaaagaaaattacttaatacctatatacttgcaatgtgtaaattacagaataaactttatgatgaaatgggtaaaacttgcttttatcccatgaatacaacattttttaa

SEQ ID NO: 23496 - DNA, 601 bp, Human
catctgaccatcttctgttatggtctttgttcatgtttatatctcagagtggggcttattgcctttgtcacaaccgccaatcttcatcatattgtctttaatgccacacatatacccctggataataatcaccaactataaagagtaataaaatactttgaaattctaaccatcaagaaaaaaataatagctcctttaaaaatatcaaggcactataataaaacattactgttataaatgttaaattctttgtcaaatgcatgtggatttacttgtcaacaggtggaaaattcagctgacrttatttgcctgcttccttttaccagatcccaattaagaaaagaaaattacttaatacctatatacttgcaatgtgtaaattacagaataaactttatgatgaaatgggtaaaacttgcttttatcccatgaatacaacattttttaaaataatccagcatacttggagttctgttccaggttgtcttcctttgaaaatacattatatcaattagatattgactttgccatccagggattggttaaaagttaaattgtgattaggctactaacatcatgtttatactttttagattattta

SEQ ID NO: 23497 - DNA, 601 bp, Human
taataaaatactttgaaattctaaccatcaagaaaaaaataatagctcctttaaaaatatcaaggcactataataaaacattactgttataaatgttaaattctttgtcaaatgcatgtggatttacttgtcaacaggtggaaaattcagctgacattatttgcctgcttccttttaccagatcccaattaagaaaagaaaattacttaatacctatatacttgcaatgtgtaaattacagaataaactttatgatgaaatgggtaaaacttgcttttatcccatgaatacaacatttttkaaaataatccagcatacttggagttctgttccaggttgtcttcctttgaaaatacattatatcaattagatattgactttgccatccagggattggttaaaagttaaattgtgattaggctactaacatcatgtttatactttttagattatttaaccttataaaatgaagtcataggaatgtcttccctaactgtataaagccatgtgtctccatttaatgggaaacctgttgataccactggttatgatcccagcccatagcttttaaagcaattacacacttcaacttcttcccaga

SEQ ID NO: 23498 - DNA, 601 bp, Human
ctactatggggaatccctccagcaacattctcgaaagatggccatgccacaaaaaccttaaggggcagcccattttatgatgggacagctctttgatgaaaattcttctttatacaaagttaacttttgcctccctggaacttcctttcattatacctggtctgtaaaacaacacaggtaaagtacctgcttgtactcacatgacagccctttgagtatttttcaatatccctcatactcctccttagttttctcttttatggagtaaatgtgtctagctcctccactattatcacccctrggaaatgtttaatttataaatgactctcatttaccaaggaatattttgaccaatgcagagtagtgtctttttatttagaccaaagtcagcaaactgtaccccctagccaaagctattgccacctgctttgtacagcctacaaactgagaatggtttttgctttttggtagggagcagtgggagtgagttatatttttaaacggtttttaaaaatcaaaagatatttcatgatatgtgaaaattatctgaaatttgaatttgtttccataaataaagtatgcacattccttcgcctctttt

SEQ ID NO: 23499 - DNA, 601 bp, Human
aaaacaacacaggtaaagtacctgcttgtactcacatgacagccctttgagtatttttcaatatccctcatactcctccttagttttctcttttatggagtaaatgtgtctagctcctccactattatcacccctgggaaatgtttaatttataaatgactctcatttaccaaggaatattttgaccaatgcagagtagtgtctttttatttagaccaaagtcagcaaactgtaccccctagccaaagctattgccacctgctttgtacagcctacaaactgagaatggtttttgcttttwggtagggagcagtgggagtgagttatatttttaaacggtttttaaaaatcaaaagatatttcatgatatgtgaaaattatctgaaatttgaatttgtttccataaataaagtatgcacattccttcgcctcttttctctggctgttatcccactacagcaacaggactgagcaattgtgacaatatggtacataaaggcttaaatattttctatctggcccttgcagagaaagttctgacccctgctctagatacttcaataattcatcctaagatgtattgctttttggaaaaaagcat

SEQ ID NO: 23500 - DNA, 601 bp, Human
acctgcttgtactcacatgacagccctttgagtatttttcaatatccctcatactcctccttagttttctcttttatggagtaaatgtgtctagctcctccactattatcacccctgggaaatgtttaatttataaatgactctcatttaccaaggaatattttgaccaatgcagagtagtgtctttttatttagaccaaagtcagcaaactgtaccccctagccaaagctattgccacctgctttgtacagcctacaaactgagaatggtttttgctttttggtagggagcagtgggagygagttatatttttaaacggtttttaaaaatcaaaagatatttcatgatatgtgaaaattatctgaaatttgaatttgtttccataaataaagtatgcacattccttcgcctcttttctctggctgttatcccactacagcaacaggactgagcaattgtgacaatatggtacataaaggcttaaatattttctatctggcccttgcagagaaagttctgacccctgctctagatacttcaataattcatcctaagatgtattgctttttggaaaaaagcatccatattattctgttgatt

SEQ ID NO: 23501 - DNA, 601 bp, Human
ttttctatctggcccttgcagagaaagttctgacccctgctctagatacttcaataattcatcctaagatgtattgctttttggaaaaaagcatccatattattctgttgattcattacgagttttcagttaactaacagccctggatcttccttataaaaatatttttaaatgaggtgtttctcattatggactgtgtgtttattttttgaatctaagtgtgtgatcttatgtttcctcttattaatttcaaatcatttgtgttcatatcttgttccaacctgaagatgtcttttgaaaygttgtctcttgaagagcaggttggctgaccctataactttgtgtcatgctaaatttcataagcatgtcatcattctagctgttgatagaaatgttgactaaaaaagccaagagtcaaggattaggtctttccaaatgccatgggattctttctgtccacttgtaaatcatcttctaatctattgtttagtgagctctgaatccatttcattgtcctaaaactcaccctacatttctttgtctatttgcaaggaattgacagtatcacatgattttgacaaatggtttgctaaaatcaaga

SEQ ID NO: 23502 - DNA, 601 bp, Human
catgctaaatttcataagcatgtcatcattctagctgttgatagaaatgttgactaaaaaagccaagagtcaaggattaggtctttccaaatgccatgggattctttctgtccacttgtaaatcatcttctaatctattgtttagtgagctctgaatccatttcattgtcctaaaactcaccctacatttctttgtctatttgcaaggaattgacagtatcacatgattttgacaaatggtttgctaaaatcaagattactcttctgaactgtaagatttaacaaatgaatccatgttggytctcatggttcctacttcctttgcttagcatccataagccaaaaatagattgttgaatttttttaaggaataagattataagatgccccaagtcgatcttgactccattgcttcaaacacggactcaggtcttctccaaggagtcttgattattttaaataataattagcagtagagactgaaatcttggtgcttggatgcacgttatcttactttatatgagaactagaaatacagtagagtaacactgggacttgtagctactttaatgacaaaacagaaaaaaatggggttttttgt

SEQ ID NO: 23503 - DNA, 601 bp, Human
caaacattgtggactagactctaaactttgctttccaaacactcatttccccgtcaggaagtttgaaaaaaaggcaactgtttgaaaaaagacatctcaagctcttcaggggaatactgaagaatatacccatggctacataatttgcggtgttcagtgcacagtgaaaatgctggcacacttgttaaaaaatgattaagaattttaagacagcaatagtaaagccgtaaactaaacatggggccctatgtgactgcataggtagcccggacatgctagtcctggggacaggacatctagratctcagatagtatccatgcatttagttgacctcaaccatgaaaagagaaatgccagcgtatgtgtatttttgaattgcaatctaaagttttcctttaactcttaatccctatgggctgtagtgtctttatttatcttttatctaagagagctttaatactgaacttcagtctcttaagaggctttagataaaatcatatatttaatagtcagtaattaacccatctttttggaagctgattaagaatgtcagaaaatataaccaagcattttcagaaaaaaaaaaaagtgacatgttga

SEQ ID NO: 23504 - DNA, 601 bp, Human
ggactagactctaaactttgctttccaaacactcatttccccgtcaggaagtttgaaaaaaaggcaactgtttgaaaaaagacatctcaagctcttcaggggaatactgaagaatatacccatggctacataatttgcggtgttcagtgcacagtgaaaatgctggcacacttgttaaaaaatgattaagaattttaagacagcaatagtaaagccgtaaactaaacatggggccctatgtgactgcataggtagcccggacatgctagtcctggggacaggacatctagaatctcagatrgtatccatgcatttagttgacctcaaccatgaaaagagaaatgccagcgtatgtgtatttttgaattgcaatctaaagttttcctttaactcttaatccctatgggctgtagtgtctttatttatcttttatctaagagagctttaatactgaacttcagtctcttaagaggctttagataaaatcatatatttaatagtcagtaattaacccatctttttggaagctgattaagaatgtcagaaaatataaccaagcattttcagaaaaaaaaaaaagtgacatgttgagatatagaag

SEQ ID NO: 23505 - DNA, 601 bp, Human
aattcatctggatgctctgaaacatattattgtaaattatagagcattagggtagggttcagaagaggtaattacccttatgctaaatgactgtttctgagtgtatttcaaagccagataatttacagctagaagtagtgaaaataattttctgttttgctaaaaatattaaaaaccaccaaagtacttctaaactcaattcatatattaaagaggaaaaattagtactgtgaatatttgtgtttcgacattgaaggtatttaaacagacatgtttcaaattaagaaaaattgtgaccggkctcagtggctcacgcctgtaatcccagcactttgagaggctgaggtgggtggatcacgaggtcaggagatcgagaccattctggctgacacggtgaaaccctgtctctactaaagatacaaaaaaaaattagccgggcatggtggtgggcgcctgtagtcccagctactcgggaggctgaggcaggagaatggcgtgaacccgggagacggaggttgcagtgagctgagatcacgccactgcactccagcctgggtgacagagtgagactctatctcaaaaaagaaaaaagaaagaaaaa

SEQ ID NO: 23506 - DNA, 601 bp, Human
ttagggtagggttcagaagaggtaattacccttatgctaaatgactgtttctgagtgtatttcaaagccagataatttacagctagaagtagtgaaaataattttctgttttgctaaaaatattaaaaaccaccaaagtacttctaaactcaattcatatattaaagaggaaaaattagtactgtgaatatttgtgtttcgacattgaaggtatttaaacagacatgtttcaaattaagaaaaattgtgaccggtctcagtggctcacgcctgtaatcccagcactttgagaggctgaggygggtggatcacgaggtcaggagatcgagaccattctggctgacacggtgaaaccctgtctctactaaagatacaaaaaaaaattagccgggcatggtggtgggcgcctgtagtcccagctactcgggaggctgaggcaggagaatggcgtgaacccgggagacggaggttgcagtgagctgagatcacgccactgcactccagcctgggtgacagagtgagactctatctcaaaaaagaaaaaagaaagaaaaattgtactgaaacacatctcttctttgaggtgcagaacagcaaatat

SEQ ID NO: 23507 - DNA, 601 bp, Human
atggcgtgaacccgggagacggaggttgcagtgagctgagatcacgccactgcactccagcctgggtgacagagtgagactctatctcaaaaaagaaaaaagaaagaaaaattgtactgaaacacatctcttctttgaggtgcagaacagcaaatattcaaactgtgattattgaatttcatatttattgtaatgccccaagttcataatttgatgtaataaagatattatatgtacattcagtatgatgatttgtaaaactaaaactatatattaattacctatttgttttatctattarttactagaataagatatagtaatatcaaccacacatcccaggtagatagtgaggtagtgatactcgagggcaggtgatttcatatcactccttgggaccagcatccattagatccctgttggcctcccattcatccttcagtctgcagccagagattctagtcctgtgcgggttgtggtatatttccattctgcatgctttgtgacatgagaatgtgaatgtaggtgattacttttcggataatgtcagctaatgctctatagctattggggcttttctcttaataattctatatgaaaa

SEQ ID NO: 23508 - DNA, 601 bp, Human
gatgatttgtaaaactaaaactatatattaattacctatttgttttatctattagttactagaataagatatagtaatatcaaccacacatcccaggtagatagtgaggtagtgatactcgagggcaggtgatttcatatcactccttgggaccagcatccattagatccctgttggcctcccattcatccttcagtctgcagccagagattctagtcctgtgcgggttgtggtatatttccattctgcatgctttgtgacatgagaatgtgaatgtaggtgattacttttcggataatgwcagctaatgctctatagctattggggcttttctcttaataattctatatgaaaaaacaattgtttttctttcttaaccagtatgggcctacattgtttttaaatgattgttttaattgaaaactcatgggaaaacagattttcctcagaagtaatttactctttatttaaaaatttacataaaataaaagatacatatctgtttaagtatgcctttgcaattcaactaaatcaactaaactgaatgaaaagactggagaacatggaagtaactctttacaagacctatatcatttgggct

SEQ ID NO: 23509 - DNA, 601 bp, Human
taatatcaaccacacatcccaggtagatagtgaggtagtgatactcgagggcaggtgatttcatatcactccttgggaccagcatccattagatccctgttggcctcccattcatccttcagtctgcagccagagattctagtcctgtgcgggttgtggtatatttccattctgcatgctttgtgacatgagaatgtgaatgtaggtgattacttttcggataatgtcagctaatgctctatagctattggggcttttctcttaataattctatatgaaaaaacaattgtttttctttctkaaccagtatgggcctacattgtttttaaatgattgttttaattgaaaactcatgggaaaacagattttcctcagaagtaatttactctttatttaaaaatttacataaaataaaagatacatatctgtttaagtatgcctttgcaattcaactaaatcaactaaactgaatgaaaagactggagaacatggaagtaactctttacaagacctatatcatttgggctttgtgttttctaactgacggctatcgtttctactgcgttgttgtctgtcatttggtctttacttacaaaataaa

SEQ ID NO: 23510 - DNA, 601 bp, Human
cttaaagttattatgaaatcattttttaatgtgaacctaaactctctccacatgccattaccagaggttagattccatgctagtgttctgtccactagattgttacatctcagaagcactgaaaattctcagactttctgagtgacacagctggtctgcatctatacacaaacaactttgcaatcgatattatttgtctaatcaaaaaactcagcagtcagaccagttggtaaattagatgtgcttaaattaaaaactaaatctttttgtttgtttgatttcatgtattttgaaattttttgacataaaatatttctgttctatgatatattattttttcttctatacatgaagagaggatggctgtattcctatcccagctcaagctgccagcagcaatgttggctgcccaagcttatgggagacctgggccaccagggaaggatgggttgcctgggccaccaggagaccctggaccccaaggtaagtcttcaagtgtaatattggcttattgatttttaactctctgtatttataacatgttagtcacagttaaggaaaaaagtatgtatgtatgtcctttatttatacattacatata

SEQ ID NO: 23511 - DNA, 601 bp, Human
ggcttattgatttttaactctctgtatttataacatgttagtcacagttaaggaaaaaagtatgtatgtatgtcctttatttatacattacatatataaatatatgcaatatataaaatggtttcatatgtaatctctttataatatttgacattctagaagtagatgtttaactattactacttcaaatttaaaaccaaatgagagttacctggtattctaaatgtattgtaaaaataatatttattataacaataacagcaataatgtgtgcttatatatcattattatctaggaatcytagaattttttaggcttccccttttggtgtaagttaagcaagtctccatcatctgagtgtcttaaataaactggagaaagagttttaggtgactcaacgacaaatagttatttggttctaaaatatatttttaagaaattttagaatctttctgctttgaatacagcttgtggatggtaacttgaatgttaaagaatttttcacatgatttctaaagttcttaaaacccaacttatattggcaaagaattttgttccacttatgacaacttgacgagagacataatcttaagtatagctt

SEQ ID NO: 23512 - DNA, 601 bp, Human
actctctgtatttataacatgttagtcacagttaaggaaaaaagtatgtatgtatgtcctttatttatacattacatatataaatatatgcaatatataaaatggtttcatatgtaatctctttataatatttgacattctagaagtagatgtttaactattactacttcaaatttaaaaccaaatgagagttacctggtattctaaatgtattgtaaaaataatatttattataacaataacagcaataatgtgtgcttatatatcattattatctaggaatcttagaattttttaggcytccccttttggtgtaagttaagcaagtctccatcatctgagtgtcttaaataaactggagaaagagttttaggtgactcaacgacaaatagttatttggttctaaaatatatttttaagaaattttagaatctttctgctttgaatacagcttgtggatggtaacttgaatgttaaagaatttttcacatgatttctaaagttcttaaaacccaacttatattggcaaagaattttgttccacttatgacaacttgacgagagacataatcttaagtatagcttaactaaattaatctga

SEQ ID NO: 23513 - DNA, 601 bp, Human
aatccagcaaagtggccaaataggcccaggcttagaagagtcaacaactctgaaagggaaatattaaattcagtgaatatatatcatgaaagataagaccaggaaaactgcttcttattgttaaccatggaggatctcaggttccttccttgaaataatcaaaagcaacttgtataaagaaagaaaagtggaaattaacactaaaattaaataagaatgcagtccaaaataatatatatgcaaagaagtgtttttctgtcaccagtttccttcctactgctattctgtaatattgagcctyattttctgaagtgtcccaaggtgactgatgtgcccttcctcttctgaaagagcaacatctgttcagttcccaatagcagtgcctgttagtatatatatcttaatataaccttataacctatgaccatgattgccaagtctttgcgtttaattagcacaatataaaacaggaacagttaaaatctctctagttttttttaaacgatacatatattccaccattatctttagattatagtgaagtttggcagattgatgaaggaaagagaaaagtataggatgagaagtagccctctatgta

SEQ ID NO: 23514 - DNA, 601 bp, Human
gcaaagtggccaaataggcccaggcttagaagagtcaacaactctgaaagggaaatattaaattcagtgaatatatatcatgaaagataagaccaggaaaactgcttcttattgttaaccatggaggatctcaggttccttccttgaaataatcaaaagcaacttgtataaagaaagaaaagtggaaattaacactaaaattaaataagaatgcagtccaaaataatatatatgcaaagaagtgtttttctgtcaccagtttccttcctactgctattctgtaatattgagcctcattttytgaagtgtcccaaggtgactgatgtgcccttcctcttctgaaagagcaacatctgttcagttcccaatagcagtgcctgttagtatatatatcttaatataaccttataacctatgaccatgattgccaagtctttgcgtttaattagcacaatataaaacaggaacagttaaaatctctctagttttttttaaacgatacatatattccaccattatctttagattatagtgaagtttggcagattgatgaaggaaagagaaaagtataggatgagaagtagccctctatgtatacact

SEQ ID NO: 23515 - DNA, 601 bp, Human
ataaaaattgcaaaacatagaattcatttttaaggaatatgtgtttcttaaaaatatttgtttttaaggaatatcagtacagtaggcatgctgtactgataatcctgcctaaaggcacagagaaatctcactgaaaagaaagaaaatgagaggctgctgtttaatttttggtgcctctagagaagtgcacaggaaattgaagtgtttttctctagtacataaataggtgtgacatgctcagaagatgaagttatacatgtaacttataagctttgctctgctcaatttaagtgtttttttycaaaaaggaaagaaaaaaatgcatttaaaatcaccagtgaccacgcaaacctcggatgctgttgtctgaattagtcctcttaatgacacagcatgactgagtttaagaaagggttgaagtcagaaatgcaacataggttgggaagaaaagatggcttctgaatgtgacacagtgtgttctgccactcattcatcctgtctgatggtggctcctctgaaatttctagatgagacattttgttttgttttgttttgttttcagtgtttgtcaggaaagaaatccatttggttctgaaataca

SEQ ID NO: 23516 - DNA, 601 bp, Human
tctcaacaataatgggaaataattgatcatacatactgttcatagggagcattacattttctcctcctgccatgttctactgtaacagcacacctttatgaaaaggcacaactaaatcacagcctactgtttcctactgagatgctctcctactgatatctttgctgtgtgtccacatgagtctgcatggctgctctgtccatttaggacaaggagtgatctttaaggggctgtttaagtatgaaaaagttggaaataaaaactctatttgccatcactgtgaaactcttacagcatggamccttttattcaaacaaagtattacatgggtgccaatatataaaatgcagataaaaatgctttatgctttttataagcagggataatgacttccagagacacaaatttctctgtactcttgtagctcagccaatagcaagcatattagatagtaagaataattttgttttaaaatatagacagatcttagacctaattcattttggttaaaatatcttaagttgatgaagtacatttgggagactgtcagtctcctctcttgtttcctagctttgctgaagctcctttggagttatacact

SEQ ID NO: 23517 - DNA, 601 bp, Human
ctcatgctcttgctatcatctattagaatcttgaattatttgttcctttcatttcctttaattcttggaataagatccgtattcctattatattatcttgttctcattttaagcaagactctttccatatacttctttcatttagcctataccttgccttcaatcagaattcctactgaagagggctcacacagcttgtcatagctatttgcaagattgatttatttaggtgtcattttcagagccaaaatctcgctatcaagagtataactagttggggctgggcatggtggctcatgcytgtaatcccagcattttgggatgccaaggcgggcagatcacctgaggtcaggagttcgagactagcctggccaacatggcaaaaccctgcctccactaaaaatacaaaaaaaatagccaggagtggtggttgagtgcttgtaattccagctactcaggaggctgaggcaggaggatcacttgaacacaggaggtggaggttgcagtgagccaagataatagtgccactgcactccagcctgagtgacagagcaggactctgtctcaaaaaaaaaaaaaaaaaaaaaagtttgactagttg

SEQ ID NO: 23518 - DNA, 601 bp, Human
caagactctttccatatacttctttcatttagcctataccttgccttcaatcagaattcctactgaagagggctcacacagcttgtcatagctatttgcaagattgatttatttaggtgtcattttcagagccaaaatctcgctatcaagagtataactagttggggctgggcatggtggctcatgcctgtaatcccagcattttgggatgccaaggcgggcagatcacctgaggtcaggagttcgagactagcctggccaacatggcaaaaccctgcctccactaaaaatacaaaaaaaatagccaggagtggtggttgagtgcttgtaattccagctactcaggaggctgaggcaggaggatcacttgaacacaggaggtggaggttgcagtgagccaagataatagtgccactgcactccagcctgagtgacagagcaggactctgtctcaaaaaaaaaaaaaaaaaaaaaagtttgactagttggaactttttatagtaattgcatgttttttaagatcctcattgccctattatacccaatctgtttgatatgtaagtttaatatgtggttaatgcaaaacagttagctaatatac

SEQ ID NO: 23519 - DNA, 601 bp, Human
atggtggctcatgcctgtaatcccagcattttgggatgccaaggcgggcagatcacctgaggtcaggagttcgagactagcctggccaacatggcaaaaccctgcctccactaaaaatacaaaaaaaatagccaggagtggtggttgagtgcttgtaattccagctactcaggaggctgaggcaggaggatcacttgaacacaggaggtggaggttgcagtgagccaagataatagtgccactgcactccagcctgagtgacagagcaggactctgtctcaaaaaaaaaaaaaaaaaaaaaagtttgactagttggaactttttatagtaattgcatgttttttaagatcctcattgccctattatacccaatctgtttgatatgtaagtttaatatgtggttaatgcaaaacagttagctaatatactatttattttaagcaaatgtatcacataattatcacagactcagaaaatggttcttctctgtgctgtgttgccatagaaccctttttgtgtgtctcttttttatatatttctcacttaggctacagaggacagaagggagaaagaggtgaacctggaattgggctgccaggga

SEQ ID NO: 23520 - DNA, 601 bp, Human
ttctctgtgctgtgttgccatagaaccctttttgtgtgtctcttttttatatatttctcacttaggctacagaggacagaagggagaaagaggtgaacctggaattgggctgccagggagtccaggtcttcctgggacttcaggtaagtgggatattgtcttcacaacacaagcaagcctttacaaattagaaccatgcttctcccctagggtccttatatgtcaagtcgagtgatccatgttggctagagggtgggagagaggaagggccatatgtgatctgcattgtaattttttttttatgtcgttagctctgggtttgccaggctcaccaggtgccccaggcccccagggccccccaggacccagtggaagatgtaacccagaagattgcctctatcctgtgtctcatgcccatcagcgcacaggtgggaattgaacacacctgaagaagacttggttcctggtaacatttccttgccactggagctctcttaataccgtcaaaccctcatcatctgtgggttgctttttttttttttttttttttttgggagtaagccaggcattaaaagcaaccgtttgaatcctattcctatag

SEQ ID NO: 23521 - DNA, 601 bp, Human
tttcaaaattcaacaaatgtatacatgagatatgtatattccattttatgtcaattttacacaaaaagaaaaaatgctgtgaacaaatatgaaactctagcaaaataatatgcatgctgaattatttaggaagaagtatactgatgtctgcaatttacgttaaaacactttgtaaaagatgaattgctggatggatagagggtagatagatggatagatacgtgatagagcaaatgcattaagacattaatggtaaaatctatgtggtgcacacacagatttccatcgtaaaggagaggtyacaaggcagttttcatcttcggagagagagagagagacctgaggatgagtcacttctccaacttacccacagccatgtagtgggcatcaaagcctgtgaaacgctcctcattggagaaatctgaccggaaagtgatggacatgaaggagccaggggagaggaccacctcctggccgggagtctgctctgtgtctgtggtctccctgccacagaaggttgccagcacctggtcctcagtttctacctttgaggtcaaagagaaagggaacaagatgagcagtttcccagctaggcttcttt

SEQ ID NO: 23522 - DNA, 601 bp, Human
ctctttctttctttctgcccctaatgtgggtcaagccctgtcctaggcatttgaatgtacatttccccaaaagggataaaccaatggccaacaagcacatgaaaagatgttcaacattgctagtcattaagggaatgcagtttaaaccacaatgaggtaccactacatactcaccagagtgattaaaatttttaaaaattgacaacatctaatgttggtttagatgtggagcagccagaactctcatacattggtggacagataaaaaatgttacatttgctttggaaaaggtctggcaaygtctcataaagctaaacgtatacctatcctatgactcagcaattcttctcttacatatttactcaatagaattgaaaacatatgtttgcaagaagacttgcacaagaaggttcataaaaactttgttagtgagagctaaaaaatggggagattccaagtagccgtcaataagagaatgagtaaacatactttagtatattcatacaatggaaaattactctgccaggaaaaggagcaaattactgatgcatgcgacacatgaattaacttcaaaaacattatgctgagtaaaagaatcct

SEQ ID NO: 23523 - DNA, 601 bp, Human
ctccctgtacccagaacttcaggagatccctcatctcctacaggcccttgacacacaccctcactcctcactgtctaacccctgtctttgttttgtttttctttatagtgctattcactctgttcaactaaatgtagccttaagcttccttcttacttattttattttattttattttattgagacagaactttactatgtcacctaggttggagtgcagtggtgccatctcagcccactgcaaccttcgcctccacctccacctccaccttctcccagtgatcctcccacctcagcctcmtgaatagctgggacgacaggcacgtgctataacacctggctgatttttgaagtttttgtagagatggggtcttgctatgttgcctaggctgatctcaaattcctagactcaagccatcttcctgccttggcctcccaaagtgctgagattacaggtgtgagccacctcgcccggcctccttacatattttaaattcagcctgaagggttctgcgtacatggtgaactgcaacctaactggatttttaagtagactgtaatctactgtcttactgtaaactaaaaataaaatcctaagccc

SEQ ID NO: 23524 - DNA, 601 bp, Human
taaagtaaaattaaaaaaaaatcctctgcttaaagatgaacgtattgtggctcagagaagggcagagtgctgtctggtgcataaagcagagatgatctctgctgtcaaagaacctgcagtctagttggggggactaataagaaataataaacaaaataattgtaggctgtcataagggttataaaaataatcaagatgatatgcatatacaaaagaaatatatgctgtatgtttataattgatgtaaaatctatgtaacctatagaagtaatcattcctataatggtaatataatagatartaactttaggtaatcaaggaaggcctttctctgaggtagcattggggatctgagatatgtaggatgagtatgagcctatttgaagagaagggaagaacactttatagggagagaaaactgcatatgtaaaggtcaaagccaagggtgggaaagagcttgcctagtgttaggaacaggcaggaatccaggctggctgggcagtgggagtgctgtggcatgaggttggaaaacagacaaacgccactttgtgttgagagatttaggtttaatttcaagtgcaaactcgatcgaatctagctt

SEQ ID NO: 23525 - DNA, 601 bp, Human
agtcatcattctcagcaaactaacacaggagcagaaaaccaaacactgcatgttctcactcataagtgggagttgaaaaatgagaacacatggacacagggaggggaagatcacacaccagggcctgtcagggggtggcggggcaaggggagggagtgcattaggacaagtacctaatgcatgtggggcttaaaacctaggtgacgggttgatgggtgcagcaaaccaccgtggcacatgtatacctatgtaacaaacctgcatgttctgcacatgtatcccagtacttaaagtaaaattaaaaaaaaatcctctgcttaaagatgaacgtattgtggctcagagaagggcagagtgctgtctggtgcataaagcagagatgatctctgctgtcaaagaacctgcagtctagttggggggactaataagaaataataaacaaaataattgtaggctgtcataagggttataaaaataatcaagatgatatgcatatacaaaagaaatatatgctgtatgtttataattgatgtaaaatctatgtaacctatagaagtaatcattcctataatggtaatataatagataataactttaggta

SEQ ID NO: 23526 - DNA, 601 bp, Human
cgagttgtcactatggaacaggatcaggacactgtggctctgggtgctgatgggttctggggctttctctccacagaaaggccccaaaacttttggaccaactttgatctgcaaaatatgagagagagagagagaaatagagtgttccatctgagcagccaaaatggccactgcaggtaacacctctccactgcactctgggttttctggaagcttccatatgaacccttggtattcacttaggtttttagtgagccttaccattcaccaaatggtttcatcttcattctctcttttatartttacaatggctcttgacgtggacaaggcaggttaataatcctctacttaactatttacaatagcgaaggtgtagaaccaactcaaatgcccatcaatgatagactggcattgatgtggcacatatacactgtggaatactatgcatccatacaaaaggatgagttcatgtcctttgcagggacatggatgaagacggaagtcatcattctcagcaaactaacacaggagcagaaaaccaaacactgcatgttctcactcataagtgggagttgaaaaatgagaacacatggacacaggg

SEQ ID NO: 23527 - DNA, 601 bp, Human
acttcctttcctggtatcccactccactcccctctataagcccgatgaactttgttacagttctcagccttgattatagagctgtatggatccatattttaaaaattcaaaccagctcatgctctgattaaaaaaaaaaaaaaaacaaacttttgtgccactttcagagtgtgagaccgcctgggacgcatgctttggaatttctggagcatttgagaagttgatgggcagctaggaaattctgtgctggaactatgacaagttctggcagcccatctgccctggggaggggcaggtttcgagagtttctgtggcctggtcactcccctttcccaggcaaggctctgcaccttcagcactttgtagcctgtgtcacagctgacgagcacttggtctttgaagaaatacttggcttgggagggctcgattttcccatggacaggaggctgtagctctgggcactcatttcctggtgaggagcaaatgaaagaacagcaggtgagaaaagagaattctgaccttaaagggccagtccctagaaagcaaggcctgatgaaggtgaataaaacatggaactgggtattggaggcatggatcttcc

SEQ ID NO: 23528 - DNA, 601 bp, Human
actgctgagatcatgttgttcagcacccattctaatccacatggaaaggggcacgggggtgttgtgggtggggaggggtggtgcagctctgggccccaggggtcttgggagtgatccatttctggatgtctgcattgtgtggggtcccgtcattcactctgtcacttgctctgacttgagttcgctctccagatcgatttcattttctgccaccatggtgaagatcaaagagggatcaagagatacagaggaaggaagcagagagaggaagagaaagagagagagattagcaagcaaagcrgaaacagtttatgcaggaaatacagaaattactccaccagaattgattaagaatgcatagtttaggtacagccagtgtgaagaacagtttgggattgtggaatttgtatcgttctgagaatttgcagagtcatacatcctggctcatgaggattataaaattctgcccctggagggagctttgcctgcatctggtccaaaccctcacttgacagcatttagagtagaacagggcttgtcccggggtcaccacagcaaggtggaggcagggccagaacaatgacccataattcccagcttc

SEQ ID NO: 23529 - DNA, 601 bp, Human
agatgaaggaggggagtaaatataggtacttcttatccactaagaaggccaatcaagacaactggttttgtcctggcctctagtccaatcaccctggacaaatcatctccatttgttttgatgatccaaaagtacagatgctcttctactttgtgaggtaaatgtgtgcagctcaacactaggataatgaggcaataatatttattatttaaatactatgaacagttttaaatttattttctgttaaagccgatttttcctcctttttcagaaaatgccattgacttggtgcctaggtatwggtatcactcatctcccttaactttggtccacctgaccgcccagttcaggaattccagggttggctttagtgtggctagatggacgggcccctgggagcctgttatgtggctgatgctggcggatagatattttctgggtggaggacctactttcacatcacttcagagaagtaactttgcccactgatacagctggccctacaactaggtagagggggtgataaatagtggaaggtagagggtcttggcagtgtggaggggcgtactttcttcccaagtccacagtggcagggaaaaag

SEQ ID NO: 23530 - DNA, 601 bp, Human
tttcttttacttctagttttattgtgcaatcctctctgcctcttctgcccaagaatgaagcccttggcttagtgagaaaactctagctgacataaactaaataatcttttgttcttctagtcccaatcctaggctgagtaacagcagctaatgtgctcacattggagtttggcacaaaaaataaaaaaacccagctcctgtatgagtacacagccccaccctgctgcctctctacaggcagcttgcttggccatagaagccaggaggcagggttggaggtggatcagctttcagtcttccmctgttcattttctataattgttgatggccgcatgtttgagccataattcccagtacaggacatgaataaagatgcctgctcctcagaggtggtctttggggagctttccagtccagctcagtcttaggggagttgtcagcactgatggagcccagcgtgagtcagctgagagtcagggcatcttttcatggccatatcagaggctctggacccaaatttgtcaatcttttcattcttaaggaaatcctaatcttaggtataacagcctatgccagagtcgaagaatcatagatgaatcat

SEQ ID NO: 23531 - DNA, 601 bp, Human
cacagctgcttgggaggctgaggcgagagaattgcttgaacccaggacgtggaggttgcagtgagccgacatcacaccactgcactccagcctgggtgacagagtgagaccctgtctcaaaaacaaaaacaaaaacaaagaggagttggaggcttagatgagtcaggagaatgttctcagtgcttgcatgccagagaggcagagccgatgggccctcctttctccctgagagttccttttctgctagggactatgagtgcatgtgagcgggtgttgggctgccacaaggcagggagaggcrggttatgtctctaagcatttctcctcccagttcctcccaaacccccagtgtggccaatggtcaggttattgctggtccttcaccctctggccagtgtgctgctgcccagcccctggggcagccaggggtctctgccaggtggcatggatggggcctggacagggactgctgtggctgtgcttgagctgtggtcaggggatatgctgggctacctggggagacagaggatccactcctcgctccccaaccctgcctggacccctgtccgtaccaggggaagaggtctttgaaggaaggtcc

SEQ ID NO: 23532 - DNA, 601 bp, Human
tcagaattttcattttaacaagactctccagtaatttgtatgcatattaaagtttaaaattgatgaatccgaagctacctacactggctgcacgttagaattacctggtgaatgaaaaaagagtaaatcagtgtctggacctatatctagaccatttatgtcatgggggtggagcccaagcacagataatgttttaaacatttccttagttaattctactgctgccagggtggagaatcactgctctgatctagacctttcattatataggcaggaaccctgaggcgtggagaaagcagakatgtccagggtcacccagcaggttggtttcagggtcagggccagggccagaccccagggctcctgatagtcagcttaatgcatttcctgtgtctcagctgtcatctttctctggatggacaggcatctgcccttcgtttaatgcagggtcaggcttccattcacctcttatgtggagcagatgacaagcccataagtggctgagcccagagacatatccaagatgagccaagcagaaagaaaagctctagaacacaggggtgggggaggctgagtatcaggtcaaagttcagggtcgagg

SEQ ID NO: 23533 - DNA, 601 bp, Human
gtaaataagttaatgaacataaagcacctggtgggcacatggcacccaatgagtcaaagccagctacacctgtgcctttcctgttggctcagttcccctaaatactcctcagattacatctcagccatttttcttttgagctaaaggaagtgaacttgatgtggcaccactgaaattagaatgaaaaggaagccagctgacatgggtcacctatgtttaagtattatctcaaacacggaaatgccacagccaccacatgggatagcatctccagtttagaggtaaggggattgaggcttamtgaggttaaataacttcctgaagatcacccagctgggaaatggtcacagtggtgtttgagcctgtgctgagtattttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactatgcccggctaattttttgtatttttagtagagacggggtttcaccgttttagccgggatggtctc

SEQ ID NO: 23534 - DNA, 601 bp, Human
tcttttgtctcacccctactgtaggacctagaacatgtggcttactcattgtttttcagactctgagaccctttttcctcatctgaaaaatggaggttgcagtatttgatatactaatcattgtacaaagaggagaggcaggaacaagtgctttgtaaactacacacactgtataaatattagctactgtggagttatcactgctggctttgcagcaagcactttgttatgttgtcctccctctctacagtatgagcatctgtctcgatgctggatctgtattttatgcatttctatcttrcattgcttggagcttagtagatacccagaaaatatatatattttttgcaatgcagcaaaatcgatacataaaaataaggcattgtgactattattgcccttgatccagtgtgggggtaactgttggagtagatgtctggaataaaaagaggaaacatatgattctctttcagtcaaatcaagaactgaatgggccatattctctaaatggacaactcctgttgcccttgctgggaggaaaccagaggccattcagatccctcttgggtcatggccttccctggataaggggagaggaagc

SEQ ID NO: 23535 - DNA, 601 bp, Human
ttacttttttagggatgagggtgaagattgatgttgggcaagttgcacggtggcaaaaaagcatacagcatttaagggcagatggagatggtcaaggttgaggggagaggtgtgtcactgatcaatgctaagacccaggcaggggtttgtaagagagcttcgtctgcctggtagacacatcgaccttctgctaaggtgcatttattgaaaacagtgtatgctatgcactctgttaagtgctatgcatctattagttaatcttttcctcatcagacttttacgaggtaggtaaggtatagcrtttccatcttatgaagaaactgaagttcgaagagatgaagtcacctgcccagcactgcaaactagtaagtgatagagcctggattcggcctgtgttctgaccactctcttgctccatctctttaaagagagtgaaaagggggtgaagatacctgctctattgcccagtaatggataggccgaaggaggggggatgggaggaaggaaaggagaaatggctgctttcatcggaggatcgtcctctgctactgactgcccacagctggtggtgctggggctgaggagccaaattcagttcctc

SEQ ID NO: 23536 - DNA, 601 bp, Human
gcggtggtcttagaagagtctggacctatggaccgtggacttagactgagcagctctgaagtccagccatgctaattgttggttacataaacctcggtaagttgaacatagttgctctgactcggtttcctcatctataaagtgggagtaatcatattacccatatcatagaatagttttaagtattaagaggattaataaatgtgaaatgtttagaaaagtgcctgatgcattaaaaagtactccataaacacaagctactgctaccttttgaaactatgattagatattaaaacaggtmacaccgtatacccctctgaagactcccagggattatagaacaccccttcttttccatgtcgacaaggattcagtaagtaagtcttcccttggctaatgggttcattcaagctgcgtatttggggcaactgagtataggacaaggacatatgcaagaatgacaacaagattattatttccacactgtcacatgcttgaggcagcagtgggcgctggtgccgtgttatgcatcctcaggcagtcctagaaatagatacatggacacagataaccttcactgttgctggtatccagtcacttg

SEQ ID NO: 23537 - DNA, 601 bp, Human
agcgcacagaccttaagagttaactgtcacacctaggagtgattcttgagtctttcactaaccagatgtgtgacctcaagcaaagtgactctactaacctgagcctcaaggacctcaacagaaattggggggaaggggagttaataaaaacacccatagaggaattttgcagaattgaatgtgatcagcgtctccttcttggcacataagtgcccaatatgtagcagttaaaatggcggtggtcttagaagagtctggacctatggaccgtggacttagactgagcagctctgaagtccarccatgctaattgttggttacataaacctcggtaagttgaacatagttgctctgactcggtttcctcatctataaagtgggagtaatcatattacccatatcatagaatagttttaagtattaagaggattaataaatgtgaaatgtttagaaaagtgcctgatgcattaaaaagtactccataaacacaagctactgctaccttttgaaactatgattagatattaaaacaggtaacaccgtatacccctctgaagactcccagggattatagaacaccccttcttttccatgtcgacaa

SEQ ID NO: 23538 - DNA, 601 bp, Human
taacccagtctgtatctcttccaggagtgagacccagacagcccaggtgattccgatacacagcgaaggttgaaaattatgcctcgctagtaaaaaccatcctctgcactcctctctctgttattcatctcagctgatcatcaaaaaataggcatcatcaacctcattttacagatgaggaagtgaatcaccaagtcactgagcagattcagctgtcatctagtttcaaagccttgggttctacccccctagggaaccgctgttggcaggtagtatgaatgccatctcggttggatgagtrtaagttggggaaagctagatattctcaaaggagtgttaaacggccagattatttggcgatccagaaattcaggggaaaaggagggacattgtaagacccagcttggagcgcacagaccttaagagttaactgtcacacctaggagtgattcttgagtctttcactaaccagatgtgtgacctcaagcaaagtgactctactaacctgagcctcaaggacctcaacagaaattggggggaaggggagttaataaaaacacccatagaggaattttgcagaattgaatgtgatcagcgtctc

SEQ ID NO: 23539 - DNA, 601 bp, Human
aaggttgccaattgacatctggacaacggccatgaaactcttagtggctctccgttcctgctgcacatgtggaaagcttcgtgaagatgctcagataccacccttagattaacccagtctgtatctcttccaggagtgagacccagacagcccaggtgattccgatacacagcgaaggttgaaaattatgcctcgctagtaaaaaccatcctctgcactcctctctctgttattcatctcagctgatcatcaaaaaataggcatcatcaacctcattttacagatgaggaagtgaatcacsaagtcactgagcagattcagctgtcatctagtttcaaagccttgggttctacccccctagggaaccgctgttggcaggtagtatgaatgccatctcggttggatgagtataagttggggaaagctagatattctcaaaggagtgttaaacggccagattatttggcgatccagaaattcaggggaaaaggagggacattgtaagacccagcttggagcgcacagaccttaagagttaactgtcacacctaggagtgattcttgagtctttcactaaccagatgtgtgacctcaagcaaag

SEQ ID NO: 23540 - DNA, 601 bp, Human
ccctcaagaactgcccattttcttttcttgccctaggattctcaaaacaccaaattaagaaggaactagagagagaaggttgccaattgacatctggacaacggccatgaaactcttagtggctctccgttcctgctgcacatgtggaaagcttcgtgaagatgctcagataccacccttagattaacccagtctgtatctcttccaggagtgagacccagacagcccaggtgattccgatacacagcgaaggttgaaaattatgcctcgctagtaaaaaccatcctctgcactcctctcyctgttattcatctcagctgatcatcaaaaaataggcatcatcaacctcattttacagatgaggaagtgaatcaccaagtcactgagcagattcagctgtcatctagtttcaaagccttgggttctacccccctagggaaccgctgttggcaggtagtatgaatgccatctcggttggatgagtataagttggggaaagctagatattctcaaaggagtgttaaacggccagattatttggcgatccagaaattcaggggaaaaggagggacattgtaagacccagcttggagcgcacaga

SEQ ID NO: 23541 - DNA, 601 bp, Human
gggaagattgagaattatgcacataaggtacttgaaatctggtcatgcacactaattggtagctaataattttgtgaattactgatatatctgacatctggagttccagctatgtccaacaggaaaccaaaataagttccccacttctcctttagtctctcaagattgagacaccagaccccacttgacagctcaccttaatggtacagccagccattcatcttaccttggtggcaatggcagaaactgcagctgttctctttgcagttatgacatttccatccatgaccttggaggaaargagagacagtgagcaaggggaacccctgtccactgcataaattagaagaaacagttctaaaatattagcttaggaagttttatagcatcctacaaacagcatgggtttggcgtcagacctggatccgattcctccacttacgagatatgcaactttgaacaaacactttaatctttaagcactggtttcctcacctgtaaaaaagataatgccagccattcagagggttattgtgaggattaaatgcactcgcatatctggaaacatctagcacatggtgagccctcaagaactgcccat

SEQ ID NO: 23542 - DNA, 601 bp, Human
cttgtgtagtactagctttggtctatgggacaattatactgtcttaccaggggcaatgtggtacagggacaagaagccagtcctggaagccagagaggtcaagtattaaattcttactctagcacttattagctgtgtgatcctgggcaattcacagaagctctctgagccatattccttgacctggaaggtggagagaatttctcatttcgattcttcaagactgatgggaagattgagaattatgcacataaggtacttgaaatctggtcatgcacactaattggtagctaataatttygtgaattactgatatatctgacatctggagttccagctatgtccaacaggaaaccaaaataagttccccacttctcctttagtctctcaagattgagacaccagaccccacttgacagctcaccttaatggtacagccagccattcatcttaccttggtggcaatggcagaaactgcagctgttctctttgcagttatgacatttccatccatgaccttggaggaaaggagagacagtgagcaaggggaacccctgtccactgcataaattagaagaaacagttctaaaatattagctta

SEQ ID NO: 23543 - DNA, 601 bp, Human
aatgaggccattaataccttctctgccttcctcacagaaactcgtagtccagacaaggggctggaaatgagtttgaaaaagactaaagctctttgcaaatgacagtaatacaagattcattctgttcccaaattaccagcaaacatagcaaggagtccttgattacttcagttgagtcaggtctggatataactaaaaaccagttcattgaggtgggtgctgttggtctactccctttgcatacaattaccagattaatcctcccattcttccctccccagcaggtatctagaaaacctcgacatgcaacctgaacacctggtctttgctgctgcaactttccctgggttaccacgtttcctttataataacttaggaaaaccagtgtcccaagaccttgtacttccacatttaatgtgaaagactccagactccaatcgttcccacagacaccctgtttcctaagcctcatcctcttaactctaacttttaaaaatgctgtttttcttataggatgccttgacattgcttgggaacatcatcacccccattgcttactgttccctctgcctggagtgcccctccgtgtttttgcatggtt

SEQ ID NO: 23544 - DNA, 601 bp, Human
ggacccgcaggaacctggttgtatgacttcaggaaacccaagtttctattcttttatgcgtaaaatgaggccattaataccttctctgccttcctcacagaaactcgtagtccagacaaggggctggaaatgagtttgaaaaagactaaagctctttgcaaatgacagtaatacaagattcattctgttcccaaattaccagcaaacatagcaaggagtccttgattacttcagttgagtcaggtctggatataactaaaaaccagttcattgaggtgggtgctgttggtctactcccttygcatacaattaccagattaatcctcccattcttccctccccagcaggtatctagaaaacctcgacatgcaacctgaacacctggtctttgctgctgcaactttccctgggttaccacgtttcctttataataacttaggaaaaccagtgtcccaagaccttgtacttccacatttaatgtgaaagactccagactccaatcgttcccacagacaccctgtttcctaagcctcatcctcttaactctaacttttaaaaatgctgtttttcttataggatgccttgacattgcttgggaaca

SEQ ID NO: 23545 - DNA, 601 bp, Human
tcttctgggagcacagatttttattaatgcaacaaagcagtgttattgcaggctgggtctacaaaagtgtggtttccagacctggttgatcctcactctgtgattttgattcagtaggcatgggaatttgagtttttaaaaacttccctagctaatgctgctgcatagcttgcttctgttggaaacttcttatctgggacaagaccatgtggcctcaaaaggacccgcaggaacctggttgtatgacttcaggaaacccaagtttctattcttttatgcgtaaaatgaggccattaatacyttctctgccttcctcacagaaactcgtagtccagacaaggggctggaaatgagtttgaaaaagactaaagctctttgcaaatgacagtaatacaagattcattctgttcccaaattaccagcaaacatagcaaggagtccttgattacttcagttgagtcaggtctggatataactaaaaaccagttcattgaggtgggtgctgttggtctactccctttgcatacaattaccagattaatcctcccattcttccctccccagcaggtatctagaaaacctcgacatgcaacctgaacac

SEQ ID NO: 23546 - DNA, 601 bp, Human
taaaatagaccctttgttccttattgaaacagttcatctgagcccctggaaataaagctgtgaagtttcagcctaaactttgaagtgtctaaactttgaagtgtcaacccaaggcttcttgattcttctgggagcacagatttttattaatgcaacaaagcagtgttattgcaggctgggtctacaaaagtgtggtttccagacctggttgatcctcactctgtgattttgattcagtaggcatgggaatttgagtttttaaaaacttccctagctaatgctgctgcatagcttgcttctsttggaaacttcttatctgggacaagaccatgtggcctcaaaaggacccgcaggaacctggttgtatgacttcaggaaacccaagtttctattcttttatgcgtaaaatgaggccattaataccttctctgccttcctcacagaaactcgtagtccagacaaggggctggaaatgagtttgaaaaagactaaagctctttgcaaatgacagtaatacaagattcattctgttcccaaattaccagcaaacatagcaaggagtccttgattacttcagttgagtcaggtctggatataacta

SEQ ID NO: 23547 - DNA, 601 bp, Human
ttgatgtgatctttggactatatcttgcctcccccactggaccctgtactacatgagggcaagtactgtatctggttttgcttaccccatgctgagcgtagaaccttgcatttggtggacactcaaatatttgttgaataaatgtatgtcagtgctaaaccctaatatatactatcaccttgagaaaacatatcagaggcttcaatgaagcttatgtgagacccaagcacaaaaaatgtattatgttcatcagaccctagagctccatatacttattctccccaacaagagccctaaataraagagaaatgatggacaagaaaatattctactctcaaggcaacaagtaaaatagaccctttgttccttattgaaacagttcatctgagcccctggaaataaagctgtgaagtttcagcctaaactttgaagtgtctaaactttgaagtgtcaacccaaggcttcttgattcttctgggagcacagatttttattaatgcaacaaagcagtgttattgcaggctgggtctacaaaagtgtggtttccagacctggttgatcctcactctgtgattttgattcagtaggcatgggaatttga

SEQ ID NO: 23548 - DNA, 601 bp, Human
gggattgcaggcgtgagccactgcgcccagcctattgatgtgatctttggactatatcttgcctcccccactggaccctgtactacatgagggcaagtactgtatctggttttgcttaccccatgctgagcgtagaaccttgcatttggtggacactcaaatatttgttgaataaatgtatgtcagtgctaaaccctaatatatactatcaccttgagaaaacatatcagaggcttcaatgaagcttatgtgagacccaagcacaaaaaatgtattatgttcatcagaccctagagctccrtatacttattctccccaacaagagccctaaataaaagagaaatgatggacaagaaaatattctactctcaaggcaacaagtaaaatagaccctttgttccttattgaaacagttcatctgagcccctggaaataaagctgtgaagtttcagcctaaactttgaagtgtctaaactttgaagtgtcaacccaaggcttcttgattcttctgggagcacagatttttattaatgcaacaaagcagtgttattgcaggctgggtctacaaaagtgtggtttccagacctggttgatcctcact

SEQ ID NO: 23549 - DNA, 601 bp, Human
attttttttttttttttttttttttttttagtacagatggggtttttccatgttggtcaggctggtcttgaactcctgacctcaggtaatctgcctgcctcagcctcccaaagtgctgggattgcaggcgtgagccactgcgcccagcctattgatgtgatctttggactatatcttgcctcccccactggaccctgtactacatgagggcaagtactgtatctggttttgcttaccccatgctgagcgtagaaccttgcatttggtggacactcaaatatttgttgaataaatgtatgtyagtgctaaaccctaatatatactatcaccttgagaaaacatatcagaggcttcaatgaagcttatgtgagacccaagcacaaaaaatgtattatgttcatcagaccctagagctccatatacttattctccccaacaagagccctaaataaaagagaaatgatggacaagaaaatattctactctcaaggcaacaagtaaaatagaccctttgttccttattgaaacagttcatctgagcccctggaaataaagctgtgaagtttcagcctaaactttgaagtgtctaaactttgaagtg

SEQ ID NO: 23550 - DNA, 601 bp, Human
agctaattttttttttttttttttttttttttttagtacagatggggtttttccatgttggtcaggctggtcttgaactcctgacctcaggtaatctgcctgcctcagcctcccaaagtgctgggattgcaggcgtgagccactgcgcccagcctattgatgtgatctttggactatatcttgcctcccccactggaccctgtactacatgagggcaagtactgtatctggttttgcttaccccatgctgagcgtagaaccttgcatttggtggacactcaaatatttgttgaataaatgyatgtcagtgctaaaccctaatatatactatcaccttgagaaaacatatcagaggcttcaatgaagcttatgtgagacccaagcacaaaaaatgtattatgttcatcagaccctagagctccatatacttattctccccaacaagagccctaaataaaagagaaatgatggacaagaaaatattctactctcaaggcaacaagtaaaatagaccctttgttccttattgaaacagttcatctgagcccctggaaataaagctgtgaagtttcagcctaaactttgaagtgtctaaactttg

SEQ ID NO: 23551 - DNA, 601 bp, Human
tcagcctcccaagtagctgggattacaggcacctgccaccatgcccagctaattttttttttttttttttttttttttttagtacagatggggtttttccatgttggtcaggctggtcttgaactcctgacctcaggtaatctgcctgcctcagcctcccaaagtgctgggattgcaggcgtgagccactgcgcccagcctattgatgtgatctttggactatatcttgcctcccccactggaccctgtactacatgagggcaagtactgtatctggttttgcttaccccatgctgagcgyagaaccttgcatttggtggacactcaaatatttgttgaataaatgtatgtcagtgctaaaccctaatatatactatcaccttgagaaaacatatcagaggcttcaatgaagcttatgtgagacccaagcacaaaaaatgtattatgttcatcagaccctagagctccatatacttattctccccaacaagagccctaaataaaagagaaatgatggacaagaaaatattctactctcaaggcaacaagtaaaatagaccctttgttccttattgaaacagttcatctgagcccctggaaa

SEQ ID NO: 23552 - DNA, 601 bp, Human
cacaagtaactgattatccttcaatctcagctcaaatatcccctacagagacacagccacaggctagatcaagacatactgctttacactcttacagcacttgtcagcgttgtagtttcatatttattggtgtgaatttttttttttttttggagactgagtctcactcgttgtccaggctggagtgcagtggtgtgatcttggctcactgcaacctccgcctccaggattcaagcaattcccttgcctcagcctcccaagtagctgggattacaggcacctgccaccatgcccagctaawtttttttttttttttttttttttttttagtacagatggggtttttccatgttggtcaggctggtcttgaactcctgacctcaggtaatctgcctgcctcagcctcccaaagtgctgggattgcaggcgtgagccactgcgcccagcctattgatgtgatctttggactatatcttgcctcccccactggaccctgtactacatgagggcaagtactgtatctggttttgcttaccccatgctgagcgtagaaccttgcatttggtggacactcaaatatttgttgaataaatgtatgtca

SEQ ID NO: 23553 - DNA, 601 bp, Human
aagctcatgtacttccttcaaccacagggcctttgcatgaattaattccttgccatacaatgctaggctgctttgtcccctctccccctcacaagtaactgattatccttcaatctcagctcaaatatcccctacagagacacagccacaggctagatcaagacatactgctttacactcttacagcacttgtcagcgttgtagtttcatatttattggtgtgaatttttttttttttttggagactgagtctcactcgttgtccaggctggagtgcagtggtgtgatcttggctcactgyaacctccgcctccaggattcaagcaattcccttgcctcagcctcccaagtagctgggattacaggcacctgccaccatgcccagctaattttttttttttttttttttttttttttagtacagatggggtttttccatgttggtcaggctggtcttgaactcctgacctcaggtaatctgcctgcctcagcctcccaaagtgctgggattgcaggcgtgagccactgcgcccagcctattgatgtgatctttggactatatcttgcctcccccactggaccctgtactacatgagggcaa

SEQ ID NO: 23554 - DNA, 601 bp, Human
ccataaaatatagtttaacatctctgatttgaaaaggtttcaaaatgataatatccacaagactagaaatcttatgttgctgtctgataaggataattagatttttttccttaattgttaccattttcttctgttctcagttaatatgaatctattcttgaaagtacaggtgagcttcagaaattgttacagtatcccataaaaataaccttcaacttcctaaactaaatgtgtaattctaattggttgtcttacttgataatttgttgccctggtaatagtgtgataattgatatttttwaaatttttttttttttccgagacagtctcgctttgtcgcccaggctggaatgcagcggtgtgatctcagctcactgcaacctctgcttcctgggttcaagcgattctcatgcctcagcctcccgagtagctgggattacaggtatgtgccaccatacttggctaatttttttttttttttttggtaaagatggggtttcgccatgttggccaggctggtctcgaactcctgacctcaagtgatccacctgcctcggcctccaaaagtgctgggattacaggtgtaagccactgcacccag

SEQ ID NO: 23555 - DNA, 601 bp, Human
tcagtggagaaccactggcatagaggaaagacatcacttggccctcgacaccatatgtattaaataaaaccctcttctgccttttctctattccatttagtaaactttgagttccctgtggtctgttcttttataaaatgctactcactggaattctggagtataatatttaaaaagtgaaaagtcttcttaactactaattactagcaaaacagcatctctgaaatattaggaattaattttatctcctgcagctaccgaaggagagataccattctgtgccataaaatatagtttaacrtctctgatttgaaaaggtttcaaaatgataatatccacaagactagaaatcttatgttgctgtctgataaggataattagatttttttccttaattgttaccattttcttctgttctcagttaatatgaatctattcttgaaagtacaggtgagcttcagaaattgttacagtatcccataaaaataaccttcaacttcctaaactaaatgtgtaattctaattggttgtcttacttgataatttgttgccctggtaatagtgtgataattgatattttttaaatttttttttttttccg

SEQ ID NO: 23556 - DNA, 601 bp, Human
tgccctctcttctgcctccctcaagagcttgcaggcaatcaagagaatttccttttgtgtctagtttcccccgtatcaagtgggaaaagaaggaagaaggcttcactgaacagctaatgtatgccaatgctttgcccccatgatctcatttagtctagacattggccctacgagttggggactcctactatcttcttcttacagatgaagagactgaggttgccctggtaacagaaaggtgaacttgctctgggtcttacaactactttttaaaattatttatttatttctttttctttcyttctttcttttctttttttttgagacggagtctcgctctgtcgcctaggctggagtgcagtggcacgatcttggctcattgcaacctctgcctcctgggttccagtgattatcctacctcagccccccgtggagctgggattataggtgtgcgccacaacacccagctaatttttgtattttcaatagagatggggtttcaccatgttggccaggctggtctcaaactcctgacctcaggtgatctgtgcacctcggcctcccaaagtactgggattacagacgtgagccaccgcaccta

SEQ ID NO: 23557 - DNA, 601 bp, Human
ctgggcgcagtggttcacgcctgtaatcccagaactttgggaggacaaggcaggtggatcacctgaggtcagaagttccagactagcctggccaacatggtgaaaccccatctctactaaaaatacaaaaattagccaggtgtggtagtgggcgcctataatccaagctacttgggaggctgaggcccaagaatcacttgaacccaggagatggaggttgcagtgagccgagattatgccactgcactgcagcctgggcgacagcgcgagactccatttcaaaaaaaaaaaaaaaaaaaaagtcatggccaaaactgcaattacttttgcactcacctaatagtctatatttctcaaggcagtggttttattttcatcattaaatcatactttaaaactgctccatccctttcatacacacacataaaataacaatagcatcaaaaattcccagggggaagcatgagacgcagtggggggaaggtggaccagtatggagactgcaaaagagagaggctgtggcctcctggtctccaggtctcatcccacccagtttcttgatccacaaccttgaatacttaaaaactctggattctcctaa

SEQ ID NO: 23558 - DNA, 601 bp, Human
atgaaagggcatttttcttttgttttcttccttgtattaaaagtaatggcaactgggcgcagtggttcacgcctgtaatcccagaactttgggaggacaaggcaggtggatcacctgaggtcagaagttccagactagcctggccaacatggtgaaaccccatctctactaaaaatacaaaaattagccaggtgtggtagtgggcgcctataatccaagctacttgggaggctgaggcccaagaatcacttgaacccaggagatggaggttgcagtgagccgagattatgccactgcactscagcctgggcgacagcgcgagactccatttcaaaaaaaaaaaaaaaaaaaaagtcatggccaaaactgcaattacttttgcactcacctaatagtctatatttctcaaggcagtggttttattttcatcattaaatcatactttaaaactgctccatccctttcatacacacacataaaataacaatagcatcaaaaattcccagggggaagcatgagacgcagtggggggaaggtggaccagtatggagactgcaaaagagagaggctgtggcctcctggtctccaggtctcatcccac

SEQ ID NO: 23559 - DNA, 601 bp, Human
tcttgctataacacccagggccatctgaaggtctacagaggccccaggcaccctcatgtctagagccccctctcctgcccctcatcctatcacacatattaaaaagcatatacatgtcacataaaaaattacagtacaaaagaaatttaaaggtttataattcttagtgttaagaaaaagtgactcatttggcctttctgatttaaatttcatcacattttagaattgagctgtgaattaccatttgccataattttacatgttatggtcaggcgtagtggctcatacttgtaatcagtcrcagcactttgggaggctgaagtgggtagagtgcttgaggccaggagttcgagaccagcctggccaacatggtgaaaccttgtctctaccaaaaattacaaaaaattagctgggcatggtggcacatgcctgtagtcccagctactcgggaggctgaagtgggagaatcgcttgaacccaggaggcagaggttgcagtgagctgagatctcgccactgcactccagcctgagcgacagagtgagaccctgtcccaaaaaaagaaaaaaaacttacattttatagaacattaaatattcttt

SEQ ID NO: 23560 - DNA, 601 bp, Human
atcttgaaggttgtttgtgcggagagttctatagaacaaaagcactagctaaggaagcttgtaaataaatcataagctggtgggaacaaaacccccgtttctcaggccactccttctcactggactatttcccctgcacaaccactgcttatgagccgggcgagttctcaaagggttgtgtgaggtcactcaggcggatggaggtgggccaggcagtaaagagagagaggcctgactcaaacaaggctctggcttggttgtgatggggctaaatgagtgagggtcgcagacaggcttgacrgggtgtgggggcaggaggagggaggcatggggcagggtggaactgggcctgtccctccgctgagctgtaaactaagtaaaatctgttgttggtatttccctgttgtctgcgcttgtgacacatttttcttaaatgtatgtgttgcctctgtgaacacataaaccaattttgtccctgggccaggaaaacagaagagatgccttgactcaaaatcaagtcagcccttcctggagaatgattccaagtgagagagggatccaacataagggagattgtctgtggctggatgtgaggatggag

SEQ ID NO: 23561 - DNA, 601 bp, Human
tttctccctttgttccctcccgttctgttctccctcattctaatttccaaagagagttgtgtaaaaatgtccatcttgaaggttgtttgtgcggagagttctatagaacaaaagcactagctaaggaagcttgtaaataaatcataagctggtgggaacaaaacccccgtttctcaggccactccttctcactggactatttcccctgcacaaccactgcttatgagccgggcgagttctcaaagggttgtgtgaggtcactcaggcggatggaggtgggccaggcagtaaagagagagargcctgactcaaacaaggctctggcttggttgtgatggggctaaatgagtgagggtcgcagacaggcttgacagggtgtgggggcaggaggagggaggcatggggcagggtggaactgggcctgtccctccgctgagctgtaaactaagtaaaatctgttgttggtatttccctgttgtctgcgcttgtgacacatttttcttaaatgtatgtgttgcctctgtgaacacataaaccaattttgtccctgggccaggaaaacagaagagatgccttgactcaaaatcaagtcagcccttcc

SEQ ID NO: 23562 - DNA, 601 bp, Human
gagaaacaggaaatctatttgcatatgtcactccttgagttttagattactctatggtccaaaccaaacacatctgctggctggatccagcccctggctggctagtctttgaaaactgctataaagccttatacaaatataagacagcatttatatgccttcttccactgccgccccgttttctccctttgttccctcccgttctgttctccctcattctaatttccaaagagagttgtgtaaaaatgtccatcttgaaggttgtttgtgcggagagttctatagaacaaaagcactagctaaggaagcttgtaaataaatcataagctggtgggaacaaaacccccgtttctcaggccactccttctcactggactatttcccctgcacaaccactgcttatgagccgggcgagttctcaaagggttgtgtgaggtcactcaggcggatggaggtgggccaggcagtaaagagagagaggcctgactcaaacaaggctctggcttggttgtgatggggctaaatgagtgagggtcgcagacaggcttgacagggtgtgggggcaggaggagggaggcatggggcagggtggaactgggcc

SEQ ID NO: 23563 - DNA, 601 bp, Human
ttgatctccatcattcccattcctcaccctcaaccagttcttttaatatctatttttttctttttggagagagggtctcactctgttgcccaggctggagtgtagtggtgcaatcagaactcaccacaggctgggtgcagtggctcatgcctgtaatcctaacactctggaaggctgaggtgggtggttcacttgaggtcaggagttcaagaccagcctggccaacatggtgaaaccctgtctctactgaaatacaaaaattatctgggcatggtagcacacgcctgtaatcccagctacctgggaggctgaggcaggagaatctcttgaacctgggagttggaggttgcagcgagccaagactgcgccactgtgctccaaaccaggcgacagagtgagactccatctcaaaaaacaaacaaacaaaaactcaccacagcctcaaactcctgagctcaagtgatcctcccgcctcagcctcccaaactgttgggaccacagacgcctgccactatgcccctttccctctcctcacccccggttctctcttaactcatgacaaaagaaaaaaaacaacaacaacaaaaactcagtgtcaggg

SEQ ID NO: 23564 - DNA, 601 bp, Human
acaggaacaccttcctcacaaaaatcccgaaacagagacatcacttggtgcttattcacacctcactctcctcttgatctccatcattcccattcctcaccctcaaccagttcttttaatatctatttttttctttttggagagagggtctcactctgttgcccaggctggagtgtagtggtgcaatcagaactcaccacaggctgggtgcagtggctcatgcctgtaatcctaacactctggaaggctgaggtgggtggttcacttgaggtcaggagttcaagaccagcctggccaacayggtgaaaccctgtctctactgaaatacaaaaattatctgggcatggtagcacacgcctgtaatcccagctacctgggaggctgaggcaggagaatctcttgaacctgggagttggaggttgcagcgagccaagactgcgccactgtgctccaaaccaggcgacagagtgagactccatctcaaaaaacaaacaaacaaaaactcaccacagcctcaaactcctgagctcaagtgatcctcccgcctcagcctcccaaactgttgggaccacagacgcctgccactatgcccctttccctc

SEQ ID NO: 23565 - DNA, 601 bp, Human
tttgcctttctattctatatcccacctcattgctaaaagattttgagacgacatagcattcatttacagggtgtctactctctgtgggatgttttgcacgtactatttatggttctcgcaagtacatttcaaagtctggttctcacttaacagatgcacgaatggaggctcaaagaagtgaaggtgtttgccaaggttaaggatctgatgggtgaatccaggtctgagagagcacctaggcgctcacacctcttctgcttaacaggaacaccttcctcacaaaaatcccgaaacagagacrtcacttggtgcttattcacacctcactctcctcttgatctccatcattcccattcctcaccctcaaccagttcttttaatatctatttttttctttttggagagagggtctcactctgttgcccaggctggagtgtagtggtgcaatcagaactcaccacaggctgggtgcagtggctcatgcctgtaatcctaacactctggaaggctgaggtgggtggttcacttgaggtcaggagttcaagaccagcctggccaacatggtgaaaccctgtctctactgaaatacaaaaattatctg

SEQ ID NO: 23566 - DNA, 601 bp, Human
ttttatgctgattataaccgtaaaatgaggccagaaggtgggcaacacagtcttatcatgttggccacattgggaaggtttccaggctgcaagaagcttccaatcccacttctttagaggacagcccagcaaaaaaataaaatccactgagcttctccttccaggaacacacatgtcaccacccataatgcccatatttttctggaatggaattaaagagggttgcaaaatgtttaggagctccttcccctacaaggaggtggggtggctgaggtctggagcagaccaaactggaagggargttaatgaaaccctgggatccaggtgaggccagccaggtggcagccctgactggggtcagaagggcctcacccctgacagcaggacatctccagactccttcagggcagcctcctgggaatccacgtacagcacagcttctttcatgagctcatcatccagttctctccagtcaggtctgctggctccaacagctaagagacagcaaaacagaccttaagcccaggattagtgccaaaggctgctaagaagcccaaagcacaggagagaggtgaacaaaggactcgtgaacacactcaga

SEQ ID NO: 23567 - DNA, 601 bp, Human
atttcagtgttttaggtgtatcagctctgttcccatgtactttatttatttattttttgagatggagtcttgctctgttgcccaggctggagtgcatgatgtcagctcactacaacctccaccttccgggttcaagtgattctcctgcctcaacctcccaagtagctgggattgcagatgtgcaccaccacgcctggctaatttttgtatttttagtagagatggagtttcaccatgttggccaggctggtctcaaactccttagctcaagtgatctgcccaccttggcctcccaaagtgytgggattacaggcgtgagccaccgagctcagcctgttcccatgtacttctgtttccttcaatctcatagggtggaagaggacctggggcaagggacagactggccactgggagcccaccctttgttgggcttctataaggtaccccatacaactcaggtggtagggggctccccatggaagccctcctcaaagcagcaagtgggagagtagggaaggagggaatgaacagggcttaggctatactttccatctgactctttcaggttgggtctctgccatttcccttaaggttcctgtct

SEQ ID NO: 23568 - DNA, 601 bp, Human
agattttaaagacatttaccaacctgcaaggcatggatacttaaccaatggcatgggctctgggtggccagagcgctcctgatgctctgccaggcatttactcttttgctgcttgatcacgaagtatggaaggtcatgagagggggacagagggcactctcgaggggctcaggatagcaactgtttaccaaccagtttgggagtatttcagtgttttaggtgtatcagctctgttcccatgtactttatttatttattttttgagatggagtcttgctctgttgcccaggctggagtgcaygatgtcagctcactacaacctccaccttccgggttcaagtgattctcctgcctcaacctcccaagtagctgggattgcagatgtgcaccaccacgcctggctaatttttgtatttttagtagagatggagtttcaccatgttggccaggctggtctcaaactccttagctcaagtgatctgcccaccttggcctcccaaagtgctgggattacaggcgtgagccaccgagctcagcctgttcccatgtacttctgtttccttcaatctcatagggtggaagaggacctggggcaagggac

SEQ ID NO: 23569 - DNA, 601 bp, Human
atcctttgatatctcccctttgtcttgtaattttggtagataccttaacctctgcacccagcacagataattaggtgcttgatacgcatctgttagatgaaacaatgcaccaataaactgatccccaaaagtaagaaagcaaaaattgccaaaaaggacagaacaagtttctgcagcattttggctccttaagtaggggctggctgacctctgatctgccatgacctttgaagttttcagacaaaactggatccatgtgatgtctttgaaccaggctccagataaaattgtattgcctttrtcttccagtgcatgagagattttaaagacatttaccaacctgcaaggcatggatacttaaccaatggcatgggctctgggtggccagagcgctcctgatgctctgccaggcatttactcttttgctgcttgatcacgaagtatggaaggtcatgagagggggacagagggcactctcgaggggctcaggatagcaactgtttaccaaccagtttgggagtatttcagtgttttaggtgtatcagctctgttcccatgtactttatttatttattttttgagatggagtcttgctctgttg

SEQ ID NO: 23570 - DNA, 601 bp, Human
atctaaaaaccatttctagctcataggccacacaaaagcaggcagcagagcaggtctggccccaggactgtagttttctgacgcttggtccagtttgaatgctgcatcctttgatatctcccctttgtcttgtaattttggtagataccttaacctctgcacccagcacagataattaggtgcttgatacgcatctgttagatgaaacaatgcaccaataaactgatccccaaaagtaagaaagcaaaaattgccaaaaaggacagaacaagtttctgcagcattttggctccttaagtargggctggctgacctctgatctgccatgacctttgaagttttcagacaaaactggatccatgtgatgtctttgaaccaggctccagataaaattgtattgcctttgtcttccagtgcatgagagattttaaagacatttaccaacctgcaaggcatggatacttaaccaatggcatgggctctgggtggccagagcgctcctgatgctctgccaggcatttactcttttgctgcttgatcacgaagtatggaaggtcatgagagggggacagagggcactctcgaggggctcaggatagca

SEQ ID NO: 23571 - DNA, 601 bp, Human
gttgtaactactaaataaatacataaaaaagaagtttcattatagccagtgtagctcccccagggagtaaatgggagcatctgatccctctcagtttccttgtgatagtaatagaagttaccgaagcaaacactgcacaattggaatgtgctttatttcagggaaatataaagggaaatgaatgctattataacttggtagaacagaagaaatggctacctagctttgctttccaactacaaacataaatgaggatctcagcatttaaggtaaaacatgataagcacaaaaggagagttcrctggggactggactccctcatttactctagaaattatgagaaccagcagcaatattcctcaagcatccatctcaacatcaagttcctttgttttatttaccagatgaccaggaatcatagatgagtttggctgcaactgtgtcttccactgccattcctagaatagacagaaatttggttcgcctttggtcaaaacaacttttcttgaaacaacccaggccccatggctggaagtttcctgatacatgtccatgttgccaatgcctattggaataacagggactgatacccagagatgag

SEQ ID NO: 23572 - DNA, 601 bp, Human
aaaaatggctccttccgaaagatcatacttgccagcatacaacccaaactccacatatccaaactataatcgtacatctgatagtctacaagtagctcaggacctttgaagtatcgggaagcaactcggacattatattcttggccaggatgataaaactcagccaaaccccagtctattagtcgtagctttctgtgctcatgatcaatcatgacattatggggcttgacatctctgtgcataattcccatgctgtgacaataatccagggccttcagaatctcatacatgtaaaatcgartatcatagtctgtgaacgtctggtacaattgcttgaagtctgtgttgtttacgtgttcaaaaaccaaggcgggggttcgtgacacagggtcttttacaatgtctgccagtgtgatgatgttgggacctcctctcaaattctccaaaatctttatttcacgcttaattttcttcttttttactggcttgagaattttaacaacaactttttcattatttgtgatgttgatggcttcaaatacttcactgtatttacctcggcctaattttcgaaccagctggtagtcatcttgatttcccc

SEQ ID NO: 23573 - DNA, 601 bp, Human
gaacccattcgagcctggtccttcacaacagtgtagaaataggggtgctccatggcctctcttgcagtaagccgtgactggtggtcatatcgcagcagtttgtccaggaaatccaaggcctcagggctgacaaggtgctgattttcacggtggacaaagcgttcccatcgctttcgagagtgtctgcccaagatatcattgaaacgtggatctaattcaatgttgtatttgtcaatatagccatataaatcttctgtccccagaaccttggctatcctcaccaactgatcataattgtcaygtccatggaaaaatggctccttccgaaagatcatacttgccagcatacaacccaaactccacatatccaaactataatcgtacatctgatagtctacaagtagctcaggacctttgaagtatcgggaagcaactcggacattatattcttggccaggatgataaaactcagccaaaccccagtctattagtcgtagctttctgtgctcatgatcaatcatgacattatggggcttgacatctctgtgcataattcccatgctgtgacaataatccagggccttcagaatctcatacatgt

SEQ ID NO: 23574 - DNA, 601 bp, Human
tacttaatacagagaactatgaggtatttcttgacttaggagtaccgtgaaaaattaaagacagtataagtgttataaattgagaaagtttggaaacttctacttttcagtgtcaaatatgaaaaagttcctgtggtaaggaactatatgctaagttcccaatatatgacagtgcacagcatagttataactaaattaaaagttgtatattggtctcccagaggccaaatctggcctgtgcattgtttttttaaaatcttgagccaacacttaaaagtcaggaaaattcatatacaaatayaaatttctggcttttatttgcaaaacagagtatcaagcaacaatggacttgcattactgcagggcaatcatcagcttcagctgagaagcagctaactccttttgaagaggcatgtgtttcccagtttgtttcagtccctaccactcacatcacctaagcaagggcaattacacccgactagctgcactaatatcatctgtctgtccccctcgagtcctgtgactcctcatctttacaaagtagaggcaatgatttatttattgaaaacaaaagcctcattatataatgaaaagtaaagga

SEQ ID NO: 23575 - DNA, 601 bp, Human
tttgtatttttagtagagacagggtttcatcatgttggtcaggatcgtctcgaactcctgacctcatgatccgcctgccttggccttccaaagtgctgggattataggcatgagccactgtgcctgggcttatattataaagccttctcctgaatagtctaaaacagtgctggcccaaaggaaatataatacaaaccacatgtgtaattttaaatgtgttagtagccacatcaagaaaattttaaaaaggacaaaattaatgtactttattaatctaaaatcttaacatataaatcaatayaaaaattattaatctattttacctttttttgtattaaacccttgaaatctaatgtattttactcttacagcatatctcaattcagcccagccatatttcaagtgcttaacagcctcatgtggcctgcgtgcctgctgtactggactgtgcaggtcttttcctagggtgttggtcacctcagactagatgcactgcatataactcttagaagttaagtacatctcatctcttcattaacaagattggtggttactaaagtttgatgaccaacaatcacctggatttttttaatatacagac

SEQ ID NO: 23576 - DNA, 601 bp, Human
aaagacccaagctagttaaatggtatatctgattaagcactttcaaagcaggacttaatgatgagggttgggggagggaacaaaaagaggccagttgtgctccaggtcaaacaccatctcagctctggcgggccttgctaacacctactatactcaccacagggtcttttacaatgtctgccagtgtgatgatgttgggacctcctctcaaattctccaaaatctttatttcacgcttaattttcttcttttttactggctgaaaggggaaaagtacatcagcaaaaaaaaaaaaaaaaawttttttcagagtatttcaacacgtagtgtaatacataaatgataaatggcttacttatgagcacaccttgaaggaagaaaatgtgtcacattcgtctctgaatccttctcctagcactgtgccaggtattctgcaggtacttacaaatgttgaattgaaagaaaaaaagatttctattccaaagaccagacacttctgcagaattagcatttcaatcatcagtcttgatgttaatgttttaaaacatgttaaacatgttaatgtcttaaaaccttacaaagtagcaatttaaatcgttag

SEQ ID NO: 23577 - DNA, 601 bp, Human
gaaagacccaagctagttaaatggtatatctgattaagcactttcaaagcaggacttaatgatgagggttgggggagggaacaaaaagaggccagttgtgctccaggtcaaacaccatctcagctctggcgggccttgctaacacctactatactcaccacagggtcttttacaatgtctgccagtgtgatgatgttgggacctcctctcaaattctccaaaatctttatttcacgcttaattttcttcttttttactggctgaaaggggaaaagtacatcagcaaaaaaaaaaaaaaaaaattttttcagagtatttcaacacgtagtgtaatacataaatgataaatggcttacttatgagcacaccttgaaggaagaaaatgtgtcacattcgtctctgaatccttctcctagcactgtgccaggtattctgcaggtacttacaaatgttgaattgaaagaaaaaaagatttctattccaaagaccagacacttctgcagaattagcatttcaatcatcagtcttgatgttaatgttttaaaacatgttaaacatgttaatgtcttaaaaccttacaaagtagcaatttaaatcgtta

SEQ ID NO: 23578 - DNA, 601 bp, Human
aggatcaatatcggggtggctgaataaacagtgaactgaaagttacaggcagtgctggctatcattgcattaggccagtacatttttcaatgggtataacatatattacctgatcataattgtcatgtccatggaaaaatggctccttccgaaagatcatacttgccagcatacaacccaaactccacatatccaaactataatcgtacatctgcataaaagtaaactcactgttattatctgtgaatcctcaggcttgtcacttcaaaataaaaaattaatttttaaaattaaaaaaaaatcactccactgactcaaaatcaaaacactaataacatcttcatatatttctttttagtctttcttttttttttttttggagacagagtctcactctgctgcccatgctggagtgcagtggcgcaatcttggctcaccacaacctccgcctcccgggttcaagcaattctcctgcctcagcctcctgactagctgggactacaggcgcgtgccaccatgcctggctaattttgtatttttagtagagacggggtttcactacgttggccagtggtctcaaactcctgacctcatgatctgc

SEQ ID NO: 23579 - DNA, 601 bp, Human
tgcttaagccacagatgcacatattttgtttcatgacttacctgcccaagatatcattgaaacgtggatctaattcaatgttgtatttgtcaatatagtcatataaatcttctgtccccagaaccttggctatcctcaccaactagtattaaagaaagacaaaaacccatatcacaagcatattatattaacaaatcaacaattaacaatgattgaatttacataaacgggtcatcatgtctacaggtatgaatgctacctcctaacagtttagacttcaactcaatgtgatagtgttagmaaaagcaaactactttataaactggtttcttcctcttgaaatgtcaccctggtgaacccttatttttctcccctcaaaacccaattgaagatgtcacttcttttgggaagctcccattgcacactcaaactactcaccactactgccttttgtgccttgtccacatttctactctgaagttatgactgtaacctattttgttgtatgtttgactcccttacaagatcagctatgaactatctgaggggaagaaaactattctttcttttttctgtattcctcagtactgcatgcacttga

SEQ ID NO: 23580 - DNA, 601 bp, Human
ggctacaagtaagtttggatatacattactctgtacagaggtaggatactcaaggggtaaattctagaaggcagttagttcttttcttaaaaaagaggagggcaacagcaattatttgaggatatgtaagtaaatgccttcactaccagatatgcacccacttggatgttgcctatatgtataattcttatgctatgtgcctgtagttcctttggaataactgggtactctataaaaattcactgtgcgtcacaatgatccaataatggaaaaccattttacttatgtttttacaactgayaggcactctatagttgctctggcacatgtcacggaactgtccttgtacacatacacacctatgtataaaccccacctctataccccatttcttaacattgtttctaagggccatgtaactactgtcatttcaaactataagatgaaatggtgtatttttccttttcatggcttggcactttcaagcccctatgccaaaaattttcagccaggaatgctgagattctagcctagaaggggataccctactcaagacagtatcactaaagtataccaaatgtcaagcatgctgaaacctggt

SEQ ID NO: 23581 - DNA, 601 bp, Human
aaaaaaaaaaaaaaaaaaaaaaaaaaaaaaaatatatatatatatatatatatatatatgagaacattattatacattcttctccactcctcttagacatggctctgcatctcactttttcttttgagacagagtctcactctcacccaggctggagggcaacggtgcgatctcggctcactgcaacctctgcctcccaagttcaagcgattatcttgccttagcctccaagtagctgggattaaaggcgccgccgccacgcccagctaattttttgtatttccagtagagacagggtttygccatgctggccaggctggtctcgaactcctgacctcaagtgacccacccgcctcagcctcccaaagtgctgggattacaggcatgagccactgcacctggccctgcatcttgcgttttaaatttcacattattatattggagttggagatctaacagaacatgaaactcttattctactggctgcaccacattccattaaatggatataccataactgatttaaccagtttcctactgatagctattctcaatgttttgttattacaaataaggctacaagtaagtttggatatacatt

SEQ ID NO: 23582 - DNA, 601 bp, Human
ctcaggcatcaggagacagatagggccgttactgctgagcgccagcggcagctggaacaggcatcccaagggggttggcagcagcaatcactggtgagcctgccagaggtccaaggggtgaaggggttggcactgaagaaatccctgaaagaaaagagctgtcagtgagccaaagacaccaaccatggcaatcttaccagtttctcatagcactcactgcaaaaggaacacaataattctttactgaagacttcctcttagctggatttttacatatacttcaagtctgaccctcacaaaytcaagttaaagtggcaagtcctaatcaatttaagagacaggtaaagaaatctaggcttggacaatttaaggagtttgtccaaagtacacgattaagcaagtggcaaccatggttggattctaacccaggcctgtctagggcagagatgtccaccctggtgaccagtagccaaccacatgtggctgctgagcacttgaaatatggctagtgcaactgaggaactacattttaaattttattcaattgtaattaaatagcctcacgtggctagtcactaccatactgaacagcacatgactg

SEQ ID NO: 23583 - DNA, 601 bp, Human
cttttgtaaaaagcagtaagttatgcccagtaactaaatgaattcaaaatggccaagacaaagaaaactaagaaagattttgccttccctctcctaccagctatggagcacagcatgttgggagatgaacagggaaaagaccaaggtaaggagcctgggagggaaggtatcaacattttaaactgaactaaaaataaaagtataaatgagttggatttagggttagatcagtaagacatgattcttactgaacagaagtttttagtatctgtctgcattttgggtagattttcaacatctygatgtaactaagacacacttccacaagagccactaggataaccccactgaagcgcttatggagtaaagtgatgtaagcgaccagcaagcagtccactgctcctatagattgggtcctcccttccttctttccttccttcctttcttcctgcctcccctgagaagctacatttttgtaatctctggagaagagcacgagataccaaccccctaaagtgtgggacggtggaggaacaatggtgggaatgggaagaagtctccacctaaatgcagcagccgggattgaggctggtttatcttt

SEQ ID NO: 23584 - DNA, 601 bp, Human
caagagagtttatagttttcccacaattacaggtctaccatttcagcttcaatggagatagtggctctgctcctacctctcaagatacatttacaagactgaggagcaggtcttctcactggatggcatgtgagggaaggggacggtcggaggaaaagaaggtagaaagcttaaaatggaagtcagtgtggccacatctcccattagctctagcatgaaacctgtacagacaatgtttgtttcttttgtaaaaagcagtaagttatgcccagtaactaaatgaattcaaaatggccaagasaaagaaaactaagaaagattttgccttccctctcctaccagctatggagcacagcatgttgggagatgaacagggaaaagaccaaggtaaggagcctgggagggaaggtatcaacattttaaactgaactaaaaataaaagtataaatgagttggatttagggttagatcagtaagacatgattcttactgaacagaagtttttagtatctgtctgcattttgggtagattttcaacatctcgatgtaactaagacacacttccacaagagccactaggataaccccactgaagcgctta

SEQ ID NO: 23585 - DNA, 601 bp, Human
gcccgccgggcagcgcggcgccggctcgtccgggcaccggcacggcccgctgcagttctggccgacggccggctgcagggaggacagggcggtcagcggcgctcggtcggcgcgcacgccctccccggccggccccgagtccctccctggcagccgccggccgcagcgggggctcccggcgcttacccggctgcagagggcgaggaggaccacgaaggcgacgcggacggggcccatactggcggcggtcatggttggcactgcgggcggagcggagggcgcggtggcggcgagcggggarcggcggggcctggagcgctggcggtggtcggaggtggggaccgggacgcgccgggctgtcgtctcggggctgtcggccggggcggctgccgtcgagctggagggtggagtcgcactggctgtctcctctcagcggggaagagttgttgtgtgagtttggggcgggcggcccgaggcttttatacgctccgggcggccgcggctcgccaatgagctgaatggagtcctacacaaacagggacattcctcgcattcctccccaccttcctgcctcatcaactcacaccggattgatcctgac

SEQ ID NO: 23586 - DNA, 601 bp, Human
cgggcgtcacaggggctagctggttttgaacacttccgaagctcacttactcccccacacacctccacgtgcacacaaccatatattcatacacaagcacacacactcatgcacacacgtggggtatgggacaaaggagggaggcgtggtccagagccgacatgactcagggtcagggccatttttcaacagtccaggacaatgttctgtgggccacagtgagggctggcttcccattcctggagtcagtgtgcacagaccgacctgggaggggacatacataggacgcagccccacagcytacctgccacgtggtattccgtttgttgacatagttgaccagctcatccgacaggggatggaaagagggcctgctccgggcattggccaacaccagcaggcagcagagggaggcccagagctgccacatgttggaagccggatcctagatccacctggagaggacagagggcatcaggacacctctctgttatgtgggtcgagggctcacacacacaggggcaccgtctcgggcatcagtggggacccccatgctcgtcctggcccaggcggagaactctaaggagctgaggtgtctatg

SEQ ID NO: 23587 - DNA, 601 bp, Human
tgacaatcagagaccctctccagccctcaacatggctcactcctcattcttggttctcagtccgagggtcagggctgggcagagacaaagggaatcaggggcgggactgataaactgccactgtgccacggcgggcgtcacaggggctagctggttttgaacacttccgaagctcacttactcccccacacacctccacgtgcacacaaccatatattcatacacaagcacacacactcatgcacacacgtggggtatgggacaaaggagggaggcgtggtccagagccgacatgactcarggtcagggccatttttcaacagtccaggacaatgttctgtgggccacagtgagggctggcttcccattcctggagtcagtgtgcacagaccgacctgggaggggacatacataggacgcagccccacagcctacctgccacgtggtattccgtttgttgacatagttgaccagctcatccgacaggggatggaaagagggcctgctccgggcattggccaacaccagcaggcagcagagggaggcccagagctgccacatgttggaagccggatcctagatccacctggagaggacagag

SEQ ID NO: 23588 - DNA, 601 bp, Human
tggggggcactggggaacagcccagagtgacacacgggcaaagtgggtgtctcccctgatctgctcccatttgctgacaatcagagaccctctccagccctcaacatggctcactcctcattcttggttctcagtccgagggtcagggctgggcagagacaaagggaatcaggggcgggactgataaactgccactgtgccacggcgggcgtcacaggggctagctggttttgaacacttccgaagctcacttactcccccacacacctccacgtgcacacaaccatatattcatacacawgcacacacactcatgcacacacgtggggtatgggacaaaggagggaggcgtggtccagagccgacatgactcagggtcagggccatttttcaacagtccaggacaatgttctgtgggccacagtgagggctggcttcccattcctggagtcagtgtgcacagaccgacctgggaggggacatacataggacgcagccccacagcctacctgccacgtggtattccgtttgttgacatagttgaccagctcatccgacaggggatggaaagagggcctgctccgggcattggccaacacca

SEQ ID NO: 23589 - DNA, 601 bp, Human
cgcttctttctaggcttatgtaatggattttttaagatgaatttatccacaaattataaactcatttttaaataagtttattcagtccagatagtgtttcttgccctgctctcctgcctcaacctctgcccaggatcctctcatcatttctcatatcatccccattgtgcagaaggcagtgtcgtgcaacttaactaccccatcctcacgtgggaagtggcatcatctcagctcaccgcaacctctgcctcccgggttcatgcgattctctagcctcagcctcccgagtagctgggattasaggcgcccgccaccacgcctggcaaagttttttatttttagtagagacggggtttcatcatgttggtcagactggtctcgaactcctgacctcaggtgatccgcttgccttggcatcccaaagtgctgggattacaggcgtgagccaccatacttggcctcatctggcttttcttagatttcccttaaattactcaagattgagtctgcccacatagtggggacccagaccttgtctgtcacatctgcggctgagacaccttggagaagcacaatagaaaacactgggggtggctcatgc

SEQ ID NO: 23590 - DNA, 601 bp, Human
aactccctccccaatccctgcaaaggccactttggctgggccacactcccctaacaaggaaatgagcacaagacatgccgaagaaggctgcagacaggtgtccttggtaatttcataaaacaaaaggaaattctgttgctcaatgcaccttttgattttttttttgggtgggacgggagggtgggagtggacagaatttcactgtgtcatccaggctggagtgcagtggcgagatctctgcccactgcaacctctgcctcctgagttcaagcgattctcgtgcctcagcctcctgagtagstgggattacaggcatgcaccaccacacccggctaatttttgtatttttagtaaagacagggtttcaccatgttggccaggctggtcttaaactcctggcttcaaatgatctgcctgccttggcctcccaaagtgctgggattacaggcatgatccaccacacctggcctgacttgcgatattgtacgcttctttctaggcttatgtaatggattttttaagatgaatttatccacaaattataaactcatttttaaataagtttattcagtccagatagtgtttcttgccctgctctcct

SEQ ID NO: 23591 - DNA, 601 bp, Human
gaaggtcttcattacaagctctgatcccacaactccctccccaatccctgcaaaggccactttggctgggccacactcccctaacaaggaaatgagcacaagacatgccgaagaaggctgcagacaggtgtccttggtaatttcataaaacaaaaggaaattctgttgctcaatgcaccttttgattttttttttgggtgggacgggagggtgggagtggacagaatttcactgtgtcatccaggctggagtgcagtggcgagatctctgcccactgcaacctctgcctcctgagttcaakcgattctcgtgcctcagcctcctgagtaggtgggattacaggcatgcaccaccacacccggctaatttttgtatttttagtaaagacagggtttcaccatgttggccaggctggtcttaaactcctggcttcaaatgatctgcctgccttggcctcccaaagtgctgggattacaggcatgatccaccacacctggcctgacttgcgatattgtacgcttctttctaggcttatgtaatggattttttaagatgaatttatccacaaattataaactcatttttaaataagtttattcag

SEQ ID NO: 23592 - DNA, 601 bp, Human
atggtgggacactgtggccattgttcccgtgcatcgaagcttgcaggcagcttcaggtcctcggtaaacataactctggataaaggaaggtcttcattacaagctctgatcccacaactccctccccaatccctgcaaaggccactttggctgggccacactcccctaacaaggaaatgagcacaagacatgccgaagaaggctgcagacaggtgtccttggtaatttcataaaacaaaaggaaattctgttgctcaatgcaccttttgattttttttttgggtgggacgggagggtgggwgtggacagaatttcactgtgtcatccaggctggagtgcagtggcgagatctctgcccactgcaacctctgcctcctgagttcaagcgattctcgtgcctcagcctcctgagtaggtgggattacaggcatgcaccaccacacccggctaatttttgtatttttagtaaagacagggtttcaccatgttggccaggctggtcttaaactcctggcttcaaatgatctgcctgccttggcctcccaaagtgctgggattacaggcatgatccaccacacctggcctgacttgcgatattgta

SEQ ID NO: 23593 - DNA, 601 bp, Human
ccaagactctccagtgttgctcccactttctctccagcgcttccccgccagccagcagggccttacccagcaggagccacaggagccctggtctctgatctctttgatggtgggacactgtggccattgttcccgtgcatcgaagcttgcaggcagcttcaggtcctcggtaaacataactctggataaaggaaggtcttcattacaagctctgatcccacaactccctccccaatccctgcaaaggccactttggctgggccacactcccctaacaaggaaatgagcacaagacatgccraagaaggctgcagacaggtgtccttggtaatttcataaaacaaaaggaaattctgttgctcaatgcaccttttgattttttttttgggtgggacgggagggtgggagtggacagaatttcactgtgtcatccaggctggagtgcagtggcgagatctctgcccactgcaacctctgcctcctgagttcaagcgattctcgtgcctcagcctcctgagtaggtgggattacaggcatgcaccaccacacccggctaatttttgtatttttagtaaagacagggtttcaccatgttggccag

SEQ ID NO: 23594 - DNA, 601 bp, Human
agggatgctttcttgaagcagagtagcagtgagagctcctggtatttgcggacgggccagcatgtcagggaaagggagctgcttcgccacctgtacacgtggacttgcaatctgctggatgctctgcccgccactccacctaatcctcgccatcattcatggccagagggattgtgatttttgtactgatggaaactgggactcagaaagtttctataacttgccttgtcagagttgtccccaccccgaatcccccaagactctccagtgttgctcccactttctctccagcgcttccccrccagccagcagggccttacccagcaggagccacaggagccctggtctctgatctctttgatggtgggacactgtggccattgttcccgtgcatcgaagcttgcaggcagcttcaggtcctcggtaaacataactctggataaaggaaggtcttcattacaagctctgatcccacaactccctccccaatccctgcaaaggccactttggctgggccacactcccctaacaaggaaatgagcacaagacatgccgaagaaggctgcagacaggtgtccttggtaatttcataaaacaaaag

SEQ ID NO: 23595 - DNA, 601 bp, Human
gctgggcacggtggctcacgcctgtaatcccagcattttgcgaggccgaggaaggcagatcaacaggtgaggcgtttgagaccaggctgtccaacatggcaaaaccccatctctactaaaaatacaaaaattagctgggcgtggtggcacacgcctgtagtcttagctactggggagactgaggcaggagaattgcttgaacccaggaggcagaggttgcagtgagccaatatcccaccactgcactccagcctgggtgacagagcaagactccatctccaaaaaaaaaaaaaaaaaaaaagaaaaagaaaacaaaagaagattgctaagattattacatttctgttacgtgtattttaccacaattaaatgacaaaattaagacagctcactgacactaaagggatgctttcttgaagcagagtagcagtgagagctcctggtatttgcggacgggccagcatgtcagggaaagggagctgcttcgccacctgtacacgtggacttgcaatctgctggatgctctgcccgccactccacctaatcctcgccatcattcatggccagagggattgtgatttttgtactgatggaaactggg

SEQ ID NO: 23596 - DNA, 601 bp, Human
aactcccgggttcaagtgatttgcccacctcggcctcccaaagtgctgggattagaggcgtcatgagccacttgccccactctcctgcctcaacatctgcccaactcagcttttaaagcaagagaagcaccaccgtgaacctctgcctgggaactcggttcatttctgaaatctgcaaaatgtgtagtattagtttgtatgtgtgtgtgtggtttttttttttttttttcctggaggcggagtttcacttttgttgcccaggctggaatgcagtggcgcaatctcagctcactgcaacctrcgcctcctgggttcaagcaattctcctgcctcagcctctatagtagctgggattataggtgcctgccaccaggcccagctaagttttgtctttttagtagagacagggtttcaccatgttggccaggttggtctcaaactcctgacctcaggtgatccgcctgcctcagcctcccaaagtgttgagattacaggcgtgagctaccgtacctggctgtgtttttttcttaacaaaaaacacagctcacccagaaaataaatactgttgtgatccacttgtatgaggtccctaggagtcaaa

SEQ ID NO: 23597 - DNA, 601 bp, Human
cgtccccacacatgctgccacagcaggtgagcaggtcctccgccgacacctccacgctgacgtgcgcattggtgtggatgcagatccggtcagagatggcttccacagccccgaaggcctgcaggaacgagccccaccgggtgaggctgccatgtccgggctgggccctctgcagcagtcccctcaaagggccacaggggcacctcagaccttgtaggcaactgatctctcaacaccaggggacgctcctggggctcaaactcagcttttattttctttggtagaaatggggtcttgctaygttggccagactggtcttgaactcccgggttcaagtgatttgcccacctcggcctcccaaagtgctgggattagaggcgtcatgagccacttgccccactctcctgcctcaacatctgcccaactcagcttttaaagcaagagaagcaccaccgtgaacctctgcctgggaactcggttcatttctgaaatctgcaaaatgtgtagtattagtttgtatgtgtgtgtgtggtttttttttttttttttcctggaggcggagtttcacttttgttgcccaggctggaatgcagtggcgcaa

SEQ ID NO: 23598 - DNA, 601 bp, Human
tggaagcacagcctgactcacccgtccccacacatgctgccacagcaggtgagcaggtcctccgccgacacctccacgctgacgtgcgcattggtgtggatgcagatccggtcagagatggcttccacagccccgaaggcctgcaggaacgagccccaccgggtgaggctgccatgtccgggctgggccctctgcagcagtcccctcaaagggccacaggggcacctcagaccttgtaggcaactgatctctcaacaccaggggacgctcctggggctcaaactcagcttttattttcttyggtagaaatggggtcttgctatgttggccagactggtcttgaactcccgggttcaagtgatttgcccacctcggcctcccaaagtgctgggattagaggcgtcatgagccacttgccccactctcctgcctcaacatctgcccaactcagcttttaaagcaagagaagcaccaccgtgaacctctgcctgggaactcggttcatttctgaaatctgcaaaatgtgtagtattagtttgtatgtgtgtgtgtggtttttttttttttttttcctggaggcggagtttcacttttgttgccc

SEQ ID NO: 23599 - DNA, 601 bp, Human
cagaccaggggccagacattccaccacattttctgaaactgactgttttgctgggatgccacccctcagacagctctgccgggccagccttggttcaggcacctcccaggaagcagcagccttgccaggccctgcctgccagactctcggagtctccccgaaacacttctgactcgcagcagtcccaggaagtcctcaaagtcccctccactgagaagctggggcccagggtctctcagcactaaacccgctgtggaagcacagcctgactcacccgtccccacacatgctgccacagcakgtgagcaggtcctccgccgacacctccacgctgacgtgcgcattggtgtggatgcagatccggtcagagatggcttccacagccccgaaggcctgcaggaacgagccccaccgggtgaggctgccatgtccgggctgggccctctgcagcagtcccctcaaagggccacaggggcacctcagaccttgtaggcaactgatctctcaacaccaggggacgctcctggggctcaaactcagcttttattttctttggtagaaatggggtcttgctatgttggccagactggtcttgaactcc

SEQ ID NO: 23600 - DNA, 601 bp, Human
gctacgagtgcccttccgggtagaacactgattctcaactgagcagacgctaaacttccctaaggtacttaaaaacaccaccagttctctgaaatgagaatcgccagtgattcccatttaactagttaggggagaagcccatgcatttttttaagccctcaggcatttcggatctgcagccgccagtgaacaccgctactgcggaaccaaggcgaggctgcaggcagctggagcagaaagttctgtgccaccaccttgttgttaaggtggagccatccccgctaactacacataaggaaaygccccaaactggttccccaagcaggaaaaaggaacatgcgatgacacaaaccagaccaggggccagacattccaccacattttctgaaactgactgttttgctgggatgccacccctcagacagctctgccgggccagccttggttcaggcacctcccaggaagcagcagccttgccaggccctgcctgccagactctcggagtctccccgaaacacttctgactcgcagcagtcccaggaagtcctcaaagtcccctccactgagaagctggggcccagggtctctcagcactaaaccc

SEQ ID NO: 23601 - DNA, 601 bp, Human
acttacctacatgggattcatagaggccaccagaaaccaggccttttcttgtccagaagttccaagcttcagcaggatagccaccattacagctgaaaagacagcctctaatgaaaacctctgagagaagcaccaccagctctccagaccactgtgtgctacccaagtgcccgaggccactcgtggacccacccccagctgcagcaagtggtgcgagcagacctcccagaccccaaaccctccaagggacgctccctagataagcacagcttgcagggaataaccgccagccccacccctrcccacaaagatccgggagaagacaggaggctctcctgttcatgtccataccagaccaggctacgagtgcccttccgggtagaacactgattctcaactgagcagacgctaaacttccctaaggtacttaaaaacaccaccagttctctgaaatgagaatcgccagtgattcccatttaactagttaggggagaagcccatgcatttttttaagccctcaggcatttcggatctgcagccgccagtgaacaccgctactgcggaaccaaggcgaggctgcaggcagctggagcagaaagtt

SEQ ID NO: 23602 - DNA, 601 bp, Human
gccaggccccaggccccttaccgtagtgcttgtcctgtttgtaggtcgggctgtagccaggctcacagatcttgctacacttgggggtatctccctcccccgtgcatgggggccgggagccgttgacgtggtgctcacagggagggatggagtacggtctgcaccctgatgggacccgggagaaagcggagtcaacctacagcccccacggagaagccccagctgggcgaggcagacctggggcaaggcaagcctcgtgcctgcagcatggacgccaggcaggtcctgccagaggcctgtrcacctggctagcacctctcagcagcccctctgtctcaacccccagtttataaaggcaaataaagccatgatggttaattgctcaaacaatccatctggccagaaagtggccaaggggacacacttacctacatgggattcatagaggccaccagaaaccaggccttttcttgtccagaagttccaagcttcagcaggatagccaccattacagctgaaaagacagcctctaatgaaaacctctgagagaagcaccaccagctctccagaccactgtgtgctacccaagtgcccgaggcca

SEQ ID NO: 23603 - DNA, 601 bp, Human
gccgtggccaggccccaggccccttaccgtagtgcttgtcctgtttgtaggtcgggctgtagccaggctcacagatcttgctacacttgggggtatctccctcccccgtgcatgggggccgggagccgttgacgtggtgctcacagggagggatggagtacggtctgcaccctgatgggacccgggagaaagcggagtcaacctacagcccccacggagaagccccagctgggcgaggcagacctggggcaaggcaagcctcgtgcctgcagcatggacgccaggcaggtcctgccagagkcctgtacacctggctagcacctctcagcagcccctctgtctcaacccccagtttataaaggcaaataaagccatgatggttaattgctcaaacaatccatctggccagaaagtggccaaggggacacacttacctacatgggattcatagaggccaccagaaaccaggccttttcttgtccagaagttccaagcttcagcaggatagccaccattacagctgaaaagacagcctctaatgaaaacctctgagagaagcaccaccagctctccagaccactgtgtgctacccaagtgcccg

SEQ ID NO: 23604 - DNA, 601 bp, Human
aaggacagggctggggctggaagctcagaaatgggagaagggagcaatgagcacgaggccccggaagaggccaggatacctcaagactccaggacacgccactcccttgtaaaaggagggctttggtcccttccagtttggaagggctgaggctgagttcagggtggaacaggcagaaagtggagagtgtgctgcttctcctggcaagagggcatcactccccctcctctatcctagagttccgggaccccaaggctcctcagccctgacctcttcgctgcagcgtgaggagggatgcagyagctccccagcctccacgtgcgccgtggccaggccccaggccccttaccgtagtgcttgtcctgtttgtaggtcgggctgtagccaggctcacagatcttgctacacttgggggtatctccctcccccgtgcatgggggccgggagccgttgacgtggtgctcacagggagggatggagtacggtctgcaccctgatgggacccgggagaaagcggagtcaacctacagcccccacggagaagccccagctgggcgaggcagacctggggcaaggcaagcctcgtgcctgcagcatggac

SEQ ID NO: 23605 - DNA, 601 bp, Human
aagctccctccacggggccgtttttgtagatctcggccatgatgtccttctcgctattggagacgctgtaggaattgtatcctggaaaatgaaccgagctcggggttggggagggcagtgaccgtgcctcgtggcacgccacggtcagccagtcactgatttctggtggcctccaggggaagactgcatctaaggggacttgccctgccaggggagctcaaggaaggctcccctgaagaactaaggacagggctggggctggaagctcagaaatgggagaagggagcaatgagcacgaggycccggaagaggccaggatacctcaagactccaggacacgccactcccttgtaaaaggagggctttggtcccttccagtttggaagggctgaggctgagttcagggtggaacaggcagaaagtggagagtgtgctgcttctcctggcaagagggcatcactccccctcctctatcctagagttccgggaccccaaggctcctcagccctgacctcttcgctgcagcgtgaggagggatgcagcagctccccagcctccacgtgcgccgtggccaggccccaggccccttaccgtagtgctt

SEQ ID NO: 23606 - DNA, 601 bp, Human
tatggaaggccccacacagccctcttccccagcccctcccctgcctgcccaatccagccctattggtcaacatgaaccatcctggcacccaggctcccctcccgacccccaccctctattgccatcagccatcagcacgcacctgacttgtagagcaggaagtccgaatacacagagaaagctccctccacggggccgtttttgtagatctcggccatgatgtccttctcgctattggagacgctgtaggaattgtatcctggaaaatgaaccgagctcggggttggggagggcagtgacmgtgcctcgtggcacgccacggtcagccagtcactgatttctggtggcctccaggggaagactgcatctaaggggacttgccctgccaggggagctcaaggaaggctcccctgaagaactaaggacagggctggggctggaagctcagaaatgggagaagggagcaatgagcacgaggccccggaagaggccaggatacctcaagactccaggacacgccactcccttgtaaaaggagggctttggtcccttccagtttggaagggctgaggctgagttcagggtggaacaggcagaaagt

SEQ ID NO: 23607 - DNA, 601 bp, Human
caagggatttctaagacaggacttggggatggggactgtccagattccttggttggagtccctatggcactacccagggcaaggtcctccctgtgtgttcatccactggtgtgaggcacgatctaggcctttgcaaagagaaagatgaagaaaatgtgtcagccagtgcaaacacgaacggcctgccattataacagaaacatgctggtaaagcaatgcaaagccaggaaggcgagggcaggcgtggccagccaccagggaggggggcgttcccacagagaacatgtatgagctggactcyaatggatgggaaggaactagcccagaggctctgggagaggcctctggaattctgtgtgttggcacaacacctggacaaagacagtcaggtgccaggctggtccacagaggagtgagcctatatggaaggccccacacagccctcttccccagcccctcccctgcctgcccaatccagccctattggtcaacatgaaccatcctggcacccaggctcccctcccgacccccaccctctattgccatcagccatcagcacgcacctgacttgtagagcaggaagtccgaatacacagagaaa

SEQ ID NO: 23608 - DNA, 601 bp, Human
agcaagggatttctaagacaggacttggggatggggactgtccagattccttggttggagtccctatggcactacccagggcaaggtcctccctgtgtgttcatccactggtgtgaggcacgatctaggcctttgcaaagagaaagatgaagaaaatgtgtcagccagtgcaaacacgaacggcctgccattataacagaaacatgctggtaaagcaatgcaaagccaggaaggcgagggcaggcgtggccagccaccagggaggggggcgttcccacagagaacatgtatgagctggackccaatggatgggaaggaactagcccagaggctctgggagaggcctctggaattctgtgtgttggcacaacacctggacaaagacagtcaggtgccaggctggtccacagaggagtgagcctatatggaaggccccacacagccctcttccccagcccctcccctgcctgcccaatccagccctattggtcaacatgaaccatcctggcacccaggctcccctcccgacccccaccctctattgccatcagccatcagcacgcacctgacttgtagagcaggaagtccgaatacacagaga

SEQ ID NO: 23609 - DNA, 601 bp, Human
acagcaccccccacactcagctggtcatgctccgggaaggagaaacagcttccagagggaacctgctgctccaccaggaggctccagggggggtcccacaatactggggaattaaatatatttttgaaggcccaacacactcaaagttgttgagtaaatattgaaatagattcctacaaaatgtgcttgttggctttaaaaatagaatttctaatacattctaattgataaaacatttaatgctagatgactgattcatctgttctttatactgggattccatgtaagtaagggtttgtcraaagcgttacacggcttaaagagttttaatagctgctccaggtacaccctgaagaggtgagggaggagaagggaggactggtggcagctaatgctagctgatgggaaagatactggctaaggggctcagggctgcccaaccaggctctcgggtggggaaatcactgtcaaagtggaaatgcatcttttaataataagggcgaggactatgctaagaagtgccatcttcacagaaactttttcttgccagaatcatcttcctttgtcaaactgttgttttacaagtttccaatctagcaaa

SEQ ID NO: 23610 - DNA, 601 bp, Human
aggtgcttttaaagtgtgacaagggtcaaccaatatagtcagactcatccttaaaagaccttaagtcactcatccctggccactcctgctgtgggcccactagcacagtcctcaacaccacaaggcttctggagccgtggggcacacctccacgggcaagccccctgcccggtcacccttcccatcacaggatctggcgcgatgctgtgggaactgttgcaggcgttggctctgaagctgctcagagtctgccctcacagcaaaagggaactcctgactgcctggcacttaggaggagctsacagcctggccgtaggtccagggtttaaggctgtgcggtgggtagaacagagaaagccgagatggccacggggtgtggctcacaattcactgttcttggcaggaagggggcagccactcaccattgtcaccccagtcagtgttccaggagttggcaaccagccagtagggtgtgccattctccactccccagcccaggatgcggatggcatggccacccatcatctctccggtgacgtgttggtacactcctgaaaagggaagaactggctgagaccgagaccgggccactgtcccacgc

SEQ ID NO: 23611 - DNA, 601 bp, Human
tgtctgaaacttgtatcttacgtgaacttaaagaataaaatgcatttctaccccgatctcgcccccaggactggcacgacaggcccacggcagattagatcttttcccagtactgatcggtgcgtggaattccagccaccacttctgattcgattccacagtgatcctgtcctctgagtattttaaagaagcctgggaataaaaagtaaggtgcttttaaagtgtgacaagggtcaaccaatatagtcagactcatccttaaaagaccttaagtcactcatccctggccactcctgctgtkggcccactagcacagtcctcaacaccacaaggcttctggagccgtggggcacacctccacgggcaagccccctgcccggtcacccttcccatcacaggatctggcgcgatgctgtgggaactgttgcaggcgttggctctgaagctgctcagagtctgccctcacagcaaaagggaactcctgactgcctggcacttaggaggagctgacagcctggccgtaggtccagggtttaaggctgtgcggtgggtagaacagagaaagccgagatggccacggggtgtggctcacaattcactg

SEQ ID NO: 23612 - DNA, 601 bp, Human
actccgctttccattcctgcgtctctgtcttgctccctggagatggatggatcacggagggggccacagtcagctggggcagcaggtactccctacggcactagtctacagggggaaggacgctctgtgctggcagcggtggctcacatggcctgtctgcactgtaaccacaggctgggatgtagccaggacttggtctccttggaagacaggtctgatgtttggccaatccagtccttcagaccctgtctgaaacttgtatcttacgtgaacttaaagaataaaatgcatttctaccccsatctcgcccccaggactggcacgacaggcccacggcagattagatcttttcccagtactgatcggtgcgtggaattccagccaccacttctgattcgattccacagtgatcctgtcctctgagtattttaaagaagcctgggaataaaaagtaaggtgcttttaaagtgtgacaagggtcaaccaatatagtcagactcatccttaaaagaccttaagtcactcatccctggccactcctgctgtgggcccactagcacagtcctcaacaccacaaggcttctggagccgtggggcacac

SEQ ID NO: 23613 - DNA, 601 bp, Human
gtgcacgaaaaaataaaacttctattaaagaatcatgctgagcacaagatcagagaggttgtgacattgcaaactcgatagatgcagggggcctgggagactggcgttctccaaagggctcccaacaccatctctcctctgatttctgtgacaaatgtggaaagctacttgcttggaggtactgggggaactgatgggggaactttcatcctgttaggaactccgctttccattcctgcgtctctgtcttgctccctggagatggatggatcacggagggggccacagtcagctggggcarcaggtactccctacggcactagtctacagggggaaggacgctctgtgctggcagcggtggctcacatggcctgtctgcactgtaaccacaggctgggatgtagccaggacttggtctccttggaagacaggtctgatgtttggccaatccagtccttcagaccctgtctgaaacttgtatcttacgtgaacttaaagaataaaatgcatttctaccccgatctcgcccccaggactggcacgacaggcccacggcagattagatcttttcccagtactgatcggtgcgtggaattccagc

SEQ ID NO: 23614 - DNA, 601 bp, Human
caatctgtaaaactagcacaggtctcccgctgttccactggctcacccacatgattagcagagtgcacgaaaaaataaaacttctattaaagaatcatgctgagcacaagatcagagaggttgtgacattgcaaactcgatagatgcagggggcctgggagactggcgttctccaaagggctcccaacaccatctctcctctgatttctgtgacaaatgtggaaagctacttgcttggaggtactgggggaactgatgggggaactttcatcctgttaggaactccgctttccattcctgsgtctctgtcttgctccctggagatggatggatcacggagggggccacagtcagctggggcagcaggtactccctacggcactagtctacagggggaaggacgctctgtgctggcagcggtggctcacatggcctgtctgcactgtaaccacaggctgggatgtagccaggacttggtctccttggaagacaggtctgatgtttggccaatccagtccttcagaccctgtctgaaacttgtatcttacgtgaacttaaagaataaaatgcatttctaccccgatctcgcccccaggactgg

SEQ ID NO: 23615 - DNA, 601 bp, Human
aagtcccaagagtcgcaagaacatgcagttccaggacgtgattctctgcagggacaaagagagacagcagctacaagtctataggcagtgacaaaggatctgagatcccatcagagtagacttcaagttggagaaaccttttattggcacaggcattccttgttaacttgacagggtgaagctgtaatttttcaaaaacagtaaaagctggtttctcctaaactattttccttgtggtagtagagatcagtgggtcagaaacaactcctgaccacttggtttccttttgagccgcgtcatwaggaggcaatctgtaaaactagcacaggtctcccgctgttccactggctcacccacatgattagcagagtgcacgaaaaaataaaacttctattaaagaatcatgctgagcacaagatcagagaggttgtgacattgcaaactcgatagatgcagggggcctgggagactggcgttctccaaagggctcccaacaccatctctcctctgatttctgtgacaaatgtggaaagctacttgcttggaggtactgggggaactgatgggggaactttcatcctgttaggaactccgctttcca

SEQ ID NO: 23616 - DNA, 601 bp, Human
ggatgacagggaactaattgggggagggatgccatggttgaaaacatggctggggcagcgagaagttaagatgaagtcccaagagtcgcaagaacatgcagttccaggacgtgattctctgcagggacaaagagagacagcagctacaagtctataggcagtgacaaaggatctgagatcccatcagagtagacttcaagttggagaaaccttttattggcacaggcattccttgttaacttgacagggtgaagctgtaatttttcaaaaacagtaaaagctggtttctcctaaactattytccttgtggtagtagagatcagtgggtcagaaacaactcctgaccacttggtttccttttgagccgcgtcataaggaggcaatctgtaaaactagcacaggtctcccgctgttccactggctcacccacatgattagcagagtgcacgaaaaaataaaacttctattaaagaatcatgctgagcacaagatcagagaggttgtgacattgcaaactcgatagatgcagggggcctgggagactggcgttctccaaagggctcccaacaccatctctcctctgatttctgtgacaaatgtg

SEQ ID NO: 23617 - DNA, 601 bp, Human
ataataatttctggttcctaaaactagttaagcccattaaatgaagtatgtcatccagatcaacatttgcattatgttatctatgcctctggtgtcactttcaaagtcaaaatttaaccctcaagagataagtgaagctataaatgcaaaacaaaattaaaatcctacagcactagatgattaaaaacttcaattataatatatgtaattttaaaataaagaataaaggcggcatttatccacaaacaagggttactataggaggcatttggctcttttctggttagaaacagcaacaggaaaaaaaaaagccacaggtatttacatcactgggagcccacttaatcagtggtcactgtgttaccctgttttaaaattagaaaattaacccacatcctcattttatagtgaatgtatcttaaaatttcacttgcagtgaagatactgactgggacactttacatttaagaaattatacagcgtttttagtatcttaggcatttaataacataaatattttcaatgtttattttcacttctctggtgataatttctgttcatttctggggttgaagaaatatacattaggtattttcagcta

SEQ ID NO: 23618 - DNA, 601 bp, Human
cactaaataaatctgagtgacaaaatcgtaataaatctgaataacaaaagtacttgattatatagcagcaaagtcatttgggagatgaaatattttttaaattgcattgaaaccattctgatatctccaaaacatagtagatatttagtcccatcatagcagatatttagtcccatcatctctaccttgaattgtacacttagacgaatccatattaaagctgtacgttcgtaagtagaatcttacagctgttttgagtcattatccaattgtagcatattaaaaaaaagaagaaagaaaaaaggaaggaagaaagaaagaaagaaggaagaaagaaaaggaaagaaagaaagagaaaaagaaagaaaggaagaaagtgaaagaaagagagagagagagagaaagaaagaagagaagagaaaagaaagatctttgtatgatctaaccttaaggtatcttctgggaatttttgcctagattctctagagaagaaacaaatgtttttcagtttcttacatgtttgttcttagtttatatttactactgatatgtgtctaaggcagcacatgttgaatacaggcttgtggcttttcatttaaca

SEQ ID NO: 23619 - DNA, 601 bp, Human
tcacccaaatcagaacactggaccactcgaagatggcattgacagcggaaggggcacactgggcctagggagggctcgaagtcgcggtcatcaggaacttctgggcctatcccagaagcctcatcttctagcataaagtcaaataagcctctctgttgaaacggtccagcccaggaaacttgtgcaagcagaaggaggatgatagtggccttcatgatttatctcatgtattttcacaaccagggaacctaggaaacaaatgagagatttaagaagagtagcactgcctaatctgtgtgtygtttcttatataatatgccacaatacagtgagcacagagaaaagatgcaaaataatatttcatttgttatcaggaagcagagcattaaaaatgtattgaaagacaatcaggtacattatagtatcatttgcacagctatttacttaggatgagaaatctgagtattatttaaatctgcttgtttgaattttgggtctaaactaagatgatatactatatatccaaatcatttgcaaaattgtcatggtaataaatcatgttgggcttttcaatgctcacttaacacatggtcagataaaa

SEQ ID NO: 23620 - DNA, 601 bp, Human
cttatcctccattgcttcagctgtttctttcactctagccaactcgtatttttatttgtctgtttcttattttcttctgcctttgctttcttcttgtacagaaagtccttcaaacttctgctgatcgtctaaaactccttcctcgcatattctctcaaaactgtgtctggtaattggataaataatgatgcctaattttttcttttactttaagtccataacactcactactcatatcatattgtgcttatattgttggacacgtcaataaattgatcatggcactgttttatctaccaatttttttttttttttgagatggagtctcactctgtcaccagggctgcagtgcagtggcgtgatctcgactcactgcaacctccccatcctgggttcaagcgattctcctgcctcagactcccgagtagctgggactacaggagcgcgccaccatgcccagctaatttttttattttcagtagagacagggtttcaccatgttggccaggatggtcttgatctcttaaccttgtgatccacccgccttgacctcccaaagtcctgggattacaggcatgagccactgcacccggcctttctg

SEQ ID NO: 23621 - DNA, 601 bp, Human
ctcctcaggagaatagcaaaataggataaaaatttcccttattaaaacaaaagccaaacagacaatgacttatgaataataatgacttatgaaaaagactattagtgaaagcaataccaataaaattatttaagatgcatacacaggtttgcccagaaatcaactaaagcaagtttacaattcccatcttacgttatttattattttcctaaggtattttaaaattttgttaaagaatttcaatctagcattttataagccaataataaaattacaatttttactatatgtttagagaaatttttttttttttgagacgtagtctcactctgtcacccaggctggagtgcagtggggccatctcggctcactgcaagctccgcctcccgggttcacgccattctcctgcctcagcctcccgagtagctggtactacaggcccccaccaccacgcccggctaattttttgtatttttagtagagatggggtttcaccatgttagccaggatggtctcgatctcctgacctcgtgatccgcctgcttcggcctcccaaagtgctgggattacaggcatgagccaccgcgcccagccataacat

SEQ ID NO: 23622 - DNA, 601 bp, Human
ctgattgttcagaacatttttaatgcataatagagagttatattaattccctacttatctatatgctaaatatttctctaattatttatttaactttaaaacaactcaatgaagtggatagcagtattatttccacttgacagataaagagatagaggacaaatgaataactttttcaaagtctttgaaccactttatggtaatttgggctcaagcaaactgactccaaaatctacactcttcacaacacacaactaccactatcattcagatattaataactggagtgtcttaaaaaggaaaaaaaaattccctaagctattgcagactcaaggtaaaaattggatcaatttcagaggtactcccatatatctttttttttttttttacaaacaccaaggcatgctattttttaaataaatgtactttttctttgtgattttacaatattataaaatcactgtgcattaagttgtgtcttaaactagacattaacaggagtctacccatctctacagtgagcctggatggccccgtggtcatccagactgaatcactggatataacactagcagtaatagagaatttgctggaaatataa

SEQ ID NO: 23623 - DNA, 601 bp, Human
aaatttttatcacatcacactgaattctgtcaatattgtccatttaataaaatagtttagtccatatttgacttgaaaatgattcttagtttcctatggtagcatattttgtgttagagctgctaggaaaaggaacatctatttattgtatgtctgttacgcaccgaacattgaccttggcacttttcctacttcaaatcctttaagcctctcaaaacataaattattggtcactaatcccttttcacagttaaataaataagactcaaagttacaaagtaattacaaagtaatgcaaaawgtatattttttaatgcagtgcctccagtacaccaattgctatcacaaccatcggccttacttagtttcaaagtgtctccctttttgggatgtcagtttcccaaatgtaaagttatagctaagaagaagtttgactatgggagaaaaccttgcaataggtttgagatagacaaatttgtaaagtgcatcattagcttctgcaactgtggcattgagttaaagaacccatactccagttattttatttatttgtttgttcatttattttaaattttcttttttcttttccttttttaagata

SEQ ID NO: 23624 - DNA, 601 bp, Human
tctaaaatttttatcacatcacactgaattctgtcaatattgtccatttaataaaatagtttagtccatatttgacttgaaaatgattcttagtttcctatggtagcatattttgtgttagagctgctaggaaaaggaacatctatttattgtatgtctgttacgcaccgaacattgaccttggcacttttcctacttcaaatcctttaagcctctcaaaacataaattattggtcactaatcccttttcacagttaaataaataagactcaaagttacaaagtaattacaaagtaatgcaaaatgtatattttttaatgcagtgcctccagtacaccaattgctatcacaaccatcggccttacttagtttcaaagtgtctccctttttgggatgtcagtttcccaaatgtaaagttatagctaagaagaagtttgactatgggagaaaaccttgcaataggtttgagatagacaaatttgtaaagtgcatcattagcttctgcaactgtggcattgagttaaagaacccatactccagttattttatttatttgtttgttcatttattttaaattttcttttttcttttccttttttaa

SEQ ID NO: 23625 - DNA, 601 bp, Human
ggaatactatgcagccataaaaaggaatgggatcatgtcctttacaaggacatggatgaaactagaagccatcatcctcagcaaactaacacaggaacagaaaaccaaatactgcatgttctcacgcataaatggaagttgaatgctgagaacacacggacacagagagggtaacaaaacacacaacagggggtagggggtgagcgggcgaacttagaggatgggtcagtagggccagcaaaccaccatggcacacgtatacctatataacaaacctgcacattctgcaaacgtatctcattttttttttagaggaaataaagaaaaatgatgaggccatgtcaaaaagaatcaggagctagaccaaagaagctctttccagtcaattcttgaataatttgaaaattaaaattagtgacagtaaaaaaaaagaatttttattttacttgtggcttcaaactccccctactcactatggcaccaacatcaccacccctactgaaaaaaatatcagcattacagaagactttaagtttcatctccatacttctaaatcaaaaactttattgaaatctagctaatgtaaattgtgcttcatgat

SEQ ID NO: 23626 - DNA, 601 bp, Human
agccaatgcaaagggtgggttgtgggggagggggagacctaaaagaatccaaataaaataactaaagctgtctatttttaaataatatatcctgaatatagaatatccaaaggaactcacaaaaattactgcaactaaaaacaaatttggcatagtaccaggatagctcaatatataaacatcaattgtatgtttatacattagcagcaaacaaataaaaaaattaacaattcaaaacagcatcaaaaagaatgaaaaacaatgaatgtagtaaaagaattgcaaggcatgtatgctaaaratgacaaaaactgttgagaaaaagaaaagaagatataaataacccttgtttgtgacttggaaggctcaatattattaagatagtaattcttcccaatgatctgtagattcaaaacaatacctttcaaagccttacaagaatatttttccagaaatgaaaaagtagatcctaaaattgatatggaatgcaaaggaaccagaatagccaaaataactttgaaaaaaaagaacaaagttggagaacctacattttctaatttcaaaacgtaatcaaaagctacagtaattgaagggtataata

SEQ ID NO: 23627 - DNA, 601 bp, Human
ccaggttataaaaatgagggctttcttgagaattacttatagtttccgagttgaatggcagagcgcacgtagacacatctgaaggtggatggctgtatctcccagtactggaccgggttgctgaaaagactcacacccgaataagaagcctttttggtgttgtgtccaggtgggcagaagtcacttgatccaactacagagatattgttgttatgaaggtagacaacctacaacatgaaacgatagaaaataattattattctctaaatatgttgaggcccttcaggtaaacattttattytttttattattttttaatccttcactttttttttttttttttttttttgagatggaatcttgctttgtcacccaggctggagtgcagtggcatgacctcagtgcattgcagcctctgcctcacaggttgaagctattctcctgcctcagcctactgagtagccgggactacaggcacacacaccatgcccggctaatttttgtttttagtagagttgggttttcaccatgttggccaggctggtctagaacttctgacctcaagtgatccggccacctcagcctcctgaagtgcttggat

SEQ ID NO: 23628 - DNA, 601 bp, Human
atgtgtggaattgaattccattcattacggagttagtttctgctaaatacttactgatgctagagcagacccctggcatctgaggatttaagagttcaactgttctcaatctatgctaaaaaaaaaaaaatgacaaataataaattctacatttccgaggcactaatttgaacttcagaagtgggagggctgatatgtaaggcaagttatttaggaatgaggagggctgacagctgtaactcagtgtggttttgcagctgcctacgttagtaccaggtattccataaaactctgtagaggycatttacatttcgtaaattctgtaattacaccttactgtatcatgccctagtagtttcacaaacttagatattcacaaaaatgttttggaatatattccttgggaatgtgaagggtctcctatattacattaaacaaaaaaccatgcagttacttagagctcatagagctttctcaaaatcaactactgatcataacagcccaattaaaaactcaaacactttatattacagatatagagtttataatccagcaatgccaatataggtaatttgatagcccctatttgcaaagtgattaa

SEQ ID NO: 23629 - DNA, 601 bp, Human
ggtcatcctggtttcgtaggatgtagggaccactccagggccttgtgtcggctcgcacctctgtgcactgcccccggccttgctgagagccacagacattggccgactctgcacccaggcgtgggcagcactccttgttcactaggctgtccaccgtcatgcagactcgggggaactgaccctgggctcctggcaggattttgcagcccaagcaactgagcagaaacccccaccaaagggggctcatggctttataattgggagagctctctctctctcttactttccttgtctctgtcgyacttttctccttatcttctactctttcagtcttttcttttcagtattttttatttttctttgctttctattcctttcttcttaaaaaaatacccacaagaatcacagaggttacatgtgtgcacatgtgtacatgaacgtgcacacacaattttatgtgattcaaacaactaacagacttaatttccttagaagcgcctctaacaaccaaatttaatgagggtagcgcttctcaccatcttcccccgttaagtcaggctttgtctaattgagttaatttacagagcacccagtcatacta

SEQ ID NO: 23630 - DNA, 601 bp, Human
caggcgtgagccactgcaccaggcctaaagccagaactcttaatgtgaaaaaagaaatctaatgtctgggcactcatggacataaagatggcaacaataggcactggggactgctagagaggggagggagggaggggtcaaaggttgaaaaactacccactgggtgcttcgcacactacctgggtgacaggatcaatcatatctcaaaccctagcactgtgcaatatatctatgtcacaaacctgcacttgtatccccaggatctaaaataaagttgaaagttaaaattaaaaaaaaaaaatcgaatgtcattcctacaccaacatcacaggcctttgtatgttcccttagtaatacctattcaaccccttatgaagctcaatgacctatatcctcctatgttccagcatcctatgagaagagaagtaaaaagtatttttaaaaggaaaaagtcttctgcaaccacccagcctacaacagtgtccaagggctttcctgaggttgccacttgtgttttttgtatttcagtggccccctgccaggctttgagtgtttattcccgaagggcatatggctgctggaaactggaggtgggaaagat

SEQ ID NO: 23631 - DNA, 601 bp, Human
ccaagtagctgggattacaggtgcccatcaccacacctcgctaatttttgtatttttagtagagacagggtttcaccatgttggctaggctggtgttgaactcctgacccgtcttggcctcccaaagtgcttggctcccaaaggcgtgagccactgcgcttggccagcactttttcattgattgacatagaaataattgttctagaagtattttggggttttgaacaaagaagttactgtgttagtgtggttttcaatcacgctaaccacaccagcaacctgctcctcattcgtctaaaamaccatgataattttgagagaaggtctatagaagcaaatgcttaaaaaacttagaaaagctggataatatatatccaatatgttattgaaatttttgtcatgattaatacccagggcaaaaccaggacctagatattcttctgaatgacagaattaaaaatattactacaaaatgattataaagccagaactatttatttatttatttatttttttgagacagatctcactctgtcacccaggctggagtgcagtggtgtgatttctgctcactgcaacctctgcctcctgggttcaagag

SEQ ID NO: 23632 - DNA, 601 bp, Human
ttagagattctattattttaataacaatactttatacttacataggtcctttcatctacagaaatcaaaaggattttacaagtgtggtttcatcattatccccatttcagagattggaaaatggaggcaattagtcacttgtacaaacaagaagttcaccgtcaactgttcaaaaactatttggtgcgcaagtttttcagaagccaaaagacatagctgcaaatggcatattctcataaagccaactggcaggtaagccttataaggtgaatagcaaattcaaagtctcctgcaattcagytcttcctgacaattaagctcagtggcttttttgtttcaatttatccctacagagactatagagaagctctctacagagaatttcaccatagaatttagagttttaaaaaacaaatcccagaatttctatgtgtttctacttattaggctgaaattactttaccagcttcatgattatggaaactatgaggtgtttattttccaaagaattaacaacatttggggtcatcaatagtctgttacaagacactaatctacatctcttccttgagaaattttggatcatcccaggagtgcccca

SEQ ID NO: 23633 - DNA, 601 bp, Human
gttttggagcccatttatgacccagaaatttattcaattaaaaaattccttttccaagatgtctcagagaaattattccaaagctctgcagtcaggtccctttcatttctaagtttatagacctgacctgaagaatttgttgaaatgctggagatgactgaaaagtgtaacaacatgaaagcctagcagacaaaatgtttatttctttaatttagttttcctaatagcatcttccatcaatttaacatgatttagttttttcttcttaatctaccaatgcaaaaaatataagaagagaagygttttagaaagaaccgtgttatcttactgggaaatggagagaggaaaaaaaatgattcctagataatatcaatctatcgaccattgagtatgtccttcagtgaaaattaaatttaaagagtcaaagtctcatgtttacaaaggactatgataaaaatggaaaaaagagtgagatcatctaaacaccacacattcctacatgaactgcatcagctcaacctcagaaagccattagactaaataagcttaaagaccaccgattagtgaatttacaaggaactctaaatagcctattcctttt

SEQ ID NO: 23634 - DNA, 601 bp, Human
gtccaaatcagaatcttgctcttcaaagtgagcttgatgtcttcattcatcctgaccccaatgaaggaccccaaaaatggggagaggtgcacgtgcagccatgcattcaagaactgctatgggaagaatctaggatggagtcaagccctcctggaatacattggtgtctatggctttcctttgactgaaaaataaggacaaagctgaacctacttgatacatgaagtttgtaacagacaaccccctcattccaagtcctacccagcccccaatttttaagacttggaagggcaggtcaccratttctcaagcatccaacatgactgtgttgcaaagagctaagcagcagaaactctacattgctgtggctaagcttgtacttttccttgacaataaagctccaagaaacctggggattccggaccatgcaggagtaccataaatgattatctgaaagtctatcatgtgatagactgtctaaaatccatccaaagttgatctatcctgtgagtttaacaagatgcccactcccaacatgagcactctaattccgcacaaagaagcttcatgtgccttagcacatgttcagttaattcctcta
